US012227810B2

(12) United States Patent
Markowitz et al.

(10) Patent No.: US 12,227,810 B2
(45) Date of Patent: *Feb. 18, 2025

(54) METHODS AND COMPOSITIONS FOR DETECTING ESOPHAGEAL NEOPLASIAS AND/OR METAPLASIAS IN THE ESOPHAGUS

(71) Applicant: Case Western Reserve University, Cleveland, OH (US)

(72) Inventors: Sanford D. Markowitz, Pepper Pike, OH (US); Helen Moinova, Beachwood, OH (US); Amitabh Chak, University Heights, OH (US); Joseph Willis, Shaker Heights, OH (US); Thomas LaFramboise, Shaker Heights, OH (US)

(73) Assignee: Case Western Reserve University, Cleveland, OH (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/430,156

(22) Filed: Feb. 1, 2024

(65) Prior Publication Data

US 2024/0191306 A1 Jun. 13, 2024

Related U.S. Application Data

(63) Continuation of application No. 17/590,986, filed on Feb. 2, 2022, which is a continuation of application No. 16/315,405, filed as application No. PCT/US2017/040708 on Jul. 5, 2017.

(60) Provisional application No. 62/358,701, filed on Jul. 6, 2016.

(51) Int. Cl.
*C12Q 1/68* (2018.01)
*C12Q 1/6827* (2018.01)
*C12Q 1/6853* (2018.01)
*C12Q 1/6886* (2018.01)
*G01N 33/574* (2006.01)

(52) U.S. Cl.
CPC ......... *C12Q 1/6886* (2013.01); *C12Q 1/6827* (2013.01); *C12Q 1/6853* (2013.01); *G01N 33/574* (2013.01); *C12Q 2600/154* (2013.01); *C12Q 2600/156* (2013.01)

(58) Field of Classification Search
None
See application file for complete search history.

(56) References Cited

U.S. PATENT DOCUMENTS

| | | | |
|---|---|---|---|
| 7,485,420 B2 | 2/2009 | Markowitz | |
| 7,964,353 B2 | 6/2011 | Markowitz | |
| 8,221,977 B2 | 7/2012 | Markowitz | |
| 8,415,100 B2 | 4/2013 | Markowitz et al. | |
| 9,322,065 B2 | 4/2016 | Renard et al. | |
| 9,580,754 B2 | 2/2017 | Markowitz et al. | |
| 10,400,286 B2 | 9/2019 | Markowitz | |
| 10,450,615 B2 | 10/2019 | Markowitz et al. | |
| 11,136,629 B2 | 10/2021 | Markowitz et al. | |
| 2007/0161031 A1 | 7/2007 | Trinklein et al. | |
| 2008/0220433 A1 | 9/2008 | Ahlquist et al. | |
| 2010/0009359 A1 | 1/2010 | Markowitz | |
| 2010/0151468 A1 | 6/2010 | Esteller et al. | |
| 2012/0094287 A1 | 4/2012 | Markowitz et al. | |
| 2014/0206565 A1 | 7/2014 | Sekary et al. | |
| 2016/0317132 A1 | 11/2016 | Markowitz et al. | |
| 2017/0369948 A1 | 12/2017 | Markowitz et al. | |
| 2019/0136325 A1 | 5/2019 | Markowitz et al. | |

FOREIGN PATENT DOCUMENTS

| | | | | |
|---|---|---|---|---|
| EP | 2 626 435 A1 | 8/2013 | | |
| EP | 2 850 210 B1 | 9/2018 | | |
| JP | 2004-505612 A | 2/2004 | | |
| JP | 2008283947 A | 11/2008 | | |
| WO | WO-2010118016 A2 | 10/2010 | | |
| WO | WO-2012/178074 A1 | 12/2012 | | |
| WO | WO-2013/171504 A1 | 11/2013 | | |
| WO | WO-2014/159652 A2 | 10/2014 | | |
| WO | WO-2016109712 A1 * | 7/2016 | ........... | C12Q 1/6806 |
| WO | WO-2018009535 A1 | 1/2018 | | |

OTHER PUBLICATIONS

Adams et al., "Promoter Methylation in Cytology Specimens as an Early Detection Marker for Esophageal Squamous Dysplasia and Early Esophageal Squamous Cell Carcinoma", Cancer Prevention Research, vol. 1: 357-361 (2008).

Andersson, et al., "Filtration Device for On-Site Collection, Storage and Shipment of Cells from Urine and Its Application to DNA-Based Detection of Bladder Cancer," PLoS One, vol. 10(7): e0131889 (2015).

Andersson, et al., "Size-Based Enrichment of Exfoliated Tumor Cells in Urine Increases the Sensitivity for DNA-Based Detection of Bladder Cancer," PLOS One, vol. 9(4): e94023 (2014).

Brait, et al., "Aberrant Promoter Methylation of Multiple Genes during Pathogenesis of Bladder Cancer," Cancer Epidemiology, Biomarkers and Prevention, vol. 17(1): 2786-2794 (2008).

Brait, et al., "Association of Promoter Methylation of VGF and PGP9.5 with Ovarian Cancer Progression," PLoS One, vol. 8(9): e70878 (2013).

(Continued)

*Primary Examiner* — Juliet C Switzer
(74) *Attorney, Agent, or Firm* — White & Case LLP

(57) ABSTRACT

The disclosure provides methods for identifying genomic loci (e.g., vimentin and/or SqBE18) that are differentially methylated in metaplasias (e.g., Barrett's esophagus) and/or neoplastic cancers (e.g., esophageal cancers). Identification of methylated genomic loci has numerous uses, including for example, to characterize disease risk, to predict responsiveness to therapy, to non-invasively diagnose subjects and to treat subjects determined to have gastrointestinal metaplasias and/or neoplasias.

16 Claims, 11 Drawing Sheets

Specification includes a Sequence Listing.

(56) References Cited

OTHER PUBLICATIONS

Carvalho, et al., "Detection of Promoter Hypermethylation in Salivary Rinses as a Biomarker for Head and Neck Squamous Cell Carcinoma Surveillance," Clinical Cancer Research, vol. 17(14): 4782-4789 (2011).

Carvalho, et al., "TGFbetaR2 aberrant methylation is a potential prognostic marker and therapeutic target in multiple myeloma," International Journal of Cancer, vol. 125: 1985-1991 (2009).

Chujan, et al., "CCNA1 Promoter Methylation: a Potential Marker for Grading Papanicolaou Smear Cervical Squamous Intraepithelial Lesions," Asian Pacific Journal of Cancer Prevention, vol. 15(18): 7971-7975 (2014).

Colacino, et al., "Comprehensive Analysis of DNA Methylation in Head and Neck Squamous Cell Carcinoma Indicates Differences by Survival and Clinicopathologic Characteristics," PLoS One, vol. 8(1): e54742 (2013).

Dennis, J. et al., Aberrant Gene Methylation in the Neoplastic Progression of Barrett's Esophagus: Identification of Candidate Diagnostic Markers, Gastroenterology, vol. 140(5), Supplement 1 (Sa1092): S-222 (2011).

Galipeau, Patricia C., "Barrett's Esophagus and Esophael Adenocarcinoma Epigenetic Biomarker Discovery Using Infinium Methylation," illumina iCommunity Newsletter: 3-4 (2008).

GenBank record having accession AF124143. Apr. 20, 1999. *Homo sapiens* cyclin A1 gene, promoter region, exon 1, and partial cds 2 pages (1999).

Gonzalgo, et al., "Rapid quantitation of methylation differences at specific sites using methylation-sensitive single nucleotide primer extension (Ms-SNuPE)," Nucleic Acids Research, vol. 25(12): 2529-2531 (1997).

Haipeng, Bai et al., "The Research Progress of Esophageal Cancel and Its Treatment," Journal of Baotou Medical College, vol. 30(3): (3 pages) (2014).

Hall, et al., "p16 Promoter Methylation is a Potential Predictor of Malignant Transformation in Oral Epithelial Dysplasia," Cancer Epidemiology, Biomarkers and Prevention, vol. 17(8): 2174-2179 (2008).

Heller, et al., "Genome-Wide Transcriptional Response to 5-Aza-2'-Deoxycytidine and Trichostatin A in Multiple Myeloma Cells," Cancer Research, vol. 68(1): 44-54 (2008).

International Search Report and Written Opinion for Application PCT/US2015/068131 dated Jun. 6, 2016, 6 pages.

International Search Report and Written Opinion for Application PCT/US2017/040708 dated Aug. 28, 2017, 8 pages.

Kato, H. & Nakajima, M., "Treatments for esophageal cancer: a review", Gen Thorac Cardiovasc Surg., vol. 61(6): 330-335 (Sep. 4, 2013).

Kaz et al. "Unique Methylation Signatures and Molecular Subclasses of Barrett's Esophagus and Esophageal Adenocarcinoma Revealed by Methylation Array Analysis," Gastroenterology vol. 140 (5) Suppl. 1, S818 (May 2011).

Kaz, A.M. et al., "DNA methylation profiing in Barrett's esophagus and esophageal adenocarcinoma reveals unique methylation signatures and molecular subclasses," Epigenetics, Landes Bioscience, US, vol. 6(12): 1403-1412 (2011).

Kaz, et al. "Differential methylation in gene bodies and promoters in barrett's esophagus and esophageal adenocarcinoma revealed by genome-wide methylation array analysis," Gastroenterology, vol. 144 (5) Supp. 1 (May 2013).

Kim, et al., "Histone demethylase JMJD2B-mediated cell proliferation regulated by hypoxia and radiation in gastric cancer cell," Biochimica et Biophysica Acta, vol. 1819: 1200-1207 (2012).

Kitkumthorn, et al., "Cyclin A1 promoter hypermethylation in human papillomavirassociated cervical cancer," BMC Cancer, vol. 6(55) 9 pages (2006).

Klajic, et al., "DNA Methylation Status of Key Cell-Cycle Regulators Such as CDKNA2/p16 and CCNA1 Correlates with Treatment Response to Doxorubicin and 5-Fluorouracil in Locally Advanced Breast Tumors," Clinical Cancer Research, vol. 20(24): 6357-6366 (2014).

Koss et al., Evaluation of Esophageal Cytology Using a Neural Net-Based Interative Scanning System (the PAPNET System); Am J Clin Pathol 1998; 109:549-557 (Year: 1998).

Lee et al., "Analyzing the Cancer Methylome through targeted bisulfite sequencing", Cancer Lett., 340(2); 16 pages (2013).

Li, et al., "A network-based, integrative approach to identify genes with aberrant co-methylation in colorectal cancer," Molecular BioSystems, vol. 10: 180-190 (2014).

Li, et al., "Sensitive digital quantification of DNA methylation in clinical samples," Nature Biotechnology, vol. 27(9): 858-863 (2009).

Li, et al., "Supplemental files for 'A network-based, integrative approach to identify genes with aberrant co-methylation in colorectal cancer'," Electronic Supplementary Material (ESI) for Molecular BioSystems, 16 pages (2013).

Liang, et al., "Integrative Identification of Epstein-Barr VirAssociated Mutations and Epigenetic Alterations in Gastric Cancer," Gastroenterology, vol. 147(6): 1350-1362 (2014).

Lim, et al., "Cervical dysplasia: Assessing methylation status (Methylight) of CCNA1, DAPK1, HS3ST2, PAX1 and TFPI2 to improve diagnostic accuracy," Gynecologic Oncology, vol. 119: 225-231 (2010).

Lin et al., "State-of the-art molecular imaging in esophageal cancer management: implications for diagnosis, prognosis, and treatment," Journal of Gastroinestinal Oncology, vol. 6(1): 3-19 (2015).

Lin et al. "Deletion or epigenetic silencing of AJAP1 on 1p36 in glioblastoma," Mol Cancer Res. vol. 10, pp. 208-217 (Jan. 2012).

Loh, et al., "DNA methylation subgroups and the CpG island methylator phenotype in gastric cancer: a comprehensive profiling approach," BMC Gastroenterology, vol. 14(55) 11 pages (2014).

Longo, et al., "Evaluation of the methylation profile of exfoliated cell samples from patients with head and neck squamous cell carcinoma," Head and Neck, vol. 36: 631-637 (2014).

Maldonado, et al., "An epigenetic marker panel for recurrence risk prediction of low grade papillary urothelial cell carcinoma (LGPUCC) and its potential use for surveillance after transurethral resection using urine," Oncotarget, vol. 5(14): 5218-5233 (2014).

Moinova et al, "Aberrant Vimentin Methylation is Characteristic of Upper Gastrointestinal Pathologies," Cancer Epidemiology, Biomarkers and Prevention, vol. 21(4): 594-600 Feb. 7, 2012.

Müller, et al., "Methylation of the Cyclin A1 Promoter Correlates with Gene Silencing in Somatic Cell Lines, while Tissue-Specific Expression of Cyclin A1 Is Methylation Independent," Molecular and Cell Biology, vol. 20(9): 3316-3329 (2000).

New England Biolabs, Random Primers, p. 111, 96/97 catalog (1997).

Ongenaert, et al., "Discovery of DNA methylation markers in cervical cancer using relaxation ranking," BMC Medical Genomics, vol. 1(57) 15 pages (2008).

Redshaw, et al., "Quantification of epigenetic biomarkers: an evaluation of established and emerging methods for DNA methylation analysis", BMC Genomics, 15:1174, 14 pages (2014).

Rettori, et al., "Prognostic significance of TIMP3 hypermethylation in post-treatment salivary rinse from head and neck squamous cell carcinoma patients," Carcinogenesis, vol. 34(1): 20-27 (2013).

Rettori, et al., "TIMP3 and CCNA1 hypermethylation in HNSCC is associated with an increased incidence of second primary tumors," Journal of Translational Medicine, vol. 11(316) 11 pages (2013).

Sartor, et al., "Genome-wide methylation and expression differences in HPV(+) and HPV(-) squamous cell carcinoma cell lines are consistent with divergent mechanisms of carcinogenesis," Epigenetics, vol. 6(6): 777-787 (2011).

"Scientists Can Make Copies of a Gene through PCR," Scitable by Nature Education; downloaded on May 31, 2023 from https://www.nature.com/scitable/topicpage/scientists-can-make-copies-of-a-gene-6525968/ Nature Education; 4 pages (2014).

Shah, et al. "Endoscopic options for early stage esophageal cancer", Journal of; Gastrointestinal Oncology. 2015, vol. 6(1), pp. 20-30 (2015).

(56) References Cited

OTHER PUBLICATIONS

Shaw et al. The Role of Pyrosequencing in Head and Neck Cancer Epigenetics Arch Otolaryngol Head Neck Surg, vol. 134, No. 3, 251-256. (Year: 2008).

Shaw, et al., "Methylation enrichment pyrosequencing: combining the specificity of MSP with validation by pyrosequencing," Nucleic Acids Research, vol. 34(11): e78 (2006).

Shaw, et al., "Promoter methylation of P16, RARbeta, E-cadherin, cyclin A1 and cytoglobin in oral cancer: quantitative evaluation using pyrosequencing," British Journal of Cancer, vol. 94(4): 561-568 (2006).

Starlard-Davenport, et al., "Restoration of the methylation status of hypermethylated gene promoters by microRNA-29b in human breast cancer: A novel epigenetic therapeutic approach," Journal of Carcinogenesis, vol. 12(15) 18 pages (2013).

Stockdale et al. "Epigenetic alterations in Barrett's esophagus and esophageal adenocarcinoma: Identification and evaluation of potential biomarkers," Cancer Res., vol. 74, 19 Suppl, (Oct. 1, 2014).

Sun, et al., "Comparison of Promoter Hypermethylation Pattern in Salivary Rinses Collected with and without an Exfoliating Brush with Patients with HNSCC," PLOS One, vol. 7(3): e33642 (2012).

Sun, et al., "Detection of TIMP3 promoter hypermethylation in salivary rinse as an independent predictor of local recurrence-free survival in head and neck cancer," Clinical Cancer Research, vol. 18(4): 1082-1091 (2012).

Tan, et al., "Quantitative methylation analyses of resection margins predict local recurrences and disease-specific deaths in patients with head and neck squamous cell carcinomas," British Journal of Cancer, vol. 99(2): 357-363 (2008).

Tokumaru, et al., "Aberrant Promoter Hypermethylation of Cyclin A1 in Cancer", Japanese Journal of Head and Neck Cancer, 32(4) pp. 410-416 (2006) with English Abstract.

Tokumaru, et al., "Inverse Correlation between Cyclin A1 Hypermethylation and p53 Mutation in Head and Neck Cancer Identified by Reversal of Epigenetic Silencing," Cancer Research, vol. 64: 5982-5987 (2004).

Weiss, et al., "Promoter Methylation of Cyclin A1 Is Associated With Human Papillomavirus 16 Induced Head and Neck Squamous Cell Carcinoma Independently of p53 Mutation," Molecular Carcinogenesis, vol. 50: 680-688 (2011).

Wu, et al. "Aberrant gene methylation in the neoplastic progression of Barrett's; esophagus: identification of candidate diagnostic markers", Gastroenterology, vol.; 140, p. S-222 (2011).

Xiong, et al., "COBRA: a sensitive and quantitative DNA methylation assay," Nucleic Acids Research, vol. 25(12): 2532-2534 (1997).

Xu, E. et al., "Genome-wide methylation analysis shows similar patterns in Barrett's Esophagus and Esophageal Adenocarcinoma," Carcinogenesis, vol. 34(12): 2750-2756 Aug. 29, 2013.

Yanatatsaneejit, et al., "Human Papillomavirus's Physical State and Cyclin A1 Promoter Methylation in Cervical Cancer," International Journal of Gynecological Cancer, vol. 21(5): 902-906 (2011).

Yanatatsaneejit, et al., "Promoter hypermethylation of CCNA1, RARRES1, and HRASLS3 in nasopharyngeal carcinoma," Oral Oncology, vol. 44: 400-406 (2008).

Yang, et al., "Gene promoter methylation patterns throughout the process of cervical carcinogenesis," Cellular Oncology, vol. 32: 131-143 (2010).

Yang, et al., "Methylation Markers for CCNA1 and C13ORF18 Are Strongly Associated with High-Grade Cervical Intraepithelial Neoplasia and Cervical Cancer in Cervical Scrapings," Cancer Epidemiology, Biomarkers and Prevention, vol. 18(11): 3000-3007 (2009).

Yu, et al., "A Novel Set of DNA Methylation Markers in Urine Sediments for Sensitive/Specific Detection of Bladder Cancer," Clinical Cancer Research, vol. 13(24): 7296-7304 (2007).

Nava et al., "Photodynamic Therapy (PDT) Using HPPH for the Treatment of Precancerous Lesions Associated with Barrett's Esophagus," Lasers in Surgery and Medicine, vol. 43: 705-712 (2011).

\* cited by examiner

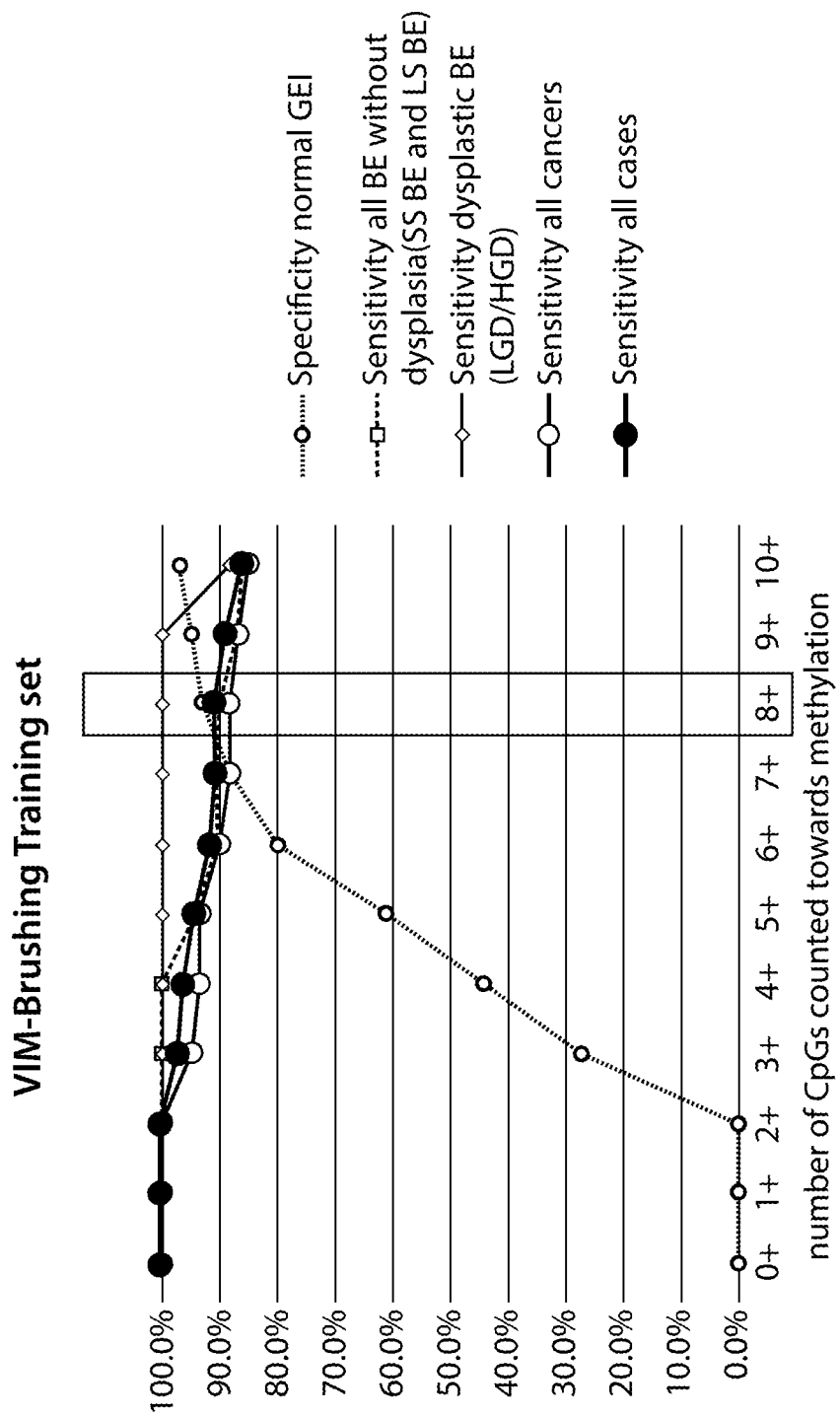

| | mVIM (Positive if > 1.05%) | | mSqBE18 (Positive if > 3.11%) | | Either mVIM or mSqBE18 Positive (one-marker fails censored) | | Either mVIM or mSqBE18 Positive (one-marker fails counted) | |
|---|---|---|---|---|---|---|---|---|
| | % | # | % | # | % | # | % | # |
| Specificity Control GEJ (GERD, EE, other) | 93.2% | 59 | 98.4% | 61 | 91.4% | 58 | 91.9% | 62 |
| Sensitivity ND SSBE | 91.7% | 12 | 83.3% | 12 | 91.7% | 12 | 91.7% | 12 |
| Sensitivity ND LSBE | 88.9% | 18 | 76.5% | 17 | 93.8% | 16 | 89.5% | 19 |
| Sensitivity NDBE combined | 90.0% | 30 | 79.3% | 29 | 92.9% | 28 | 90.3% | 31 |
| Sensitivity LGD | 100.0% | 7 | 87.5% | 8 | 100.0% | 7 | 100.0% | 8 |
| Sensitivity HGD | 100.0% | 10 | 100.0% | 10 | 100.0% | 10 | 100.0% | 10 |
| Sensitivity dysplastic BE combined | 100.0% | 17 | 94.4% | 18 | 100.0% | 17 | 100.0% | 18 |
| Sensitivity Cancer | 88.3% | 60 | 95.1% | 61 | 96.6% | 59 | 96.8% | 62 |
| All cases (NDBE through cancer) combined | 90.7% | 107 | 90.7% | 108 | 96.2% | 104 | 95.5% | 111 |

Fig. 3

| | mVIM (Positive if > 1.05%) | | mSqBE18 (Positive if > 3.11%) | | Either mVIM or mSqBE18 Positive (one-marker fails censored) | | Either mVIM or mSqBE18 Positive (one-marker fails counted) | |
|---|---|---|---|---|---|---|---|---|
| | % | # | % | # | % | # | % | # |
| Specificity Control GEJ (GERD, EE, other) | 92.6% | 27 | 92.9% | 28 | 88.5% | 26 | 89.7% | 29 |
| Sensitivity ND SSBE | 84.2% | 19 | 72.2% | 18 | 83.3% | 18 | 84.2% | 19 |
| Sensitivity ND LSBE | 100.0% | 22 | 86.4% | 22 | 100.0% | 22 | 100.0% | 22 |
| Sensitivity NDBE combined | 92.7% | 41 | 80.0% | 40 | 92.5% | 40 | 92.7% | 41 |
| Sensitivity LGD | 92.3% | 26 | 91.7% | 24 | 95.8% | 24 | 92.3% | 26 |
| Sensitivity HGD | 76.9% | 13 | 100.0% | 13 | 100.0% | 13 | 100.0% | 13 |
| Sensitivity dysplastic BE combined | 87.2% | 39 | 94.6% | 37 | 97.3% | 37 | 94.9% | 39 |
| Sensitivity Cancer | 94.6% | 37 | 94.7% | 38 | 94.6% | 37 | 94.7% | 38 |
| All cases (NDBE through cancer) combined | 91.5% | 117 | 89.6% | 115 | 94.7% | 114 | 94.1% | 118 |

Fig. 4

| | mVIM (Positive if > 1.05%) | | mSqBE18 (Positive if > 3.11%) | | Either mVIM or mSqBE18 Positive | |
|---|---|---|---|---|---|---|
| | % | # | % | # | % | # |
| Specificity Control GEJ (GERD, EE, other) | 93.0% | 86 | 96.6% | 89 | 90.5% | 84 |
| Sensitivity ND SSBE | 87.1% | 31 | 76.7% | 30 | 87.1% | 31 |
| Sensitivity ND LSBE | 95.0% | 40 | 82.1% | 39 | 95.1% | 41 |
| Sensitivity NDBE combined | 91.5% | 71 | 79.7% | 69 | 91.7% | 72 |
| Sensitivity LGD | 93.9% | 33 | 90.6% | 32 | 94.1% | 34 |
| Sensitivity HGD | 87.0% | 23 | 100.0% | 23 | 100.0% | 23 |
| Sensitivity dysplastic BE combined | 91.1% | 56 | 94.5% | 55 | 96.5% | 57 |
| Sensitivity Cancer | 90.7% | 97 | 94.9% | 99 | 96.0% | 100 |

Fig. 5

| | mVIM (Positive if > 1%) | | mSqBE18 (Positive if > 1%) | | Either mVIM or mSqBE18 Positive | |
|---|---|---|---|---|---|---|
| | % | # | % | # | % | # |
| Specificity Control GEJ (GERD, EE, other) | 89.5% | 38 | 100.0% | 38 | 89.5% | 38 |
| Sensitivity ND SSBE | 69.2% | 13 | 53.8% | 13 | 84.6% | 13 |
| Sensitivity ND LSBE | 88.9% | 18 | 83.3% | 18 | 94.4% | 18 |
| Sensitivity NDBE combined | 80.6% | 31 | 71.0% | 31 | 90.3% | 31 |
| Sensitivity LGD | 83.3% | 6 | 100.0% | 6 | 100.0% | 6 |
| Sensitivity HGD | 50.0% | 4 | 50.0% | 4 | 50.0% | 4 |
| Sensitivity dysplastic BE combined | 72.7% | 11 | 72.7% | 11 | 81.8% | 11 |
| Sensitivity Cancer | 87.5% | 8 | 75.0% | 8 | 87.5% | 8 |

Fig. 7

METHODS AND COMPOSITIONS FOR DETECTING ESOPHAGEAL NEOPLASIAS AND/OR METAPLASIAS IN THE ESOPHAGUS

CROSS-REFERENCE TO RELATED APPLICATIONS

This application is a continuation of of U.S. application Ser. No. 17/590,986, filed on Feb. 2, 2022, which is a continuation of U.S. application Ser. No. 16/315,405, filed on Jan. 4, 2019, which is a United States National Stage filing under 35 U.S.C. § 371 of International Application No. PCT/US2017/040708, filed on Jul. 5, 2017, which claims priority to and the benefit of U.S. provisional application Ser. No. 62/358,701, filed on Jul. 6, 2016. The disclosures of each of the foregoing applications are hereby incorporated by reference in their entirety.

FUNDING

This invention was made with government support under UOICA152756; U54CA163060; and P50CA150964 awarded by the National Institutes of Health (NIH). The government has certain rights in the invention.

SEQUENCE LISTING

The instant application contains a Sequence Listing which has been submitted electronically in XML file format and is hereby incorporated by reference in its entirety. Said XML copy, created on Feb. 5, 2024, is named 1848493-0002-098-303_SL.XML and is 24,024,017 bytes in size

BACKGROUND

Over 15,000 new cases of esophageal cancer were diagnosed in 2010, and there were nearly as many deaths from this cancer alone. As with other cancers, this rate can be decreased by improved methods for diagnosis. Although methods for detecting esophageal cancer exist, the methods are not ideal. Generally, a combination of endoscopy, isolation of cells (for example, via collection of cells/tissues from a fluid sample or from a tissue sample), and/or imaging technologies are used to identify cancerous cells and tumors. While upper endoscopy, usually performed by a gastroenterologist, can detect neoplasias of the esophagus, as well as of the stomach and duodenum, it is an uncomfortable and expensive procedure. Other detection procedures, such as barium esophogography are also available, but are associated with false positives, false negatives, and cost and discomfort issues.

Because of the disadvantages of existing methods for detecting or treating esophageal neoplasias/cancers, new methods are needed for esophageal neoplasia/cancer diagnosis and therapy.

SUMMARY OF THE DISCLOSURE

In certain aspects, the present disclosure is based in part on the discovery of particular human genomic DNA regions (also referred to herein as informative loci or patches) in which the cytosines within CpG dinucleotides are differentially methylated in esophageal neoplasia compared to normal human tissues.

A first aspect of the present disclosure provides a method of diagnosing whether a subject has an esophageal neoplasia or metaplasia, comprising: obtaining a sample from a subject; measuring the amount of methylated cytosines in CpG dinucleotides in a vimentin nucleic acid sequence, or portion thereof, obtained from the sample; wherein if at least 80% of the cytosines in CpG dinucleotides in the vimentin nucleic acid sequence, or portion thereof, are methylated, than the vimentin nucleic acid sequence, or portion thereof, is considered a methylated read; and measuring the number of methylated reads present in the sample; wherein if at least 1% of the vimentin nucleic acid sequences, or portions thereof, in the sample are methylated reads, than the subject is determined to have an esophageal neoplasia or metaplasia.

In some embodiments, the vimentin nucleic acid sequences from the sample are treated with bisulfite. Optionally, the sequence of the bisulfite converted nucleic acid sequences is determined by next-generation sequencing. In some embodiments, the level of methylated cytosines is determined in an amplified portion of the vimentin nucleic acid sequence obtained from the subject. Optionally, between the amplification primers, the amplified portion comprises 10 dinucleotides that correspond to or are derived from 10 CpG dinucleotides present in the native non-bisulfite treated vimentin genomic sequence. In some embodiments, the primers used to amplify the portion of the vimentin nucleic acid sequence comprise SEQ ID NOs: 16209 and 16210. Optionally, the amplified portion comprises the nucleotide sequence of SEQ ID NOs: 16207 and/or 16208. In some embodiments, the 10 CpGs correspond to those that, after bisulfite treatment, are included in SEQ ID Nos: 16211 and 16212.

In some embodiments, if at least 1.05% of the vimentin nucleic acid sequences, or portions thereof, in the sample are methylated reads, than the subject is determined to have an esophageal neoplasia or metaplasia. Optionally, if at least 3% of the vimentin nucleic acid sequences, or portions thereof, in the sample are methylated reads, than the subject is determined to have an esophageal neoplasia or metaplasia. In some embodiments, if at least 5% of the vimentin nucleic acid sequences, or portions thereof, in the sample are methylated reads, than the subject is determined to have an esophageal neoplasia or metaplasia.

In some embodiments, if the subject is determined to have an esophageal neoplasia or metaplasia, then administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

A second aspect of the present disclosure provides a method of treating a subject having an esophageal neoplasia or metaplasia, wherein it has been previously determined that at least 1% of the vimentin nucleic acid sequences, or portions thereof, in a sample from the subject have at least 80% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. Optionally, the surgery is endoscopic mucosal resection (EMR), esophagectomy, and/or anti-reflux surgery.

In some embodiments, the disclosure provides for a method of diagnosing whether a subject has an esophageal neoplasia or metaplasia, comprising: obtaining a sample from a subject by means of a brushing (e.g., a cytology brushing); measuring the amount of methylated cytosines in CpG dinucleotides in an SqBE18 nucleic acid sequence, or portion thereof, obtained from the sample; wherein if at least 70% or at least 75% of the cytosines in CpG dinucleotides in the SqBE18 nucleic acid sequence, or portion thereof, are methylated, than the SqBE18 nucleic acid sequence, or portion thereof, is considered a methylated read; and measuring the number of methylated reads present in the sample; wherein if at least 3% of the SqBE18 nucleic acid sequences, or portions thereof, in the sample are methylated reads, than the subject is determined to have an esophageal neoplasia or metaplasia. In some embodiments, the SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the SqBE18 nucleic acid sequence obtained from the subject. In some embodiments, the amplified portion comprises 21 dinucleotides that correspond to or are derived from 21 CpG dinucleotides present in the native non-bisulfite treated SqBE18 genomic sequence. In some embodiments, if at least 3.11% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 3% of the SqBE18 nucleic acid sequences, or portions thereof, in a brushing (e.g., a cytology brushing) sample from the subject have at least 70% or at least 75% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery. In some embodiments, the disclosure provides for a method of diagnosing whether a subject has an esophageal neoplasia or metaplasia, comprising: obtaining a sample from a subject by means of a balloon; measuring the amount of methylated cytosines in CpG dinucleotides in an SqBE18 nucleic acid sequence, or portion thereof, obtained from the sample; wherein if at least 70% or at least 75% of the cytosines in CpG dinucleotides in the SqBE18 nucleic acid sequence, or portion thereof, are methylated, than the SqBE18 nucleic acid sequence, or portion thereof, is considered a methylated read; and measuring the number of methylated reads present in the sample; wherein if at least 0.1% of the SqBE18 nucleic acid sequences, or portions thereof, in the sample are methylated reads, than the subject is determined to have an esophageal neoplasia or metaplasia. In some embodiments, the SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the SqBE18 nucleic acid sequence obtained from the subject. In some embodiments, the amplified portion comprises 21 dinucleotides that correspond to or are derived from 21 CpG dinucleotides present in the native non-bisulfite treated SqBE18 genomic sequence. In some embodiments, if at least 0.76% of the SqBE18 nucleic acid sequences, or portions thereof, in the sample are methylated reads, than the subject is determined to have an esophageal neoplasia or metaplasia. In some embodiments, if at least 1% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 1% of the SqBE18 nucleic acid sequences, or portions thereof, in a balloon sample from the subject have at least 70% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery.

In some embodiments, the disclosure provides for a method of diagnosing whether a subject has an esophageal neoplasia or metaplasia, comprising: obtaining a sample from a subject by means of a brushing (e.g., a cytology brushing); measuring the amount of methylated cytosines in CpG dinucleotides in a vimentin nucleic acid sequence, or portion thereof, obtained from the sample; wherein if at least 80% of the cytosines in CpG dinucleotides in the vimentin nucleic acid sequence, or portion thereof, are methylated, than the vimentin nucleic acid sequence, or portion thereof, is considered a vimentin methylated read; measuring the amount of methylated cytosines in CpG dinucleotides in an SqBE18 nucleic acid sequence, or portion thereof, obtained from the sample; wherein if at least 70% or 75% of the cytosines in CpG dinucleotides in the SqBE18 nucleic acid sequence, or portion thereof, are methylated, than the SqBE18 nucleic acid sequence, or portion thereof, is considered an SqBE18 methylated read; and measuring the number of methylated reads present in the sample; wherein if at least 1% of the vimentin nucleic acid sequences, or portions thereof, in the sample are vimentin methylated reads, and wherein if at least 3% of the SqBE18 nucleic acid sequences, or portions thereof, in the sample are SqBE18 methylated reads, than the subject is determined to have an esophageal neoplasia or metaplasia. In some embodiments, the vimentin and SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the vimentin nucleic acid sequence and in an amplified portion of the SqBE18 nucleic acid sequence obtained from the subject. In some embodiments, the amplified portion of the SqBE18 nucleic acid sequence comprises 21 dinucleotides that correspond to or are derived from 21 CpG dinucleotides present in the native non-bisulfite treated SqBE18 genomic sequence. In some embodiments, the amplified portion of the vimentin nucleic acid sequence comprises 10 dinucleotides that correspond to or are derived from 10 CpG dinucleotides present in the native non-bisulfite treated vimentin genomic sequence. In some embodiments, if at least 1% of the vimentin nucleic acid sequences, or portions thereof, in the sample are vimentin methylated reads, wherein if at least 3.11% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 1% of the vimentin nucleic acid sequences, or portions thereof, in a brushing (e.g., a cytology brushing) sample from the subject have at least 80% of the CpG dinucleotides methylated, wherein it has been previously determined that at least 3% of the SqBE18 nucleic acid sequences, or portions thereof, in a brushing (e.g., a cytology brushing) sample from the subject have at least 75% of the CpG dinucleotides methylated, and wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery. In some embodiments, method of diagnosing whether a subject has an esophageal neoplasia or metaplasia, comprising: obtaining a sample from a subject by means of a balloon; measuring the amount of methylated cytosines in CpG dinucleotides in a vimentin nucleic acid sequence, or portion thereof, obtained from the sample; wherein if at least 80% of the cytosines in CpG dinucleotides in the vimentin nucleic acid sequence, or portion thereof, are methylated, than the vimentin nucleic acid sequence, or portion thereof, is considered a vimentin methylated read; measuring the amount of methylated cytosines in CpG dinucleotides in an SqBE18 nucleic acid sequence, or portion thereof, obtained from the sample; wherein if at least 70% or at least 75% of the cytosines in CpG dinucleotides in the SqBE18 nucleic acid sequence, or portion thereof, are methylated, than the SqBE18 nucleic acid sequence, or portion thereof, is considered a SqBE18 methylated read; and measuring the number of methylated reads present in the sample; wherein if at least 0.95% of the vimentin nucleic acid sequences, or portions thereof, in the sample are vimentin methylated reads, and wherein if at least 0.1% of the SqBE18 nucleic acid sequences, or portions thereof, in the sample are SqBE18 methylated reads, than the subject is determined to have an esophageal neoplasia or metaplasia. In some embodiments, the vimentin and SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the vimentin nucleic acid sequence and in an amplified portion of the SqBE18 nucleic acid sequence obtained from the subject. In some embodiments, the amplified portion comprises 21 dinucleotides that correspond to or are derived from 21 CpG dinucleotides present in the native non-bisulfite treated SqBE18 genomic sequence. In some embodiments, the amplified portion of the vimentin nucleic acid sequence comprises 10 dinucleotides that correspond to or are derived from 10 CpG dinucleotides present in the native non-bisulfite treated vimentin genomic sequence. In some embodiments, if at least 1% of the vimentin nucleic acid sequences, or portions thereof and if at least 0.76% of the SqBE18 nucleic acid sequences, or portions thereof, in the sample are methylated reads, than the subject is determined to have an esophageal neoplasia or metaplasia. In some embodiments, if at least 1% of the vimentin nucleic acid sequences, or portions thereof and at least 1% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 1% of the SqBE18 nucleic acid sequences, or portions thereof, in a balloon sample from the subject have at least 70% h or at least 75% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery.

In some embodiments, the primers used to amplify the portion of the SqBe18 nucleic acid sequence in any of the methods disclosed herein comprise SEQ ID NOs: 8388 and/or 8402. In some embodiments, the amplified portion comprises the nucleotide sequence of SEQ ID NOs: 8318, 8360, 8332 and/or 8374. In some embodiments, the amplified portion comprises the nucleotide sequence of SEQ ID NOs: 8332 and/or 8374. In some embodiments, the determination that the subject has an esophageal neoplasia or metaplasia is confirmed by an additional diagnostic assay. In some embodiments, the additional diagnostic assay is an endoscopic assay.

BRIEF DESCRIPTION OF THE FIGURES

FIG. 1A shows a ROC curve based on Next-Generation Bisulfite Sequencing assay for SqBE18 in the training set of 61 controls and 108 cases. FIG. 1B shows a ROC curve based on Next-Generation Bisulfite Sequencing VIM assay in the training set of 59 controls and 107 cases. FIG. 1C shows a ROC curve based on Next-Generation Bisulfite Sequencing assay for SqBE18 in the validation set of 28 controls and 115 cases. FIG. 1D shows a ROC curve based on Next-Generation Bisulfite Sequencing VIM assay in the validation set of 27 controls and 117 cases. Area under the curve (AUC), and the sensitivity and specificity of the assay at the optimal cutpoint are listed for each of FIGS. 1A-1D. The numbers of cases and controls for each marker in the training and validation set reflect the number of samples that were sequenced with the depth of greater than 80 reads for each marker. (median read depth was 3,809 for SqBE18, and 10,021 for VIM).

FIGS. 2A and 2B show VIM and SqBE18 performance at different numbers of CpG cutoff for positivity, using the ROC cutoff for percent methylation. FIG. 2A shows a VIM Sensitivity and specificity curve. The 8+ CpG cutoff (blue box), maximizes the sum of specificity for controls and sensitivity for cases. FIG. 2B shows a SqBE18 Sensitivity and specificity curve. The 15+, 16+, and 17+ CpG cutoffs offer identical maximum sensitivity+ specificity sum for SqBE18. 16+ CpGs (blue box), was chosen as the middle of this range.

FIG. 3 is a table showing the performance of VIM and SqBE18 in a training set of brushings. Specificity Controls of the Gastroesophageal Junction (GEJ)=Unaffected controls (individuals with GERD, erosive esophagitis (EE), or no pathology detected during endoscopy ("other")); SSBE=short-segment Barrett's Esophagus (1 to 3 cm)); LSBE=Barrett's Esophagus (3 cm or more); LGD=Barret's Esophagus with Low-Grade Dysplasia; HGD=Barrett's Esophagus with High-Grade Dysplasia; Cancer=includes EAC (Esophageal adenocarcinoma) and JCA (Junctional cancer of the esophagus).

FIG. 4 is a table showing the performance of VIM and SqBE18 in VALIDATION set of brushings. Specificity Controls of the Gastroesophageal Junction (GEJ)=Unaffected controls (individuals with GERD, erosive esophagitis (EE), or no pathology detected during endoscopy ("other")); SSBE=short-segment Barrett's Esophagus (1 to 3 cm)); LSBE=Barrett's Esophagus (3 cm or more); LGD=Barret's Esophagus with Low-Grade Dysplasia; HGD=Barrett's Esophagus with High-Grade Dysplasia; Cancer=includes EAC (Esophageal adenocarcinoma) and JCA (Junctional cancer of the esophagus).

FIG. 5 is a table showing the performance of VIM and SqBE18 in a combination set of brushings. This table includes all the samples from training and validation set of brushings combined. Specificity Controls of the Gastroesophageal Junction (GEJ)=Unaffected controls (individuals with GERD, erosive esophagitis (EE), or no pathology detected during endoscopy ("other")); SSBE=short-segment Barrett's Esophagus (I to 3 cm)); LSBE=Barrett's Esophagus (3 cm or more); LGD=Barret's Esophagus with Low-Grade Dysplasia; HGD=Barrett's Esophagus with High-Grade Dysplasia; Cancer=includes EAC (Esophageal adenocarcinoma) and JCA (Junctional cancer of the esophagus).

FIG. 6A shows a ROC curve based on Next-Generation Bisulfite Sequencing assay for VIM in the training set of 38 controls and 50 cases. FIG. 6B shows a ROC curve based on Next-Generation Bisulfite Sequencing SqBE18 assay in the training set of 38 controls and 50 cases. Area under the curve (AUC), and the sensitivity and specificity of the assay at the optimal cutpoint are listed for each graph.

FIG. 7 is a table showing performance of VIM and SqBE18 in Esophageal balloon samples. Specificity Controls of the Gastroesophageal Junction (GEJ)=Unaffected controls (individuals with GERD, erosive esophagitis (EE), or no pathology detected during endoscopy ("other")); SSBE=short-segment Barrett's Esophagus (1 to 3 cm)); LSBE=Barrett's Esophagus (3 cm or more); LGD=Barret's Esophagus with Low-Grade Dysplasia; HGD=Barrett's Esophagus with High-Grade Dysplasia; Cancer=includes EAC (Esophageal adenocarcinoma) and JCA (Junctional cancer of the esophagus).

DETAILED DESCRIPTION OF THE INVENTION

I. Definitions

Figure 1A:
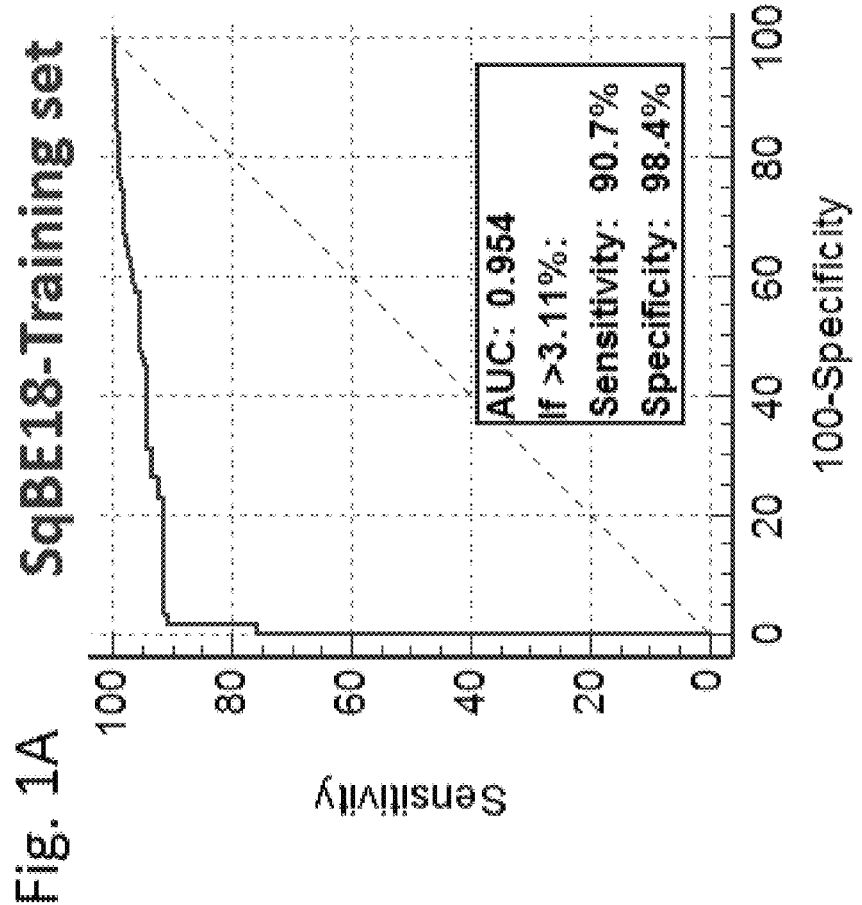
FIGS. 1A-1D show the Receiver Operating Characteristic (ROC) curves of methylated vimentin (VIM) and SqBE18 measurement in esophageal cytology brushings of the normal appearing GE junction or of endoscopically visualized BE or EAC.

For convenience, certain terms employed in the specification, examples, and appended claims are collected here. Unless defined otherwise, all technical and scientific terms used herein have the same meaning as commonly understood by one of ordinary skill in the art to which this invention belongs.

Although methods and materials similar or equivalent to those described herein can be used in the practice or testing of the present invention, suitable methods and materials are described below. The materials, methods and examples are illustrative only, and are not intended to be limiting. All publications, patents and other documents mentioned herein are incorporated by reference in their entirety.

Each embodiment of the invention described herein may be taken alone or in combination with one or more other embodiments of the invention.

Throughout this specification, the word "comprise" or variations such as "comprises" or "comprising" will be understood to imply the inclusion of a stated integer or groups of integers but not the exclusion of any other integer or group of integers.

The articles "a" and "an" are used herein to refer to one or to more than one (i.e., to at least one) of the grammatical object of the article. By way of example, "an element" means one element or more than one element.

The terms "adenoma" is used herein to describe any precancerous neoplasia or benign tumor of epithelial tissue, for example, a precancerous neoplasia of the gastrointestinal tract, pancreas, and/or the bladder.

The term "blood-derived fraction" herein refers to a component or components of whole blood. Whole blood comprises a liquid portion (i.e., plasma) and a solid portion (i.e., blood cells). The liquid and solid portions of blood are each comprised of multiple components; e.g., different proteins in plasma or different cell types in the solid portion. One of these components or a mixture of any of these components is a blood-derived fraction as long as such fraction is missing one or more components found in whole blood.

The term "esphophagus" is intended to encompass the upper portion of the digestive system spanning from the back of the oral cavity, passing downwards through the rear part of the mediastinum, through the diaphragm and into the stomach.

The term "esophageal cancer" is used herein to refer to any cancerous neoplasia of the esophagus.

"Barrett's esophagus" as used herein refers to an abnormal change (metaplasia) in the cells of the lower portion of the esophagus. Barrett's is characterized the finding of intestinal metaplasia in the esophagus.

A "brushing" of the esophagus, as referred to herein, may be obtained using any of the means known in the art. In some embodiments, a brushing is obtained by contacting the esophagus with a brush, a cytology brush, a sponge, a balloon, or with any other device or substance that contacts the esophagus and obtains an esophageal sample.

"Cells," "host cells" or "recombinant host cells" are terms used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

The terms "compound", "test compound," "agent", and "molecule" are used herein interchangeably and are meant to include, but are not limited to, peptides, nucleic acids, carbohydrates, small organic molecules, natural product extract libraries, and any other molecules (including, but not limited to, chemicals, metals, and organometallic compounds).

The term "compound-converted DNA" herein refers to DNA that has been treated or reacted with a chemical compound that converts unmethylated C bases in DNA to a different nucleotide base. For example, one such compound is sodium bisulfite, which converts unmethylated C to U. If DNA that contains conversion-sensitive cytosine is treated with sodium bisulfite, the compound-converted DNA will contain U in place of C. If the DNA which is treated with sodium bisulfite contains only methylcytosine, the compound-converted DNA will not contain uracil in place of the methylcytosine.

The term "de-methylating agent" as used herein refers agents that restore activity and/or gene expression of target genes silenced by methylation upon treatment with the agent. Examples of such agents include without limitation 5-azacytidine and 5-aza-2'-deoxycytidine.

The term "detection" is used herein to refer to any process of observing a marker, or a change in a marker (such as for example the change in the methylation state of the marker), in a biological sample, whether or not the marker or the change in the marker is actually detected. In other words, the act of probing a sample for a marker or a change in the marker, is a "detection" even if the marker is determined to be not present or below the level of sensitivity. Detection may be a quantitative, semi-quantitative or non-quantitative observation.

The term "differentially methylated nucleotide sequence" refers to a region of a genomic loci that is found to be methylated in a in cancer tissues or cell lines, but not methylated in the normal tissues or cell lines.

The term "neoplasia" as used herein refers to an abnormal growth of tissue. As used herein, the term "neoplasia" may be used to refer to cancerous and non-cancerous tumors, as well as to Barrett's esophagus (which may also be referred to herein as a metaplasia) and Barrett's esophagus with dysplasia. In some embodiments, the Barrett's esophagus with dysplasia is Barrett's esophagus with high grade dysplasia. In some embodiments, the Barrett's esophagus with dysplasia is Barrett's esophagus with low grade dysplasia. In some embodiments, the neoplasia is a cancer (e.g., esophageal adenocarcinoma).

"Gastrointestinal neoplasia" refers to neoplasia of the upper and lower gastrointestinal tract. As commonly understood in the art, the upper gastrointestinal tract includes the esophagus, stomach, and duodenum; the lower gastrointestinal tract includes the remainder of the small intestine and all of the large intestine.

The terms "healthy", "normal," and "non-neoplastic" are used interchangeably herein to refer to a subject or particular cell or tissue that is devoid (at least to the limit of detection) of a disease condition, such as a neoplasia.

"Homology" or "identity" or "similarity" refers to sequence similarity between two peptides or between two nucleic acid molecules. Homology and identity can each be determined by comparing a position in each sequence which may be aligned for purposes of comparison. When an equivalent position in the compared sequences is occupied by the same base or amino acid, then the molecules are identical at that position; when the equivalent site occupied by the same or a similar amino acid residue (e.g., similar in steric and/or electronic nature), then the molecules can be referred to as homologous (similar) at that position. Expression as a percentage of homology/similarity or identity refers to a function of the number of identical or similar amino acids at positions shared by the compared sequences. A sequence which is "unrelated or "non-homologous" shares, in some embodiments, less than 40% identity, and in particular embodiments, less than 25% identity with a sequence of the present invention. In comparing two sequences, the absence of residues (amino acids or nucleic acids) or presence of extra residues also decreases the identity and homology/similarity.

The term "homology" describes a mathematically based comparison of sequence similarities which is used to identify genes or proteins with similar functions or motifs. The nucleic acid and protein sequences of the present invention may be used as a "query sequence" to perform a search against public databases to, for example, identify other family members, related sequences or homologs. Such searches can be performed using the NBLAST and XBLAST programs (version 2.0) of Altschul, et al. (1990) *J Mol. Biol.* 215:403-10. BLAST nucleotide searches can be performed with the NBLAST program, score-100, wordlength=12 to obtain nucleotide sequences homologous to nucleic acid molecules of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and BLAST) can be used. See www.ncbi.nlm.nih.gov.

As used herein, "identity" means the percentage of identical nucleotide or amino acid residues at corresponding positions in two or more sequences when the sequences are aligned to maximize sequence matching, i.e., taking into account gaps and insertions. Identity can be readily calculated by known methods, including but not limited to those described in (*Computational Molecular Biology*, Lesk, A. M., ed., Oxford University Press, New York, 1988; *Biocomputing*: Informatics and Genome Projects, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; and Carillo, H., and Lipman, D., SIAM J. Applied Math., 48: 1073, 1988). Methods to determine identity are designed to give the largest match between the sequences tested. Moreover, methods to determine identity are codified in publicly available computer programs. Computer program methods to determine identity between two sequences include, but are not limited to, the GCG program package (Devereux, J., et al., *Nucleic Acids Research* 12(1): 387 (1984)), BLASTP, BLASTN, and FASTA (Altschul, S. F. et al., *J. Molec. Biol.* 215: 403-410 (1990) and Altschul et al. *Nuc. Acids Res.* 25: 3389-3402 (1997)). The BLAST X program is publicly available from NCBI and other sources (*BLAST Manual*, Altschul, S., et al., NCBI NLM NIH Bethesda, Md. 20894; Altschul, S., et al., *J. Mol. Biol.* 215: 403-410 (1990)). The well known Smith Waterman algorithm may also be used to determine identity.

The term "including" is used herein to mean, and is used interchangeably with, the phrase "including but not limited to."

The term "isolated" as used herein with respect to nucleic acids, such as DNA or RNA, refers to molecules in a form which does not occur in nature. Moreover, an "isolated nucleic acid" is meant to include nucleic acid fragments which are not naturally occurring as fragments and would not be found in the natural state.

The term "methylation-specific PCR" ("MSP") herein refers to a polymerase chain reaction in which amplification of the compound-converted template sequence is performed. Two sets of primers are designed for use in MSP. Each set of primers comprises a forward primer and a reverse primer. One set of primers, called methylation-specific primers (see below), will amplify the compound-converted template sequence if C bases in CpG dinucleotides within the DNA are methylated. Another set of primers, called unmethylation-specific primers or primers for unmethylated sequences and the like (see below), will amplify the compound-converted template sequences if C bases in CpG dinucleotides within the DNA are not methylated.

As used herein, the term "nucleic acid" refers to polynucleotides such as deoxyribonucleic acid (DNA), and, where appropriate, ribonucleic acid (RNA). The term should also be understood to include, as equivalents, analogs of either RNA or DNA made from nucleotide analogs, and, as applicable to the embodiment being described, single-stranded (such as sense or antisense) and double-stranded polynucleotides.

"Operably linked" when describing the relationship between two DNA regions simply means that they are functionally related to each other. For example, a promoter or other transcriptional regulatory sequence is operably linked to a coding sequence if it controls the transcription of the coding sequence.

The term "or" is used herein to mean, and is used interchangeably with, the term "and/or", unless context clearly indicates otherwise.

The terms "proteins" and "polypeptides" are used interchangeably herein.

A "sample" includes any material that is obtained or prepared for detection of a molecular marker or a change in a molecular marker such as for example the methylation state, or any material that is contacted with a detection reagent or detection device for the purpose of detecting a molecular marker or a change in the molecular marker.

As used herein, "obtaining a sample" includes directly retrieving a sample from a subject to be assayed, or directly retrieving a sample from a subject to be stored and assayed at a later time. Alternatively, a sample may be obtained via a second party. That is, a sample may be obtained via, e.g., shipment, from another individual who has retrieved the sample, or otherwise obtained the sample.

A "subject" is any organism of interest, generally a mammalian subject, such as a mouse, and in particular embodiments, a human subject.

As used herein, the term "specifically hybridizes" refers to the ability of a nucleic acid probe/primer of the invention to hybridize to at least 12, 15, 20, 25, 30, 35, 40, 45, 50 or 100 consecutive nucleotides of a target sequence, or a sequence complementary thereto, or naturally occurring mutants thereof, such that it has, in some embodiments, less than 15%, less than 10%, or less than 5% background hybridization to a cellular nucleic acid (e.g., mRNA or genomic DNA) other than the target gene. A variety of hybridization conditions may be used to detect specific hybridization, and the stringency is determined primarily by the wash stage of the hybridization assay. Generally high temperatures and low salt concentrations give high stringency, while low temperatures and high salt concentrations give low stringency. Low stringency hybridization is achieved by washing in, for example, about 2.0×SSC at 50° C., and high stringency is achieved with about 0.2×SSC at 50° C. Further descriptions of stringency are provided below.

As applied to polypeptides, the term "substantial sequence identity" means that two peptide sequences, when optimally aligned such as by the programs GAP or BESTFIT using default gap, share at least 90 percent sequence identity, in some embodiments, at least 95 percent sequence identity, or at least 99 percent sequence identity or more. In some embodiments, residue positions which are not identical differ by conservative amino acid substitutions. For example, the substitution of amino acids having similar chemical properties such as charge or polarity is not likely to affect the properties of a protein. Examples include glutamine for asparagine or glutamic acid for aspartic acid.

An "informative loci" as used herein, refers to any of the nucleic acid sequences disclosed herein that may have altered (e.g., increased) methylation in a sample (e.g., an esophageal tissue sample) from a subject having Barrett's esophagus and/or an esophageal neoplasia as compared to the methylation patterns of the corresponding nucleic acid sequence in a sample from a healthy control subject. An example of an informative loci is vimentin.

The term "Up3" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12563, 12581, 12599, 12617, or fragments or reverse complements thereof. In some embodiments, the Up3 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12569, 12587, 12605 or 12623, or fragments or reverse complements thereof. In some embodiments, the Up3 sequence refers to a bisulfite converted product of a methylated nucleotide sequence comprising a sequence at least 80%, 85%, 90%, 91%, 92%, 93%, 94%, 95%, 96%, 97%, 98%, 99% h or 100% identity to the sequence of SEQ ID NO: 12575, 12593, 12611 or 12629, or fragments or reverse complements thereof. In some embodiments, the Up3 sequence may be amplified using primers comprising the sequence of SEQ ID NOs: 12635 and/or 12641, or fragments or reverse complements thereof.

The term "Up10" as used herein refers to a nucleotide sequence comprising a sequence at least 80%, 85%, 90%, 91%, 92%, 93%, 94%, 95%, 96%, 97%, 98%, 99%/h or 100% identity to the sequence of SEQ ID NO: 12564, 12582, 12600 or 12618, or fragments or reverse complements thereof. In some embodiments, the Up10 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12570, 12588, 12606 or 12624, or fragments or reverse complements thereof. In some embodiments, the Up10 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12576, 12594, 12612 or 12630, or fragments or reverse complements thereof. In some embodiments, the Up10 sequence may be amplified using primers comprising the sequence of SEQ ID NOs: 12636 and/or 12642, or fragments or reverse complements thereof.

The term "Up15-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12565, 12583, 12601 or 12619, or fragments or reverse complements thereof. In some embodiments, the Up15-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12571, 12589, 12607 or 12625, or fragments or reverse complements thereof. In some embodiments, the Up15-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12577, 12595, 12613 or 12631, or fragments or reverse complements thereof. In some embodiments, the Up15-1 sequence may be amplified using primers comprising the sequence of SEQ ID NOs: 12637 and/or 12643, or fragments or reverse complements thereof.

The term "Up15-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12565, 12583, 12647 or 12656, or fragments or reverse complements thereof. In some embodiments, the Up15-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12571, 12589, 12650 or 12659, or fragments or reverse complements thereof. In some embodiments, the Up15-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12577, 12595, 12653 or 12662, or fragments or reverse complements thereof. In some embodiments, the Up15-2 sequence may be amplified using primers comprising the sequence of SEQ ID NOs: 12665 and/or 12668, or fragments or reverse complements thereof.

The term "Up20-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12566, 12584, 12602 or 12620, or fragments or reverse complements thereof. In some embodiments, the Up20-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12572, 12590, 12608 or 12626, or fragments or reverse complements thereof. In some embodiments, the Up20-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12578, 12596, 12614 or 12632, or fragments or reverse complements thereof. In some embodiments, the Up20-1 sequence may be amplified using primers comprising the sequence of SEQ ID NOs: 12638 and/or 12644, or fragments or reverse complements thereof.

The term "Up20-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12566, 12584, 12648 or 12657, or fragments or reverse complements thereof. In some embodiments, the Up20-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12572, 12590, 12651 or 12660, or fragments or reverse complements thereof. In some embodiments, the Up20-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12578, 12596, 12654 or 12663, or fragments or reverse complements thereof. In some embodiments, the Up20-2 sequence may be amplified using primers comprising the sequence of SEQ ID NOs: 12666 and/or 12669, or fragments or reverse complements thereof.

The term "Up27" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12567, 12585, 12603 or 12621, or fragments or reverse complements thereof. In some embodiments, the Up27 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12573, 12591, 12609 or 12627, or fragments or reverse complements thereof. In some embodiments, the Up27 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12579, 12597, 12615 or 12633, or fragments or reverse complements thereof. In some embodiments, the Up27 sequence may be amplified using primers comprising the sequence of SEQ ID NOs: 12639 and/or 12645, or fragments or reverse complements thereof.

The term "Up35-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12568, 12586, 12604 or 12622, or fragments or reverse complements thereof. In some embodiments, the Up35-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12574, 12592, 12610 or 12628, or fragments or reverse complements thereof. In some embodiments, the Up35-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12580, 12598, 12616 or 12634, or fragments or reverse complements thereof. In some embodiments, the Up35-1 sequence may be amplified using primers comprising the sequence of SEQ ID NOs: 12640 and/or 12646, or fragments or reverse complements thereof.

The term "Up35-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12568, 12586, 12649 or 12658, or fragments or reverse complements thereof. In some embodiments, the Up35-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12574, 12592, 12652 or 12661, or fragments or reverse complements thereof. In some embodiments, the Up35-2 sequence refers to a bisulfite converted product of a methylated nucleotide sequence comprising a sequence at least 80%, 85%, 90%, 91%, 92%, 93%, 94%, 95%, %%, 97%, 98%, 99% or 100% identity to the sequence of SEQ ID NO: 12580, 12598, 12655 or 12664, or fragments or reverse complements thereof. In some embodiments, the Up35-2 sequence may be amplified using primers comprising the sequence of SEQ ID NOs: 12667 and/or 12670, or fragments or reverse complements thereof.

The term "SqBE 2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8209, 8251, 8293 or 8335, or fragments or reverse complements thereof. In some embodiments, the SqBE 2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8223, 8265, 8307 or 8349, or fragments or reverse complements thereof. In some embodiments, the SqBE 2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8237, 8279, 8321 or 8363, or fragments or reverse complements thereof. In some embodiments, the SqBE 2 sequence may be amplified using primers comprising the sequence of SEQ ID NOs: 8377 and/or 8391, or fragments or reverse complements thereof.

The term "SqBE 5" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8210, 8252, 8294 or 8336, or fragments or reverse complements thereof. In some embodiments, the SqBE 5 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8224, 8266, 8308 or 8350, or fragments or reverse complements thereof. In some embodiments, the SqBE 5 sequence refers to a bisulfite converted product of a methylated nucleotide sequence comprising a sequence at least 80%, 85%, 90%, 91%, 92%, 93%, 94%, 95%, %%, 97%, 98%, 99% or 100% identity to the sequence of SEQ ID NO: 8238, 8280, 8322 or 8364, or fragments or reverse complements thereof. In some embodiments, the SqBE 5 sequence may be amplified using primers comprising the sequence of SEQ ID NOs: 8378 and/or 8392, or fragments or reverse complements thereof.

The term "SqBE 7" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8211, 8253, 8295 or 8337, or fragments or reverse complements thereof. In some embodiments, the SqBE 7 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8225, 8267, 8309 or 8351, or fragments or reverse complements thereof. In some embodiments, the SqBE 7 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8239, 8281, 8323 or 8365, or fragments or reverse complements thereof. In some embodiments, the SqBE 7 sequence may be amplified using primers comprising the sequence of SEQ ID NOs: 8379 and/or 8393, or fragments or reverse complements thereof.

The term "SqBE 9" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8212, 8254, 8296 or 8338, or fragments or reverse complements thereof. In some embodiments, the SqBE 9 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8226, 8268, 8310 or 8352, or fragments or reverse complements thereof. In some embodiments, the SqBE 9 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8240, 8282, 8324 or 8366, or fragments or reverse complements thereof. In some embodiments, the SqBE 9 sequence may be amplified using primers comprising the sequence of SEQ ID NOs: 8380 and/or 8394, or fragments or reverse complements thereof.

The term "SqBE 10" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8213, 8255, 8297 or 8339, or fragments or reverse complements thereof. In some embodiments, the SqBE 10 sequence refers to a bisulfite converted nucleotide sequence comprising a sequence at least 80%, 85%, 90%, 91%, 92%, 93%, 94%, 95%, 96%, 97%, 98%, 99% h or 100% identity to the sequence of SEQ ID NO: 8227, 8269, 8311 or 8353, or fragments or reverse complements thereof. In some embodiments, the SqBE 10 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8241, 8283, 8325 or 8367, or fragments or reverse complements thereof. In some embodiments, the SqBE 10 sequence may be amplified using primers comprising the sequence of SEQ ID NOs: 8381 and/or 8395, or fragments or reverse complements thereof.

The term "SqBE 11-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8214, 8256, 8298 or 8340, or fragments or reverse complements thereof. In some embodiments, the SqBE 11-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8228, 8270, 8312 or 8354, or fragments or reverse complements thereof. In some embodiments, the SqBE 11-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8242, 8284, 8326 or 8368, or fragments or reverse complements thereof. In some embodiments, the SqBE 11-1 sequence may be amplified using primers comprising the sequence of SEQ ID NOs: 8382 and/or 8396, or fragments or reverse complements thereof.

The term "SqBE 11-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8214, 8256, 8405 or 8420, or fragments or reverse complements thereof. In some embodiments, the SqBE 11-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8228, 8270, 8410 or 8425, or fragments or reverse complements thereof. In some embodiments, the SqBE 11-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8242, 8284, 8415 or 8430, or fragments or reverse complements thereof. In some embodiments, the SqBE 11-2 sequence may be amplified using primers comprising the sequence of SEQ ID NOs: 8435 and/or 8440, or fragments or reverse complements thereof.

The term "SqBE 13" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8215, 8257, 8299 or 8341, or fragments or reverse complements thereof. In some embodiments, the SqBE 13 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8229, 8271, 8313 or 8355, or fragments or reverse complements thereof. In some embodiments, the SqBE 13 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8243, 8285, 8327 or 8369, or fragments or reverse complements thereof. In some embodiments, the SqBE 13 sequence may be amplified using primers comprising the sequence of SEQ ID NOs: 8383 and/or 8397, or fragments or reverse complements thereof.

The term "SqBE 14-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8216, 8258, 8406 or 8421, or fragments or reverse complements thereof. In some embodiments, the SqBE 14-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8230, 8272, 8411 or 8426, or fragments or reverse complements thereof. In some embodiments, the SqBE 14-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8244, 8286, 8416 or 8431, or fragments or reverse complements thereof. In some embodiments, the SqBE 14-2 sequence may be amplified using primers comprising the sequence of SEQ ID NOs: 8436 and/or 8441, or fragments or reverse complements thereof.

The term "SqBE 15" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8217, 8259, 8301 or 8343, or fragments or reverse complements thereof. In some embodiments, the SqBE 15 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8231, 8273, 8315 or 8357, or fragments or reverse complements thereof. In some embodiments, the SqBE 15 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8245, 8287, 8329 or 8371, or fragments or reverse complements thereof. In some embodiments, the SqBE 15 sequence may be amplified using primers comprising the sequence of SEQ ID NOs: 8385 and/or 8399, or fragments or reverse complements thereof.

The term "SqBE 16-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8218, 8260, 8302 or 8344, or fragments or reverse complements thereof. In some embodiments, the SqBE 16-1 sequence refers to a bisulfite converted nucleotide sequence comprising a sequence at least 80%, 85%, 90%, 91%, 92%, 93%, 94%, 95%, 96%, 97%, 98%, 99% h or 100% identity to the sequence of SEQ ID NO: 8232, 8274, 8316 or 8358, or fragments or reverse complements thereof. In some embodiments, the SqBE 16-I sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8246, 8288, 8330 or 8372, or fragments or reverse complements thereof. In some embodiments, the SqBE 16-1 sequence may be amplified using primers comprising the sequence of SEQ ID NOs: 8386 and/or 8400, or fragments or reverse complements thereof.

The term "SqBE 16-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8218, 8260, 8407 or 8422, or fragments or reverse complements thereof. In some embodiments, the SqBE 16-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8232, 8274, 8412 or 8427, or fragments or reverse complements thereof. In some embodiments, the SqBE 16-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8246, 8288, 8417 or 8432, or fragments or reverse complements thereof. In some embodiments, the SqBE 16-2 sequence may be amplified using primers comprising the sequence of SEQ ID NOs: 8437 and/or 8442, or fragments or reverse complements thereof.

The term "SqBE 17-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8219, 8261, 8303 or 8345, or fragments or reverse complements thereof. In some embodiments, the SqBE 17-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8233, 8275, 8317 or 8359, or fragments or reverse complements thereof. In some embodiments, the SqBE 17-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8247, 8289, 8331 or 8373, or fragments or reverse complements thereof. In some embodiments, the SqBE 17-1 sequence may be amplified using primers comprising the sequence of SEQ ID NOs: 8387 and/or 8401, or fragments or reverse complements thereof.

The term "SqBE 18" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8220, 8262, 8304 or 8346, or fragments or reverse complements thereof. In some embodiments, the SqBE 18 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8234, 8276, 8318 or 8360, or fragments or reverse complements thereof. In some embodiments, the SqBE 18 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8248, 8290, 8332 or 8374, or fragments or reverse complements thereof. In some embodiments, the SqBE 18 sequence may be amplified using primers comprising the sequence of SEQ ID NOs: 8388 and/or 8402, or fragments or reverse complements thereof.

The term "SqBE 22-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8221, 8263, 8305 or 8347, or fragments or reverse complements thereof. In some embodiments, the SqBE 22-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8235, 8277, 8319 or 8361, or fragments or reverse complements thereof. In some embodiments, the SqBE 22-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8249, 8291, 8333 or 8375, or fragments or reverse complements thereof. In some embodiments, the SqBE 22-1 sequence may be amplified using primers comprising the sequence of SEQ ID NOs: 8389 and/or 8403, or fragments or reverse complements thereof.

The term "SqBE 22-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8221, 8263, 8409 or 8424, or fragments or reverse complements thereof. In some embodiments, the SqBE 22-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8235, 8277, 8414 or 8429, or fragments or reverse complements thereof. In some embodiments, the SqBE 22-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8249, 8291, 8419 or 8434, or fragments or reverse complements thereof. In some embodiments, the SqBE 22-2 sequence may be amplified using primers comprising the sequence of SEQ ID NOs: 8439 and/or 8444, or fragments or reverse complements thereof.

The term "SqBE 23" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8222, 8264, 8306 or 8348, or fragments or reverse complements thereof. In some embodiments, the SqBE 23 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8236, 8278, 8320 or 8362, or fragments or reverse complements thereof. In some embodiments, the SqBE 23 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8250, 8292, 8334 or 8376, or fragments or reverse complements thereof. In some embodiments, the SqBE 23 sequence may be amplified using primers comprising the sequence of SEQ ID NOs: 8390 and/or 8404, or fragments or reverse complements thereof.

In some instances, any of the nucleotide sequences disclosed herein contain one or more "Y" positions. Cytosine residues that may be methylated or unmethylated, and hence may be bisulfite converted to T (if unmethylated) or remain as a C (if methylated), are designated with a "Y." In some embodiments, a parental nucleotide sequence is fully unmethylated if the sequence comprises a T at every Y position following bisulfite conversion. In some embodiments, a parental nucleotide sequence is fully methylated if the sequence comprises a C at every Y position following bisulfite conversion. In some embodiments, a parental nucleotide sequence is partially methylated if the sequence comprises at least one C at a Y position and at least one T at a Y position of the sequence following bisulfite conversion. In some embodiments, the bisulfite converted sequences disclosed herein comprise at least one C at a Y position and at least one T at a Y position, i.e., the parental sequence is partially methylated.

II. Overview

This disclosure is based at least in part on the recognition that differential methylation of particular genomic loci (e.g., vimentin and/or SqBE18) may be indicative of a neoplasia or metaplasia of the upper gastrointestinal tract, e.g., esophagus. The present findings demonstrate that methylation at these genomic loci may be a useful biomarker of neoplasia in the upper gastrointestinal tract. The present findings further demonstrate that the status of methylation at these genomic loci used in combination with the status of somatic mutation(s) in TP53 may be a highly sensitive and specific biomarker of neoplasia in the upper gastrointestinal tract.

In general, neoplasias may develop through one of at least three different pathways, termed chromosomal instability, microsatellite instability, and the CpG island methylator phenotype (CIMP). Although there is some overlap, these pathways tend to present somewhat different biological behavior. By understanding the pathway of tumor development, the target genes involved, and the mechanisms underlying the genetic instability, it is possible to implement strategies to detect and treat the different types of neoplasias.

This disclosure is based, at least in part, on the recognition that certain target genes may be silenced or inactivated by the differential methylation of CpG islands in the 5' flanking or promoter regions of the target gene. CpG islands are clusters of cytosine-guanosine residues in a DNA sequence, which are prominently represented in the 5-flanking region or promoter region of about half the genes in our genome. In particular, this application is based at least in part on the recognition that differential methylation of particular genomic loci may be indicative of neoplasia of the upper gastrointestinal tract including, but not limited to, esophageal neoplasia.

Additionally, this disclosure is based, at least in part, on the recognition that somatic mutations in TP53 (e.g., any of the somatic TP53 mutations disclosed herein), in combination with methylation of certain informative loci as disclosed herein, may serve as useful indicators of neoplasia, including esophageal neoplasia (e.g., esophageal adenocarcinoma). In certain embodiments, the TP53 somatic mutation is any of the TP53 mutations disclosed herein. In certain embodiments, the TP53 somatic mutation is any nonsynonymous somatic mutation known in the art. In certain embodiments, the TP53 somatic mutation is any one or more mutation at any one or more amino acid residue corresponding to amino acid residue 72, 105, 108, 110, 113, 124, 127, 132, 144, 152, 163, 175, 183, 194, 213, 214, 218, 232, 234, 248, 265, 273, 278, 306, 337, 347, or 639 of SEQ ID NO: 16205. In certain embodiments, the TP53 somatic mutation is any one or more mutation selected from the group consisting of: Leu194Arg, Gly105Asp, Arg273His, Tyr163His, Ile232Thr, Arg213Ter, Arg273His, Arg248Gln, Arg175His, Arg110delinsGlnSer, Ser183Ter, Arg248Gln, Arg337Leu, Lys132Arg, Leu265ThrfsTer7, Arg306Ter, Cys124TrpfsTer25, Pro72Arg, Val218Glu, His214Leu, Gln144Ter, Phe113Ser, Tyr234His, Ser127Phe, Pro278Ala, Ala347Thr, and Pro152Leu of SEQ ID NO: 16205. In certain embodiments, the TP53 mutation is any one or more mutation at any one or more nucleotide position corresponding to nucleotide position 108, 215, 314, 338, 380, 395, 430, 455, 487, 524, 548, 581, 637, 639, 641, 653, 695, 700, 743, 818, 832, 916, 1010, or 1039 of SEQ ID NO: 16206.

The sequence of SEQ ID NO: 16205 (corresponding to GenBank Accession No. NP_000537.3) is as follows:

```
MEEPQSDPSVEPPLSQETFSDLWKLLPENNVLSPLPSQAMDDLMLSPDDI
EQWFTEDPGPDEAPRMPEAAPPVAPAPAAPTPAAPAPAPSWPLSSSVPSQ
KTYQGSYGFRLGFLHSGTAKSVTCTYSPALNKMFCQLAKTCPVQLWVDST
PPPGTRVRAMAIYKQSQHMTEVVRRCPHHERCSDSDGLAPPQHLIRVEGN
LRVEYLDDRNTFRHSVVVPYEPPEVGSDCTTIHYNYMCNSSCMGGMNRRP
ILTIITLEDSSGNLLGRNSFEVRVCACPGRDRRTEEENLRKKGEPHHELP
PGSTKRALPNNTSSSPQPKKKPLDGEYFTLQIRGRERFEMFRELNEALEL
KDAQAGKEPGGSRAHSSHLKSKKGQSTSRHKKLMFKTEGPDSD
```

The sequence of SEQ ID NO: 16206 (corresponding to GenBank Accession No. NM_000546.5) is as follows:

```
GATGGGATTGGGGTTTTCCCCTCCCATGTGCTCAAGACTGGCGCTAAAAG
TTTTGAGCTTCTCAAAAGTCTAGAGCCACCGTCCAGGGAGCAGGTAGCTG
CTGGGCTCCGGGGACACTTTGCGTTCGGGCTGGGAGCGTGCTTTCCACGA
CGGTGACACGCTTCCCTGGATTGGCAGCCAGACTGCCTTCCGGGTCACTG
CCATGGAGGAGCCGCAGTCAGATCCTAGCGTCGAGCCCCCTCTGAGTCAG
GAAACATTTTCAGACCTATGGAAACTACTTCCTGAAAACAACGTTCTGTC
CCCCTTGCCGTCCCAAGCAATGGATGATTTGATGCTGTCCCCGGACGATA
TTGAACAATGGTTCACTGAAGACCCAGGTCCAGATGAAGCTCCCAGAATG
```

```
CCAGAGGCTGCTCCCCCCGTGGCCCCTGCACCAGCAGCTCCTACACCGGC

GGCCCCTGCACCAGCCCCTCCTGGCCCCTGTCATCTTCTGTCCCTTCCC

AGAAAACCTACCAGGGCAGCTACGGTTTCCGTCTGGGCTTCTTGCATTCT

GGGACAGCCAAGTCTGTGACTTGCACGTACTCCCCTGCCCTCAACAAGAT

GTTTTGCCAACTGGCCAAGACCTGCCCTGTGCAGCTGTGGGTTGATTCCA

CACCCCCGCCCGGCACCCGCGTCCGCGCCATGGCCATCTACAAGCAGTCA

CAGCACATGACGGAGGTTGTGAGGCGCTGCCCCCACCATGAGCGCTGCTC

AGATAGCGATGGTCTGGCCCCTCCTCAGCATCTTATCCGAGTGGAAGGAA

ATTTGCGTGTGGAGTATTTGGATGACAGAAACACTTTTCGACATAGTGTG

GTGGTGCCCTATGAGCCGCCTGAGGTTGGCTCTGACTGTACCACCATCCA

CTACAACTACATGTGTAACAGTTCCTGCATGGGCGGCATGAACCGGAGGC

CCATCCTCACCATCATCACACTGGAAGACTCCAGTGGTAATCTACTGGGA

CGGAACAGCTTTGAGGTGCGTGTTTGTGCCTGTCCTGGGAGAGACCGGCG

CACAGAGGAAGAGAATCTCCGCAAGAAAGGGGAGCCTCACCACGAGCTGC

CCCCAGGGAGCACTAAGCGAGCACTGCCCAACAACACCAGCTCCTCTCCC

CAGCCAAAGAAGAAACCACTGGATGGAGAATATTTCACCCTTCAGATCCG

TGGGCGTGAGCGCTTCGAGATGTTCCGAGAGCTGAATGAGGCCTTGGAAC

TCAAGGATGCCCAGGCTGGGAAGGAGCCAGGGGGAGCAGGGCTCACTCC

AGCCACCTGAAGTCCAAAAAGGGTCAGTCTACCTCCCGCCATAAAAAACT

CATGTTCAAGACAGAAGGGCCTGACTCAGACTGACATTCTCCACTTCTTG

TTCCCCACTGACAGCCTCCCACCCCCATCTCTCCCTCCCCTGCCATTTTG

GGTTTTGGGTCTTTGAACCCTTGCTTGCAATAGGTGTGCGTCAGAAGCAC

CCAGGACTTCCATTTGCTTTGTCCCGGGGCTCCACTGAACAAGTTGGCCT

GCACTGGTGTTTTGTTGTGGGGAGGAGGATGGGGAGTAGGACATACCAGC

TTAGATTTTAAGGTTTTTACTGTGAGGGATGTTTGGGAGATGTAAGAAAT

GTTCTTGCAGTTAAGGGTTAGTTTACAATCAGCCACATTCTAGGTAGGGG

CCCACTTCACCGTACTAACCAGGGAAGCTGTCCCTCACTGTTGAATTTTC

TCTAACTTCAAGGCCCATATCTGTGAAATGCTGGCATTTGCACCTACCTC

ACAGAGTGCATTGTGAGGGTTAATGAAATAATGTACATCTGGCCTTGAAA

CCACCTTTTATTACATGGGGTCTAGAACTTGACCCCCTTGAGGGTGCTTG

TTCCCTCTCCCTGTTGGTCGGTGGGTTGGTAGTTTCTACAGTTGGGCAGC

TGGTTAGGTAGAGGGAGTTGTCAAGTCTCTGCTGGCCCAGCCAAACCCTG

TCTGACAACCTCTTGGTGAACCTTAGTACCTAAAAGGAAATCTCACCCCA

TCCCACACCCTGGAGGATTTCATCTCTTGTATATGATGATCTGGATCCAC

CAAGACTTGTTTTATGCTCAGGGTCAATTTCTTTTTTCTTTTTTTTTTTT

TTTTTTCTTTTTCTTTGAGACTGGGTCTCGCTTTGTTGCCCAGGCTGGAG

TGGAGTGGCGTGATCTTGGCTTACTGCAGCCTTTGCCTCCCCGGCTCGAG

CAGTCCTGCCTCAGCCTCCGGAGTAGCTGGGACCACAGGTTCATGCCACC

ATGGCCAGCCAACTTTTGCATGTTTTGTAGAGATGGGGTCTCACAGTGTT

GCCCAGGCTGGTCTCAAACTCCTGGGCTCAGGCGATCCACCTGTCTCAGC

CTCCCAGAGTGCTGGGATTACAATTGTGAGCCACCACGTCCAGCTGGAAG
```

```
GGTCAACATCTTTTACATTCTGCAAGCACATCTGCATTTTCACCCCACCC

TTCCCCTCCTTCTCCCTTTTTATATCCCATTTTTATATCGATCTCTTATT

TTACAATAAAACTTTGCTGCCACCTGTGTGTCTGAGGGGTG.
```

Esophageal adenocarcinoma (EAC) has steadily increased in incidence over recent decades. With an 85% mortality rate this cancer is the most rapidly increasing cause of cancer mortality from solid tumors in the American population. There has thus been substantial interest in development of screening approaches for early detection of EAC and its precursor lesions of Barrett's esophagus (BE). However, the majority of EACs develop in patients without prior symptoms, and current approaches of endoscopic screening of individuals with persistent symptoms of gastro-esophageal reflux disease, combined with longitudinal screening of those found to have BE, have accordingly not had significant impact on reducing deaths from EACs.

As noted above, early detection of gastrointestinal neoplasia (e.g., neoplasia of the upper gastrointestinal tract) coupled with appropriate intervention, is important for increasing patient survival rates. Present systems for screening for esophageal neoplasia are deficient for a variety of reasons, including a lack of specificity and/or sensitivity (e.g., barium swallow) or a high cost and intensive use of medical resources (e.g., upper endoscopy or CT scan). Alternative systems for detection of esophageal neoplasia would be useful in a wide range of other clinical circumstances as well. For example, detecting esophageal neoplasia may select the patient to undergo therapies that include, but are not limited, to resection of the neoplasia (via endoscopic resection or surgical resection), ablation of the neoplasia, chemotherapy, or radiation therapy. As a further example, patients who have received surgical and/or pharmaceutical therapy for esophageal cancer may experience a relapse. It would be advantageous to have an alternative system for determining whether such patients have a recurrent or relapsed neoplasia of the upper gastrointestinal tract. As a further example, an alternative diagnostic system would facilitate monitoring an increase, decrease or persistence of neoplasia of the upper gastrointestinal tract in a patient known to have such a neoplasia. A patient undergoing chemotherapy may be monitored to assess the effectiveness of the therapy.

III. Methylation of Informative Loci as Disease Biomarkers

The present disclosure relates at least in part to the identification of genomic loci whose altered DNA methylation is indicative of the presence of esophageal neoplasias and/or metaplasias that include Barrett's esophagus (BE) and/or esophageal adenocarcinoma (EAC). In some embodiments, the Barrett's esophagus is associated with dysplasia. In some embodiments, the dysplasia is high-grade dysplasia. In some embodiments, the dysplasia is low-grade dysplasia. In some embodiments, the methylation patterns of the informative loci as disclosed herein are determined in a sample taken from a subject as described herein and may be used to distinguish between subjects having Barrett's esophagus and subjects having high grade dysplasia and/or low grade dysplasia and/or esophageal adenocarcinoma. Examples of the informative loci are provided herein.

In some embodiments, any of the nucleotide sequences disclosed herein, or fragments or reverse complements thereof, may contain one or more "Y" residues. Cytosine residues that may be methylated or unmethylated, and hence may be bisulfite converted to T (if unmethylated) or remain as a C (if methylated), are designated with a "Y." In some embodiments, one or more of the Y residues in any of the sequences disclosed herein (or fragments or reverse complements thereof) designates a methylated C. In some embodiments, one or more of the Y residues in any of the sequences disclosed herein (or fragments or reverse complements thereof) designates an unmethylated C. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the sequences disclosed herein (or fragments or reverse complements thereof) correspond to methylated C residues. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the sequences disclosed herein (or fragments or reverse complements thereof) correspond to unmethylated C residues. In some embodiments, at least 10%, 20%, 30%, 40%, 50%, 60%, 70%, 80%, 90%, or 100% of the Y residues in any of the sequences disclosed herein (or fragments or reverse complements thereof) correspond to methylated C residues. In some embodiments, at least 10%, 20%, 30%, 40%, 50%, 60%, 70%, 80%, 90%, or 100% of the Y residues in any of the sequences disclosed herein (or fragments or reverse complements thereof) are correspond to unmethylated C residues. In some embodiments, any of the sequences disclosed herein (or fragments or reverse complements thereof) is bisulfite-converted. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the bisulfite-converted sequences disclosed herein (or fragments or reverse complements thereof) correspond to C. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the bisulfite-converted sequences disclosed herein (or fragments or reverse complements thereof) correspond to T. In some embodiments, at least 10%, 20%, 30%, 40%6, 50%, 60%, 70%, 80%, 90%, or 100% of the Y residues in any of the bisulfite-converted sequences disclosed herein (or fragments or reverse complements thereof) correspond to C residues. In some embodiments, at least 10%, 20%, 30%, 40%, 50%, 60%, 70%, 80%, 90%, or 100% of the Y residues in any of the bisulfite-converted sequences disclosed herein (or fragments or reverse complements thereof) correspond to T residues.

In some embodiments, an informative loci in a subject is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma) if the loci is at least 10%, 20%, 30%, 40%, 50%, 60%, 70%, 80%, 90%, or 100% methylated. In some embodiments, a DNA sample from a subject is treated with bisulfite, and the resulting bisulfite sequence corresponds to any of the nucleotide sequences disclosed herein comprising a "Y" nucleotide. In some embodiments, if at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, a DNA sample from a subject is treated with bisulfite, and the resulting bisulfite sequence corresponds to any of the nucleotide sequences disclosed herein comprising a "Y" nucleotide. In some embodiments, if at least 10%, 20%, 30%, 40%, 50%, 60%, 70%, 80%, 90%, or 100% of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). The disclosure provides for informative loci that may be used to assess whether a subject (e.g. a human) has or is prone to developing a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, one or more informative loci, as defined herein, may be used for determining whether a subject has or is likely to develop, a metaplasia (e.g., Barrett's esophagus). In some embodiments, one or more informative loci, as defined herein, may be used for determining whether a subject has or is likely to develop, a neoplasia (e.g., Barrett's esophagus with high grade dysplasia, or an esophageal cancer such as esophageal adenocarcinoma). In some embodiments, one or more informative loci, as defined herein, may be used to distinguish between whether a subject has a metaplasia in the esophagus (e.g., Barrett's esophagus) or an esophageal neoplasia (e.g., Barrett's esophagus with high grade dysplasia, or an esophageal cancer such as esophageal adenocarcinoma).

In some embodiments, the informative loci include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 1-428, 2569-2996, 5137-5531, 7507-7532, 7663-7668, 7819-7842, 7963-7976, 8047-8060, 8131-8143, 8209-8222, 8293-8306, 8405-8409, 8447-8632, 9563-9748, 10679-10825, 11561-11611, 11867-11917, 12173-12219, 12455-12460, 12491-12496, 12527-12532, 12563-12568, 12599-12604, 12647-12649, 12671-12907, 14093-14329, 15515-15537, 15653-15692, 15893-15932, 16133-16137, 16163-16165, 16181-16183, or 16199, or fragments or complements thereof. In particular embodiments, the informative loci include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 7963-7976, 8047-8060, 8131-8143, 12455-12460, 12491-12496, 12527-12532, 16163-16165, 16181-16183, or 16199, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 1-428, 2569-2996, 5137-5531, 7507-7532, 7663-7668, 7819-7842, 7963-7976, 8047-8060, 8131-8143, 8209-8222, 8293-8306, or 8405-8409, or fragments or complements thereof. In particular embodiments, the informative loci that are associated with increased methylation in both Barrett's esophagus and esophageal adenocarcinoma samples include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 7963-7976, 8047-8060, or 8131-8143, or fragments or complements thereof. In some embodiments, the informative loci are associated with increased methylation in an esophageal adenocarcinoma sample and/or a Barrett's with low grade or high grade dysplasia as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 8447-8632, 9563-9748, 10679-10825, 11561-11611, 11867-11917, 12173-12219, 12455-12460, 12491-12496, or 12527-12532, or fragments or complements thereof. In particular embodiments, the informative loci that are associated with increased methylation in Barrett's with low grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 12455-12460, 12491-12496, or 12527-12532, or fragments or complements thereof. In particular embodiments, the informative loci that are associated with increased methylation in an esophageal adenocarcinoma sample or a Barrett's with high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 12455-12460, 12491-12496, or 12527-12532, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% h or 100% identity to any of SEQ ID NOs: 12671-12908, 14093-14329, 15515-15537, 15653-15692, 15893-15932, 16133-16137, 16163-16165, 16181-16183, or 16199, or fragments or complements thereof. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to any of SEQ ID NOs: 16163-16165, 16181-16183, or 16199, or fragments or complements thereof.

In some embodiments, the informative loci or amplicon of the informative loci are treated with an agent, such as bisulfite. In some embodiments, the informative loci include sequences that have been treated with bisulfite. In some embodiments, the disclosure provides for bisulfite control sequences of any of the plus DNA strands disclosed herein. In some embodiments, the disclosure provides for bisulfite-treated unmethylated sequences of any of the plus DNA strands disclosed herein. In some embodiments, the bisulfite-converted plus-strand control DNA sequences include any one or more having at least 80%, 85%, 87%, 90%, 91%, 92%, 93%, 94%, 95%, 96%, 97%, 98%, 99% or 100% identity to any of SEQ ID NOs: 857-1284, 3425-3852, 5927-6321, 7559-7584, 7715-7740, 7867-7890, 7991-8004, 8075-8088, 8157-8169, 8223-8236, 8307-8320, 8410-8414, 8819-9004, 9935-10120, 10973-11119, 11663-11713, 11969-12019, 12267-12313, 12467-12472, 12503-12508, or 12539-12544, 12569-12574, 12605-12610, 12650-12652, or fragments or complements thereof. In particular embodiments, the bisulfite-converted plus-strand control DNA sequences include any one or more having at least 80%, 85%, 87%, 90%, 91%, 92%, 93%, 94%, 95%, 96%, 97%, 98%, 99% or 100% identity to any of SEQ ID NOs: 7991-8004, 8075-8088, 8157-8169, 8223-8236, 8307-8320, 8410-8414, 12467-12472, 12503-12508, or 12539-12544, 12569-12574, 12605-12610, 12650-12652, or fragments or complements thereof. In some embodiments, the informative loci are associated with increased methylation in both Barrett's esophagus and esophageal adenocarcinoma samples, as compared to the same sample types taken from a healthy control subject. In some embodiments, the disclosure provides for bisulfite-treated unmethylated sequences of any of the plus DNA strands that are associated with increased methylation in both Barrett's esophagus and esophageal adenocarcinoma samples, as compared to the same sample types taken from a healthy control subject. In some embodiments, the bisulfite converted sequences of any of the plus DNA strands that are associated with increased methylation in both Barrett's esophagus and esophageal adenocarcinoma samples are selected from the group consisting of sequences having at least 80%, 85%, 87%, 90%, 91%, 92%, 93%, 94%, 95%, 96%, 97%, 98%, 99% or 100% identity to any of SEQ ID NOs: 857-1284, 3425-3852, 5927-6321, 7559-7584, 7715-7740, 7867-7890, 7991-8004, 8075-8088, 8157-8169, 8223-8236, 8307-8320, or 8410-8414, or fragments or complements thereof. In particular embodiments, the bisulfite converted sequences of any of the plus DNA strands that are associated with increased methylation in both Barrett's esophagus and esophageal adenocarcinoma samples include any one or more bisulfite-converted methylated plus-strand DNA sequences selected from the group consisting of sequences having at least 80V., 85%, 87%, 90%, 91%, 92%, 93%, 94%, 95%, 9%, 97%, 98%, 99% or 100% identity to any of: SEQ ID NOs: 7991-8004, 8075-8088, 8157-8169, 8223-8236, 8307-8320, or 8410-8414, or fragments or complements thereof. In some embodiments, the disclosure provides for bisulfite-treated unmethylated sequences of any of the plus DNA strands that are associated with increased methylation in an esophageal adenocarcinoma sample or a Barrett's with low grade or high grade dysplasia sample as compared to a sample of the same type taken from a subject having Barrett's esophagus without dysplasia. In some embodiments, the bisulfite converted sequences of any of the plus DNA strands that are associated with increased methylation in an esophageal adenocarcinoma sample or a Barrett's with low grade or high grade dysplasia sample include any one or more bisulfite-converted methylated plus-strand DNA sequences selected from the group consisting having at least 80%, 85%, 87%, 90%, 91%, 92%, 93%, 94%, 95%, 96%, 97%, 98%, 99% or 100% identity to any of SEQ ID NOs: 8819-9004, 9935-10120, 10973-11119,11663-11713, 11969-12019, 12267-12313, 12467-12472, 12503-12508, 12539-12544, 12569-12574, 12605-12610, or 12650-12652, or fragments or complements thereof. In particular embodiments, the bisulfite converted sequences of any of the plus DNA strands that are associated with increased methylation in an esophageal adenocarcinoma sample or a Barrett's with low grade or high grade dysplasia sample include any one or more of the sequences having at least 80%, 85%, 87%, 90, 91%, 92%, 93%, 94%, 95%, 96%, 97%, 98%, 99% or 100% identity to any of SEQ ID NOs: 12467-12472, 12503-12508, 12539-12544, 12569-12574, 12605-12610, or 12650-12652, or fragments or complements thereof. In some embodiments, the informative loci are associated with reduced methylation in an esophageal adenocarcinoma sample as compared to a sample of the same type taken from a subject having Barrett's esophagus. In some embodiments, the disclosure provides for methylated control sequences of the plus DNA strand that are associated with reduced methylation in an esophageal adenocarcinoma sample as compared to a sample of the same type taken from a subject having Barrett's esophagus. In some embodiments, the methylated control sequences of any of the plus DNA strands that are associated with reduced methylation in an esophageal adenocarcinoma sample include any one or more bisulfite-converted methylated plus-strand DNA sequences selected from the group consisting having at least 80%, 85%, 87%, 90%, 91%, 92%, 93%, 94%, 95%, 96%, 97%, 98%, 99% or 100% identity to any of SEQ ID NOs: 13145-13381, 14567-14803, 15561-15583, 15733-15772, 15973-16012, 16143-16147, 16169-16171, 16187-16189 or 16201, or fragments or complements thereof. In particular embodiments, the methylated control sequences of any of the plus DNA strands that are associated with reduced methylation in an esophageal adenocarcinoma sample include any one or more bisulfite-converted methylated plus-strand DNA sequences selected from the group consisting having at least 80%, 85%, 87%, 90%, 91%, 92%, 93%, 94%, 95%, 96%, 97%, 98%, 99% or 100% identity to any of SEQ ID NOs: 16169-16171, 16187-16189 or 16201, or fragments or complements thereof.

In some embodiments, the informative loci or amplicon of the informative loci are treated with an agent, such as bisulfite. In some embodiments, the informative loci include sequences that have been treated with bisulfite. In some embodiments, the informative loci include methylated nucleic acid sequences that have been treated with bisulfite. In some embodiments, the bisulfite-converted methylated plus-strand DNA sequences have at least 80%, 85%, 87%, 90%, 91%, 92%, 93%, 94%, 95%, 96%, 97%, 98%, 99% or 100% identity to any of SEQ ID NOs: 1285-1712, 3853-4280, 6322-6716, 7585-7610, 7741-7766, 7891-7914, 8005-8018, 8089-8102, 8170-8182, 8237-8250, 8321-8334, 8415-8419, 9005-9190, 10121-10306, 11120-11266, 11714-11764, 12020-12070, 12314-12360, 12473-12478, 12509-12514 or 12545-12550, 12575-12580, 12611-12616, 12653-12655, or fragments or complements thereof. In particular embodiments, the bisulfite-converted methylated plus-strand DNA sequences have at least 80%, 85%, 87%, 90%, 91%, 92%, 93%, 94%, 95%, 96%, 97%, 98%, 99% or 100% identity to any of SEQ ID NOs: 8005-8018, 8089-8102, 8170-8182, 12473-12478, 12509-12514 or 12545-12550, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to any of SEQ ID NOs: 1285-1712, 3853-4280, 6322-6716, 7585-7610, 7741-7766, 7891-7914, 8005-8018, 8089-8102, 8170-8182, 8237-8250, 8321-8334, or 8415-8419, or fragments or complements thereof. In particular embodiments, the informative loci that are associated with increased methylation in both Barrett's esophagus and esophageal adenocarcinoma samples include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to: SEQ ID NOs: 8005-8018, 8089-8102, 8170-8182, 8237-8250, 8321-8334, or 8415-8419, or fragments or complements thereof. In some embodiments, the informative loci are associated with increased methylation in an esophageal adenocarcinoma sample or a Barrett's with low grade or high grade dysplasia sample as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 9005-9190, 10121-10306, 11120-11266, 11714-11764, 12020-12070, 12314-12360, 12473-12478, 12509-12514, 12545-12550, 12575-12580, 12611-12616, or 12653-12655, or fragments or complements thereof. In particular embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to SEQ ID NOs: 12473-12478, 12509-12514, 12545-12550, 12575-12580, 12611-12616, or 12653-12655, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 13382-13618, 14804-15040, 15584-15606, 15773-15812, 16013-16052, 16148-16152, 16172-16174, 16190-16192 or 16202. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, %%, 97%, 98%, 99% or 100% identity to SEQ ID NOs: 16172-16174, 16190-16192 or 16202, or fragments or complements thereof.

In some embodiments, the informative loci include sequences associated with any of the minus strand DNA sequences having at least 80%, 85%, 87%, 90%, 91%, 92%, 93%, 94%, 95%, 96%, 97%, 98%, 99% or 100% identity to any of SEQ ID NOs: 429-856, 2997-3424, 5532-5926, 7533-7558, 7689-7714, 7843-7866, 7977-7990, 8061-8074, 8144-8156, 8251-8264, 8335-8348, 8420-8424, 8633-8818, 9749-9934, 10826-10972, 11612-11662, 11918-11968, 12220-12266, 12461-12466, 12497-12502, 12533-12538, 12581-12586, 12617-12622, 12656-12658, 12909-13144, 14330-14566, 15538-15560, 15693-15732, 15933-15972, 16138-16142, 16166-16168, 16184-16186 or 16200, or fragments or complements thereof. In particular embodiments, the informative loci include sequences associated with any of the minus strand DNA sequences having at least 80%, 85%, 87%, 90%, 91%, 92%, 93%, 94%, 95%, 96%, 97%, 98%, 99% or 100% identity to any of SEQ ID NOs: 7977-7990, 8061-8074, 8144-8156, 8251-8264, 8335-8348, 8420-8424, 12461-12466, 12497-12502, 12533-12538, 12581-12586, 12617-12622, 12656-12658, 16166-16168, 16184-16186 or 16200, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include sequences associated with any one or more of the minus strand DNA sequences having at least 80%, 85%, 87%, 90%, 91%, 92%, 93%, 94%, 95%, 96%, 97%, 98%, 99% or 100% identity to any of SEQ ID NOs: 429-856, 2997-3424, 5532-5926, 7533-7558, 7689-7714, 7843-7866, 7977-7990, 8061-8074, 8144-8156, 8251-8264, 8335-8348, 8420-8424, or fragments or complements thereof. In particular embodiments, the informative loci that are associated with increased methylation in both Barrett's esophagus and esophageal adenocarcinoma samples include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 8251-8264, 8335-8348, 8420-8424, or fragments or complements thereof. In some embodiments, the informative loci are associated with increased methylation in an esophageal adenocarcinoma sample or a Barrett's with low grade or high grade dysplasia sample as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 8633-8818, 9749-9934, 10826-10972, 11612-11662, 11918-11968, 12220-12266, 12461-12466, 12497-12502, 12533-12538, 12581-12586, 12617-12622, or 12656-12658, or fragments or complements thereof. In particular embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 12461-12466, 12497-12502, 12533-12538, 12581-12586, 12617-12622, or 12656-12658, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to any of SEQ ID NOs: 12909-13144, 14330-14566, 15538-15560, 15693-15732, 15933-15972, 16138-16142, 16166-16168, 16184-16186 or 16200, or fragments or complements thereof. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to any of SEQ ID NOs: 16166-16168, 16184-16186 or 16200, or fragments or complements thereof.

In some embodiments, the informative loci or amplicon of the informative loci are treated with an agent, such as bisulfite. In some embodiments, the informative loci include sequences that have been treated with bisulfite. In some embodiments, the disclosure provides for bisulfite control sequences of any of the minus DNA strands disclosed herein. In some embodiments, the disclosure provides for bisulfite-treated sequences of any of the minus DNA strands disclosed herein. In some embodiments, the bisulfite-converted minus-strand control DNA sequences include any one or more of the sequences having at least 80%, 85%, 87%, 90%, 91%, 92%, 93%, 94%, 95%, 96%, 97%, 98%, 99% or 100% identity to any of SEQ ID NOs: 1713-2140, 4281-4708, 6717-7111, 7611-7636, 7767-7792, 7915-7938, 8019-8032, 8103-8116, 8183-8195, 8265-8278, 8349-8362, 8425-8429, 9191-9376, 10307-10492,11267-11413, 11765-11815, 12071-12121, 12361-12407, 12479-12484, 12515-12520, 12551-12556, 12587-12592, 12623-12628, or 12659-12661, or fragments or complements thereof. In particular embodiments, the bisulfite-converted minus-strand control DNA sequences include any one or more the sequences having at least 80%, 85%, 87%, 90%, 91%, 92%, 93%, 94%, 95%, 96%, 97%, 98%, 99% or 100% identity to any of SEQ ID NOs: 8019-8032, 8103-8116, 8183-8195, 12479-12484, 12515-12520, or 12551-12556, or fragments or complements thereof. In some embodiments, the informative loci are associated with increased methylation in both Barrett's esophagus and esophageal adenocarcinoma samples, as compared to the same sample types taken from a healthy control subject. In some embodiments, the disclosure provides for bisulfite-treated sequences of any of the minus DNA strands that are associated with increased methylation in both Barrett's esophagus and esophageal adenocarcinoma samples, as compared to the same sample types taken from a healthy control subject. In some embodiments, the sequences of any of the minus DNA strands that are associated with increased methylation in both Barrett's esophagus and esophageal adenocarcinoma samples are selected from the group consisting of sequences having at least 80%, 85%, 87%, 90%, 91%, 92%, 93%, 94%, 95%, 96%, 97%, 98%, 99% or 100% identity to any of SEQ ID NOs: 1713-2140, 4281-4708, 6717-7111, 7611-7636, 7767-7792, 7915-7938, 8019-8032, 8103-8116, 8183-8195, 8265-8278, 8349-8362, or 8425-8429, or fragments or complements thereof. In particular embodiments, the sequences of any of the minus DNA strands that are associated with increased methylation in both Barrett's esophagus and esophageal adenocarcinoma samples include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to: SEQ ID NOs: 8019-8032, 8103-8116, 8183-8195, 8265-8278, 8349-8362, or 8425-8429, or fragments or complements thereof. In some embodiments, the disclosure provides for bisulfite-treated sequences of any of the minus DNA strands that are associated with increased methylation in an esophageal adenocarcinoma sample or a Barrett's with low grade or high grade dysplasia sample as compared to a sample of the same type taken from a subject having Barrett's esophagus without dysplasia. In some embodiments, the sequences of any of the minus DNA strands that are associated with increased methylation in an esophageal adenocarcinoma sample or a Barrett's with low grade or high grade dysplasia sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 9191-9376, 10307-10492, 11267-11413, 11765-11815, 12071-12121, 12361-12407, 12479-12484, 12515-12520, or 12551-12556, 12587-12592, 12623-12628, or 12659-12661, or fragments or complements thereof. In particular embodiments, the unmethylated sequences of any of the minus DNA strands that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to SEQ ID NOs: 12479-12484, 12515-12520, 12551-12556, 12587-12592, 12623-12628, or 12659-12661, or fragments or complements thereof. In some embodiments, the informative loci are associated with reduced methylation in an esophageal adenocarcinoma sample as compared to a sample of the same type taken from a subject having Barrett's esophagus. In some embodiments, the disclosure provides for methylated control sequences of the minus DNA strand that are associated with reduced methylation in an esophageal adenocarcinoma sample as compared to a sample of the same type taken from a subject having Barrett's esophagus. In some embodiments, the methylated control sequences of any of the minus DNA strands that are associated with reduced methylation in an esophageal adenocarcinoma sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 13619-13855, 15041-15277, 15607-15629, 15813-15852, 16053-16092, 16153-16157, 16175-16177, 16192-16195 or 16203, or fragments or complements thereof. In particular embodiments, the methylated control sequences of any of the minus DNA strands that are associated with reduced methylation in an esophageal adenocarcinoma sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 16175-16177, 16192-16195 or 16203, or fragments or complements thereof.

In some embodiments, the informative loci or amplicon of the informative loci are treated with an agent, such as bisulfite. In some embodiments, the informative loci include sequences that have been treated with bisulfite. In some embodiments, the informative loci include methylated nucleic acid sequences that have been treated with bisulfite. In some embodiments, the bisulfite-converted methylated minus-strand DNA sequences include any one or more of sequences having at least 80%, 85%, 87%, 90%, 91%, 92%, 93%, 94%, 95%, 96%, 97%, 98%, 99% or 100% identity to SEQ ID NOs: 2141-2568, 4709-5136, 7112-7506, 7637-7662, 7793-7818, 7939-7962, 8033-8046, 8117-8130, 8196-8208, 8279-8292, 8363-8376, 8430-8434, 9377-9562, 10493-10678, 11414-11560, 11816-11866, 12122-12172, 12408-12454, 12485-12490, 12521-12526, 12557-12562, 12593-12598, 12269-12634, or 12662-12664, or fragments or complements thereof. In particular embodiments, the bisulfite-converted methylated minus-strand DNA sequences include any one or more of sequences having at least 80%, 85%, 87%, 90%, 91%, 92%, 93%, 94%, 95%, 96%, 97%, 98%, 99% or 100% identity to SEQ ID NOs: 8033-8046, 8117-8130, 8196-8208, 8279-8292, 8363-8376, 8430-8434, 12485-12490, 12521-12526, 12557-12562, 12593-12598, 12269-12634, or 12662-12664, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 2141-2568, 4709-5136, 7112-7506, 7637-7662, 7793-7818, 7939-7962, 8033-8046, 8117-8130, 8196-8208, 8279-8292, 8363-8376, or 8430-8434, or fragments or complements thereof. In particular embodiments, the informative loci that are associated with increased methylation in both Barrett's esophagus and esophageal adenocarcinoma samples include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to: SEQ ID NOs: 8033-8046, 8117-8130, 8196-8208, 8279-8292, 8363-8376, or 8430-8434, or fragments or complements thereof. In some embodiments, the informative loci are associated with increased methylation in an esophageal adenocarcinoma sample or a Barrett's with high grade dysplasia sample as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% h or 100% identity to SEQ ID NOs: 9377-9562, 10493-10678, 11414-11560,11816-11866, 12122-12172, 12408-12454, 12485-12490, 12521-12526, 12557-12562, 12593-12598, 12269-12634, or 12662-12664, or fragments or complements thereof. In particular embodiments, the informative loci that are associated with increased methylation in an esophageal adenocarcinoma sample or a Barrett's with low grade or high grade dysplasia sample include any one or more of the sequences of sequences having at least 80%, 85%, 87%, 90%, 91%, 92%, 93%, 94%, 95%, 96%, 97%, 98%, 99% or 100% identity to SEQ ID NOs: 12485-12490, 12521-12526, 12557-12562, 12593-12598, 12269-12634, or 12662-12664, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99%, or 100% identity to SEQ ID NOs: 13856-14092, 15278-15514, 15630-15652, 15853-15892, 16093-16132, 16158-16162, 16178-16180, 16196-16198, or 16204, or fragments or complements thereof. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to SEQ ID NOs: 16178-16180, 16196-16198, or 16204, or fragments or complements thereof.

In some embodiments, the disclosure provides for a bisulfite-converted nucleotide sequence comprising the bisulfite-converted nucleotide sequence of any one of the following: Up3, Up10, Up15-1, Up15-2, Up20-1, Up20-2, Up20-2, Up27, Up35-1, Up35-2, SqBE2, SqBE5, SqBE7, SqBE9, SqBE10, SqBE11-1, SqBE11-2, SqBE13, SqBE14-2, SqBE15, SqBE16-1, SqBE16-2, SqBE17-1, SqBE18, SqBE22-1, SqBE22-2 or SqBE23. In particular embodiments, the sequence comprises the bisulfite-converted nucleotide sequence of any one of the following: Up3, Up10, Up15-1, Up15-2, Up20-1, Up20-2, Up20-2, Up27, Up35-1, or Up35-2. In particular embodiments, the sequence comprises the bisulfite-converted nucleotide sequence of any one of the following: SqBE2, SqBE5, SqBE7, SqBE9, SqBE10, SqBE11-1, SqBE11-2, SqBE13, SqBE14-2, SqBE15, SqBE16-1, SqBE16-2, SqBE17-1, SqBE18, SqBE22-1, SqBE22-2 or SqBE23.

In some embodiments, the disclosure provides for a panel of any of the sequences disclosed herein. In some embodiments, the panel comprises any of the following combinations of sequences: a) Up3, Up10, Up15-1, Up15-2, Up20-1, Up20-2, Up27, Up35-1, and Up35-2; b) Up3, Up15-1, Up15-2, Up20-1, Up27, and Up35-1; c) Up10, Up3, Up15-1, Up15-2, Up20-1, Up27, and Up35-1; d) Up35-2, Up3, Up15-1, Up15-2, Up20-1, Up27 and Up35-1; e) Up15-1 and Up35-1; f) Up15-1, Up35-1, and Up10; g) Up15-1, Up35-1 and Up20-1; h) Up15-1, Up35-1, Up10, and Up15-2; i) Up15-1, Up35-1, Up10, and Up27; j) Up15-1, Up35-1, Up15-2, and Up20-1; k) Up15-1, Up35-1, Up15-2 and Up27; l) Up15-1, Up35-1, Up20-1, and Up27; m) Up3 and Up35-1; n) Up3 and Up35-2; o) Up3 and Up10; p) Up3 and Up27; q) Up35-1 and Up35-2; r) Up35-1 and Up27; s) Up35-2 and Up10; t) Up10 and Up27; u) Up3, Up35-1 and Up35-2; v) Up3, Up35-1 and Up10; w) Up3, Up35-1, and Up27; x) Up3, Up35-2 and Up10; y) Up3, Up35-2, and Up27; z) Up3, Up10, and Up27; aa) Up35-1, Up10, and Up27; ab) Up35-2, Up10, and Up27; ac) Up3, Up35-1, Up35-2 and Up10; ad) Up3, Up35-1, Up35-2 and Up27; ae) Up35-1, Up35-2, Up10 and Up27; af) Up3, Up35-2, Up10 and Up27; ag) Up3, Up35-1, Up10 and Up27; ah) Up3, Up10, Up27, Up35-1, and Up35-2; ai) Up35-1 and Up10, aj) Up35-1 and Up27; ak) Up35-2 and Up10; al) Up35-2 and Up27; am) Up3, Up35-1 and Up35-2; an) Up3, Up35-1, and Up10; ao) Up3, Up35-1, and Up27; ap) Up3, Up35-2 and Up10; aq) Up3, Up35-2 and Up27; ar) Up3, Up10 and Up27; at) Up35-1, Up10, and Up27; au) Up3, Up35-1, Up35-2, and Up10; av) Up3, Up35-1, Up35-2 and Up27; aw) Up35-1, Up35-2, Up10 and Up27; ax) Up3, Up35-2, Up10 and Up27; ay) Up3, Up35-1, Up10 and Up27; az) Up3, Up10, Up27, Up35-1, and Up35-2; ba) SqBE5 and SqBE7; bb) SqBE5 and SqBE16; bc) SqBE5 and SqBE17; bd) SqBE5 and SqBE18; be) SqBE7 and SqBE16; bf) SqBE7 and SqBE17; SqBE7 and SqBE17; bg) SqBE7 and SqBE18; bh) SqBE16 and SqBE17 and bi) SqBE16 and SqBE18. In some embodiments, the disclosure provides for a method of detecting the methylation status of the sequences in any of the panels disclosed herein. In some embodiments, the disclosure provides for a method of detecting the methylation status of the sequences in any of the panels disclosed herein, and further comprises detecting the mutation status of p53. In particular embodiments, the disclosure provides for a method of a) detecting the methylation status of a panel comprising the sequences of Up-3 and Up35-2, and b) further detecting the mutation status of TP53.

In some embodiments, the disclosure provides for a method of detecting the methylation status of any of the loci disclosed herein, and further comprises detecting the methylation status of vimentin. In some embodiments, the vimentin methylation is detected in a manner consistent with that described in Li et al. (Li M, et al. (2009) Sensitive digital quantification of DNA methylation in clinical samples. Nat Biotechnol 27(9):858-863). In some embodiments, the vimentin methylation patterns are determined in a nucleotide sequence having at least 80%, 85%, 90%, 91%, 92%, 93%, 94%, 95%, 96%, 97%, 98%, 99% or 100% identity to SEQ ID NO: 16207 or 16208. In some embodiments, the methylation patterns are determined in any of the following nucleic acid sequence combinations: a) vimentin and SQBE5; b) vimentin and SQBE7, c) vimentin and SQBE16, d) vimentin and SQBE17 or e) vimentin and SQBE18.

In particular embodiments, the disclosure provides for a nucleotide sequence comprising a sequence having at least 80%, 85%, 90%, 91%, 92%, 93%, 94%, 95%, 96%, 97%, 98%, 99% or 100% identity to any of the following sequences: 8209-8222, 8251-8264, 8293-8306, 8335-8348, 8405-8409, 8420-8424, 12563-12568, 12581-12586, 12599-12604, 12617-12622, 12647-12649 or 12656-12658, or fragments and/or reverse complements thereof. In particular embodiments, the disclosure provides for a nucleotide sequence comprising a sequence having at least 80%, 85%, 90%, 91%, 92%, 93%, 94%, 95%, 96%, 97%, 98%, 99% or 100% identity to any of the following sequences: 12563-12568, 12581-12586, 12599-12604, 12617-12622, 12647-12649 or 12656-12658, or fragments and/or reverse complements thereof. In particular embodiments, the disclosure provides for a nucleotide sequence comprising a sequence having at least 80%, 85%, 90%, 91%, 92%, 93%, 94%, 95%, 96%, 97%, 98%, 99% or 100% identity to any of the following sequences: 8209-8222, 8251-8264, 8293-8306, 8335-8348, 8405-8409, or 8420-8424, or fragments and/or reverse complements thereof.

In some embodiments, the disclosure provides for a bisulfite-converted nucleotide sequence comprising a sequence having at least 80%, 85%, 90%, 91%, 92%, 93%, 94%, 95%, 96%, 97%, 98%, 99% or 100% identity to any of the following sequences: SEQ ID NOs: 8307-8313, 8315-8327, 8329-8334, 8349-8355, 8357-8369, 8371-8376, 8411, 8412, 8414, 8416, 8417, 8419, 8426, 8427, 8429, 8431, 8432, 8434, 12605-12616, 12623-12634, 12650-12655, or 12659-12664, or fragments and/or reverse complements thereof. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 8307-8313, 8315-8327, 8329-8334, 8349-8355, 8357-8369, 8371-8376, 8411, 8412, 8414, 8416, 8417, 8419, 8426, 8427, 8429, 8431, or 8432, 8434. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 12605-12616, 12623-12634, 12650-12655, or 12659-12664.

In some embodiments, the disclosure provides for a bisulfite-converted nucleotide sequence comprising a sequence having at least 80%, 85%, 90%, 91%, 92%, 93%, 94%, 95%, 96%, 97%, 98%, 99% or 100% identity to any of the following sequences: SEQ ID NOs: 8223-8250, 8265-8292, 12569-12580, or 12587-12598, or fragments and/or reverse complements thereof. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 8223-8250 or 8265-8292. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 12569-12580 or 12587-12598.

In some embodiments, the sample for use in any of the methods disclosed herein is a tissue sample taken from the subject. In some embodiments, the sample is tissue sample from the esophagus. In some embodiments, the sample is a biopsy or a brushing. In some embodiments, the sample is a biopsy or brushing of the esophagus. In some embodiments, the sample is a body fluid. In some embodiments, the body fluid is blood, serum, saliva, spit, stool, urine or an esophageal washing.

The present disclosure contemplates methods of selecting an individual to undergo a diagnostic procedure to determine the presence of Barrett's esophagus, Barrett's esophagus with dysplasia (e.g., Barrett's esophagus with low-grade or high-grade dysplasia), or of esophageal adenocarcinoma, by obtaining a biological sample from an individual, and determining in the sample the presence of DNA methylation in at least one of any of the sequences disclosed herein. In some embodiments, the disclosure provides for a method of selecting a subject for monitoring of esophageal neoplasia, wherein the presence of DNA methylation in at least one of any of the sequences disclosed herein is detected in a sample from the subject. In some embodiments, detection is achieved by any one or more of DNA sequencing, next generation sequencing, methylation specific PCR, methylation specific PCR combined with a fluorogenic hybridization probe, real time methylation specific PCR, or hybridization to an array. In some embodiments, the detection in the sample is indicative that the subject is at high risk of progression to esophageal neoplasia (e.g., esophageal cancer). In some embodiments, the subject is monitored by endoscopy. In some embodiments, a sample from a subject in which DNA methylation of at least one of any of the sequences disclosed herein is detected, is indicative that the subject should be administered a particular treatment. In some embodiments, the treatment is selected from the group consisting of endoscopic removal or ablation of an esophageal neoplasia, and/or surgery, radiation, or chemotherapy treatment of esophageal adenocarcinoma. In some embodiments, the sequence is any one or more sequence selected from the group consisting of a sequence having at least 80%, 85%, 90%, 91%, 92%, 93%, 94%, 95%, 96%, 97%, 98%, 99% or 100% identity to any of the following sequences: SEQ ID NOs: 1-856, 2569-3424, 5137-5926; 7507-7558, 7663-7714, 7819-7866, 7963-7990, 8047-8074, 8131-8156, 8209-8222, 8251-8264, 8293-8306, 8335-8348, 8405-8409, and 8420-8424, or fragments or complements thereof.

The present disclosure also contemplates methods of selecting an individual to undergo a diagnostic procedure to determine presence of Barrett's esophagus with low-grade dysplasia, Barrett's esophagus with high grade dysplasia or of esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of sequences having at least 80%, 85%, 90%, 91%, 92%, 93%, 94%, 95%, 96%, 97%, 98%, 99% h or 100% identity to any of the following sequences: SEQ ID NOs: 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, or 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated.

The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. In certain embodiments, the method optionally further comprises detecting the presence or absence of a somatic mutation in TP53. In certain embodiments, the TP53 somatic mutation, as described herein, is any one or more mutation at any one or more amino acid residue corresponding to amino acid residue 72, 105, 108, 110, 113, 124, 127, 132, 144, 152, 163, 175, 183, 194, 213, 214, 218, 232, 234, 248, 265, 273, 278, 306, 337, 347, or 639 of SEQ ID NO: 16205. In certain embodiments, the TP53 somatic mutation is any non-synonomous somatic mutation known in the art. In certain embodiments, the TPS3 somatic mutation is any one or more mutation selected from the group consisting of: Leu194Arg, Gly105Asp, Arg273His, Tyr163His, Ile232Thr, Arg213Ter, Arg273His, Arg248Gln, Arg175His, Arg110delinsGlnSer, Ser183Ter, Arg248Gln, Arg337Leu, Lys132Arg, Leu265ThrfsTer7, Arg306Ter, Cys124TrpfsTer25, Pro72Arg, Val218Glu, His214Leu, Gln144Ter, Phe113Ser, Tyr234His, Ser127Phe, Pro278Ala, Ala347Thr, and Pro152Leu of SEQ ID NO: 16205 In certain embodiments, the TP53 mutation is any one or more non-synonymous somatic mutation at any one or more nucleotide position corresponding to nucleotide position 108, 215, 314, 338, 380, 395, 430, 455, 487, 524, 548, 581, 637, 639, 641, 653, 695, 700, 743, 818, 832, 916, 1010, or 1039 of SEQ ID NO: 16206.

The present disclosure also contemplates methods of selecting an individual to undergo a treatment for Barrett's esophagus, Barrett's esophagus with low grade dysplasia, Barrett's esophagus with high grade dysplasia or for esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of sequence having at least 80%, 85%, 90%, 91%, 92%, 93%, 94%, 95%, 96%, 97%, 98%, 99% or 100% identity to any of the following sequences: SEQ ID NOs: 1-856, 2569-3424, 5137-5926; 7507-7558, 7663-7714, 7819-7866, 7963-7990, 8047-8074, 8131-8156, 8209-8222, 8251-8264, 8293-8306, 8335-8348, 8405-8409, or 8420-8424, or fragments or complements thereof. In some embodiments, the present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TPS3 in the sample is contemplated.

The present disclosure also contemplates methods of selecting an individual to undergo a treatment for Barrett's esophagus, Barrett's esophagus with low-grade dysplasia, Barrett's esophagus with high grade dysplasia or for esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of sequence having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972, 11561-11662, 11867-119%8, 12173-12266, 12455-12466, 12491-12502, 12527-12538, 12563-12568, 12581-12586, 12599-12604, 12617-12622, 12647-12649, or 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. The present disclosure also contemplates methods of selecting an individual to undergo enhanced surveillance for the development of Barrett's esophagus with low grade dysplasia, Barrett's esophagus with high grade dysplasia or of esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of a sequence having at least 80%, 85%, 90%, 91%, 92%, 93%, 94%, 95%, %%, 97%, 98%, 99% or 100% identity to any of the following sequences: SEQ ID NOs: 8447-8818, 9563-9934, 10679-10972, 11561-11968, 11867-11968, 12173-12266, 12455-12466, 12491-12502, 12527-12538, 12563-12568, 12581-12586, 12599-12604, 12617-12622, 12647-12649, or 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TPS3 in the sample is contemplated. The present disclosure also contemplates methods of determining the response of an individual with esophageal cancer to therapy by obtaining a biological sample from an individual with esophageal cancer, and determining the presence of methylation in at least one of any of the sequences disclosed herein. In some embodiments, the sequence is any one or more sequence selected from the group consisting of sequences having at least 80%, 85%, 90%, 91%, 92%, 93%, 94%, 95%, %%, 97%, 98%, 99% or 100% identity to any of the following sequences: SEQ ID NOs: 1-856, 2569-3424, 5137-5926; 7507-7558, 7663-7714, 7819-7866, 7%3-7990, 8047-8074, 8131-8156, 8209-8222, 8251-8264, 8293-8306, 8335-8348, 8405-8409, or 8420-8424, 8447-8818, 9563-9934, 10679-10972; SEQ ID NOs: 11561-11662, 11867-11968, 12173-12266; SEQ ID NOs: 12455-12466, 12491-12502, 12527-12538, 12563-12568, 12581-12586, 12599-12604, 12617-12622, 12647-12649, and 12656-12658, or fragments or complements thereof. In some implementations, an increase in levels of methylation over time is indicative of disease progression and a need for a change in therapy (such as modifying the dosing regime of an exiting therapy, or administering a new therapeutic(s) either alone or in combination with the existing therapy), and an absence of increase in levels of methylation over time or decrease in levels of methylation over time is indicative that a change in therapy is not required. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TPS3 in the sample is contemplated.

The present disclosure also contemplates method of distinguishing EAC and/or low/high grade dysplasia from BE by obtaining a biological sample from an individual, and determining in the sample the presence of DNA methylation in at least one of any of the sequences disclosed herein. In some embodiments, the sequence is any one or more sequence selected from the group consisting of sequences having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972; SEQ ID NOs: 11561-11662, 11867-11968, 12173-12266; SEQ ID NOs: 12455-12466, 12491-12502, 12527-12538, 12563-12568, 12581-12586, 12599-12604, 12617-12622, 12647-12649, and 12656-12658, or fragments or complements thereof. The present disclosure further contemplates that the method may further comprise determining the status of somatic mutation(s) in TPS3 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. In certain embodiments, the absence of methylation at Up15-1, Up35-1, Up35-2, Up3, Up27, and Up10; and the absence of a somatic mutation in TP53 may be indicative of non-dysplastic Barret's esophagus. In certain embodiments, the presence of methylation at any one of Up15-1, Up35-1, Up35-2, Up3, Up27, and Up10; or the presence of a somatic mutation in TP53 may be indicative of esophageal adenocarcinoma or of Barrett's with high grade dysplasia.

The present disclosure also contemplates method of distinguishing EAC and/or low/high grade dysplasia from BE by obtaining a biological sample from an individual, and determining in the sample the presence of DNA methylation in at least one of any of the sequences disclosed herein. In some embodiments, the sequence is any one or more sequence selected from the group consisting of sequences having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972; SEQ ID NOs: 11561-11662, 11867-11968, 12173-12266; SEQ ID NOs: 12455-12466, 12491-12502, 12527-12538, 12563-12568, 12581-12586, 12599-12604, 12617-12622, 12647-12649, and 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TPS3 in the sample is contemplated. In certain embodiments, the absence of methylation at Up15-1, Up35-1, Up35-2, Up3, Up27, and Up10; and the absence of a somatic mutation in TPS3 may be indicative of non-dysplastic Barret's esophagus. In certain embodiments, the presence of methylation at any one of Up15-1, Up35-1, Up35-2, Up3, Up27, and Up10; or the presence of a somatic mutation in TP53 may be indicative of esophageal adenocarcinoma.

The present disclosure also contemplates a method of monitoring the progression (or regression) of esophageal neoplasias over time. The method involves detecting the methylation status of one or more nucleotide sequences selected from the group consisting of sequences having at least 80%, 85%, 90%, 91%, 92%, 93%, 94%, 95%, 96%, 97%, 98%, 99% or 100% identity to any of the following sequences: SEQ ID NOs: 1-856, 2569-3424, 5137-5926; 7507-7558, 7663-7714, 7819-7866, 7963-7990, 8047-8074, 8131-8156, 8209-8222, 8251-8264, 8293-8306, 8335-8348, 8405-8409, and 8420-8424, 8447-8818, 9563-9934, 10679-10972; SEQ ID NOs: 11561-11662, 11867-11968, 12173-12266; SEQ ID NOs: 12455-12466, 12491-12502, 12527-12538, 12563-12568, 12581-12586, 12599-12604, 12617-12622, 12647-12649, and 12656-12658, or fragments or complements thereof in samples from a subject at a first time and at a later time. In certain embodiments, neoplasia regression may be indicated by the absence of methylation in the nucleotide sequence taken at a later time and the presence of methylation in the nucleotide sequence taken at the first time. In certain embodiments, neoplasia progression may be indicated by the presence of methylation in the nucleotide sequence taken at a later time and the absence of methylation in the nucleotide sequence taken at the first time. The present disclosure further contemplates that the method may further comprise determining the status of somatic mutation(s) in TP53 in the samples. In some embodiments, neoplastic regression may be indicated by the presence of methylated chromosomal loci e.g., methylation of Up15-1, Up35-1, Up35-2, Up3, Up27, and/or Up10 or the presence of a somatic mutation in TP53 in a first sample; and the absence of methylated chromosomal loci e.g., unmethylated Up15-1, Up35-1, Up35-2, Up3, Up27, and Up10, and the absence of somatic mutation(s) in TP53 in a later sample. In some embodiments, neoplastic progression may be indicated by the presence of unmethylated chromosomal loci e.g., unmethylated Up15-1, Up35-1, Up35-2, Up3, Up27, and Up10; and the absence of somatic mutation(s) in TPS3 in a first sample; and the presence of methylated chromosomal loci e.g., methylated Up15-1, Up35-1, Up35-2, Up3, Up27, and/or Up10, or the presence of a somatic mutation in TPS3 in a later sample.

The present disclosure also provides sequences that will hybridize under highly stringent conditions to the nucleotide sequences of any one or more of SEQ ID NOs: 1-8444 and 8447-16204, or fragments or complements thereof. As discussed above, one of ordinary skill in the art will understand readily that appropriate stringency conditions which promote DNA hybridization can be varied. One of ordinary skill in the art will understand readily that appropriate stringency conditions which promote DNA hybridization can be varied. For example, one could perform the hybridization at 6.0× sodium chloride/sodium citrate (SSC) at about 45° C., followed by a wash of 2.0×SSC at 50° C. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or temperature or salt concentration may be held constant while the other variable is changed. In one embodiment, the disclosure provides nucleic acids which hybridize under low stringency conditions of 6×SSC at room temperature followed by a wash at 2×SSC at room temperature.

In other embodiments, the disclosure also provides the methylated forms of the nucleotide sequences of any one or more of SEQ ID NOs: 1-8444 and 8447-16204, or fragments thereof, wherein the cytosine bases of the CpG islands present in the sequences are methylated. In other words, the nucleotide sequences listed of any one or more of SEQ ID NOs: 1-8444 or 8447-16204 or fragments or complements thereof may be either in the methylated status (e.g., as seen in neoplasias) or in the unmethylated status (e.g., as seen in normal cells). In further embodiments, the nucleotide sequences of the disclosure can be isolated, recombinant, and/or fused with a heterologous nucleotide sequence, or in a DNA library.

In certain embodiments, the present disclosure provides bisulfite-converted nucleotide sequences, for example, bisulfite-converted sequences selected from any of the sequences disclosed herein. In some embodiments, the sequence is selected from the group consisting of sequences having at least 80%, 85%, 90%, 91%, 92%, 93%, 94%, 95%, 96%, 97%, 98%, 99% or 100% identity to any of the following sequences: SEQ ID NOs: 857-2568, 3425-5136, 5927-7506, 7559-7662, 7715-7818, 7867-7962, 7991-8046, 8075-8130, 8157-8208, 8223-8250, 8265-8292, 8307-8334, 8349-8376, 8410-8419, 8425-8434, and/or fragments thereof, and/or the reverse complements thereof. In yet other embodiments, the disclosure provides bisulfite-converted sequences selected from the group consisting of sequences having at least 80%, 85%, 90%, 91%, 92%, 93%, 94%, 95%, 96%, 97%, 98%, 99% or 100% identity to any of the following sequences: SEQ ID NOs: 8819-9562, 9935-10678, 10973-11560; 11663-11866, 11969-12172, 12267-12454; 12467-12490, 12503-12526, 12539-12562, 12569-12580, 12587-12598, 12605-12616, 12623-12634, 12650-12655, and 12659-12664, and/or fragments thereof, and/or the reverse complements thereof. In yet other embodiments, the disclosure provides bisulfite-converted sequences selected from the group consisting of sequences having at least 80%, 85%, 90%, 91%, 92%, 93%, 94%, 95%, 96%, 97%, 98%, 99% or 100% identity to any of the following sequences: SEQ ID NOs: 13145-14092, 14567-15514, 15561-15652; 15733-15892, 15973-16132, 16143-16162; 16169-16180, 16187-16198, and 16201-16204, and/or fragments thereof, and/or the reverse complements thereof.

A fragment/portion of any of the nucleotide sequences disclosed herein may be of any length, so long as the methylation status of that nucleotide sequence may be determined. In some embodiments, the nucleotide sequence is at least 10, 15, 25, 30, 40, 50, 60, 70, 80, 90, 100, 110, 120, 130, 140, 150, 160, 170, 180, 190, 200, 250, 300, 350, 400, 450, 500, 600, 700, 800, 900, 1000, 1200, 1400, 1500, 1700, or 2000 nucleotides in length. In some embodiments, the nucleotide sequence is at least 10-2000, 10-1000, 10-500, 10-200, 10-150, 10-100, 50-2000, 50-1000, 50-500, 50-200, 50-150, 50-100, 80-2000, 80-1000, 80-500, 80-150, 80-100, 100-2000, 100-1000, 100-500, 100-200, or 100-150 nucleotides in length.

Such bisulfite-converted nucleotide sequences can be used for detecting the methylation status, for example, by an MSP reaction or by direct sequencing (e.g., next generation sequencing). These bisulfite-converted sequences are also of use for designing primers for MSP reactions that specifically detect methylated or unmethylated nucleotide sequences following bisulfite conversion. In yet other embodiments, the bisulfite-converted nucleotide sequences of the disclosure also include nucleotide sequences that will hybridize under highly stringent conditions to any nucleotide sequence of any one or more of SEQ ID NOs: 1-8444 and 8447-16204, or fragments or complements thereof.

In further aspects, the application provides methods for producing such bisulfite-converted nucleotide sequences, for example, the application provides methods for treating a nucleotide sequence with a bisulfite agent such that the unmethylated cytosine bases are converted to a different nucleotide base such as a uracil.

In yet other aspects, the application provides oligonucleotide primers for amplifying a region within the nucleic acid sequence of any one or more of SEQ ID NOs: 1-8444 and 8447-16204. In certain aspects, a pair of the oligonucleotide primers can be used in a detection assay, such as the HpaII assay. In certain aspects, primers used in an MSP reaction can specifically distinguish between methylated and non-methylated DNA.

The primers of the disclosure have sufficient length and appropriate sequence so as to provide specific initiation of amplification nucleic acids. Primers of the disclosure are designed to be "substantially" complementary to each strand of the nucleic acid sequence to be amplified. In some embodiments, the primer is selected from the group consisting of sequences having 80%, 85%, 90%, 91%, 92%, 93%, 94%, 95%, 96%, 97%, 98%, 99%, or 100% identity to any of SEQ ID NOs: 8377-8404, 8435-8446, 12635-12646, and 12665-12670. In some embodiments, the primer comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or 35 consecutive nucleotides of any of the primer sequences of SEQ ID NOs: 8377-8404, 8435-8446, 12635-12646, and 12665-12670. While exemplary primers include the sequences of any sequence having at least 80%, 85%, 90%, 91%, 92%, 93%, 94%, 95%, 96%, 97%, 98%, 99%, or 100% identity to any of SEQ ID NOs: 8377-8404, 8435-8446, 12635-12646, and 12665-12670, or fragments thereof, it is understood that any primers that hybridize with the bisulfite-converted sequence of any one or more of SEQ ID NOs: 1-8444 and 8447-16204 are included within the scope of this disclosure and is useful in the method of the disclosure for detecting methylated nucleic acid, as described. Similarly, it is understood that any primers that would serve to amplify a methylation sensitive restriction site or sites within the differentially methylated region of the informative loci of any of the sequences of SEQ ID NOs: 1-8444 or 8447-16204, or fragments or complements thereof are included within the scope of this disclosure and is useful in the method of the disclosure for detecting nucleic methylated nucleic acid, as described.

The oligonucleotide primers of the disclosure may be prepared by using any suitable method, such as conventional phosphotriester and phosphodiester methods or automated embodiments thereof. In one such automated embodiment, diethylphosphoramidites are used as starting materials and may be synthesized as described by Beaucage, et al. (*Tetrahedron Letters*, 22:1859-1862, 1981). One method of synthesizing oligonucleotides on a modified solid support is described in U.S. Pat. No. 4,458,066.

IV. Assays and Drug Screening Methodologies

In certain aspects, the application provides assays and methods using any of the informative loci, or bisulfite converted methylated or unmethylated sequences thereof, disclosed herein. In some embodiments, the informative loci comprise a sequence having at least 80%, 85%, 90%, 91%, 92%, 93%, 94%, 95%, 96%, 97%, 98%, 99%, or 100% identity to any of the sequences of SEQ ID NOs: 1-428, 2569-2996, 5137-5531, 7507-7532, 7663-7668, 7819-7842, 7963-7976, 8047-8060, 8131-8143, 8209-8222, 8293-8306, 8405-8409, 8447-8632, 9563-9748, 10679-10825, 11561-11611, 11867-11917, 12173-12219, 12455-12460, 12491-12496, 12527-12532, 12563-12568, 12599-12604, 12647-12649, 12671-12908, 14093-14329, 15515-15537, 15653-15692, 15893-15932, 16133-16137, 16163-16165, 16181-16183, 16199, 429-856, 2997-3424, 5532-5926, 7533-7558, 7689-7714, 7843-7866, 7977-7990, 8061-8074, 8144-8156, 8251-8264, 8335-8348, 8420-8424, 8633-8818, 9749-9934, 10826-10972, 11612-11662, 11918-11968, 12220-12266, 12461-12466, 12497-12502, 12533-12538, 12581-12586, 12617-12622, 12656-12658, 12909-13144, 14330-14566, 15538-15560, 15693-15732, 15933-15972, 16138-16142, 16166-16168, 16184-16186 or 16200 or any fragments or complements thereof. In some embodiments, the informative loci are used as molecular markers to distinguish between healthy cells and metaplastic cells (e.g., Barrett's esophageal cells). In some embodiments, the informative loci are used as molecular markers to distinguish between healthy cells and neoplastic cells (e.g., cancer cells). In particular embodiments, the informative loci are used as molecular markers to distinguish between healthy cells and esophageal adenocarcinoma cells. In some embodiments, the informative loci are used as molecular markers to distinguish between Barrett's esophagus cells and cancer cells. In some embodiments, the informative loci are used as molecular markers to distinguish between Barrett's esophagus cells and esophageal adenocarcinoma cells. For example, in one embodiment, the application provides methods and assays using any of the informative loci comprising a sequence having at least 80%, 85%, 90%, 91%, 92%, 93%, 94%, 95%, 96%, 97%, 98%, 99%, or 100% identity to any one or more of SEQ ID NOs: 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, OR 12656-12658, or any fragments or complements thereof as markers that distinguish between healthy cells and neoplasia cells. In other embodiments, the application provides methods and assays using the informative loci comprising a sequence having at least 80%, 85%, 90%, 91%, 92%, 93%, 94%, 95%, 96%, 97%, 98%, 99%, or 100% identity to any one or more of SEQ ID NOs: 1-856, 2569-3424, 5137-5926, 7507-7558, 7663-7714, 7819-7866, 7963-7990, 8047-8047, 8131-8156, 8209-8222, 8251-8264, 8293-8306, 8335-8348, 8405-8409, 8420-8424, 8447-8818, 9563-9934, 10679-10972,11561-11662, 11867-11968, 12173-12266, 12455-12466, 12491-12502, 12527-12538, 12563-12568, 12581-12586, 12599-12604, 12617-12622, 12647-12649, 12656-12658, 12671-13144, 14093-14566, 15515-15560, 15653-15732, 15893-15972, 16135-16142, 16163-16168, 16181-16186 and/or 16199-16200 or any fragments or complements thereof as markers that distinguish between healthy cells and cells derived from neoplasias of the upper gastrointestinal tract. In one aspect, a molecular marker of the invention is a differentially methylated sequence of an informative locus. In certain aspects, the application provides assays and methods using the informative loci comprising a sequence having at least 80%, 85%, 90%, 91%, 92%, 93%, 94%, 95%, 96%, 97%, 98%, 99%, or 100% identity to any one or more of SEQ ID NOs: 1-856, 2569-3424, 5137-5926, 7507-7558, 7663-7714, 7819-7866, 7963-7990, 8047-8047, 8131-8156, 8209-8222, 8251-8264, 8293-8306, 8335-8348, 8405-8409, 8420-8424, 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, 12656-12658, 12671-13144, 14093-14566, 15515-15560, 15653-15732, 15893-15972, 16135-16142, 16163-16168, 16181-16186 and/or 16199-16200 or any fragments or complements thereof in combination with the status of somatic mutation(s) in TPS3 as molecular markers that distinguish between healthy cells and cancer cells. For example, in one embodiment, the application provides methods and assays using the informative loci comprising a sequence having at least 80%, 85%, 90%, 91%, 92%, 93%, 94%, 95%, 96%, 97%, 98%, 99%, or 100% identity to any one or more of SEQ ID NOs: 1-856, 2569-3424, 5137-5926, 7507-7558, 7663-7714, 7819-7866, 7963-7990, 8047-8047, 8131-8156, 8209-8222, 8251-8264, 8293-8306, 8335-8348, 8405-8409, 8420-8424, 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, 12656-12658, 12671-13144, 14093-14566, 15515-15560, 15653-15732, 15893-15972, 16135-16142, 16163-16168, 16181-16186 and/or 16199-16200 or any fragments or complements thereof and the status of somatic mutation(s) in TPS3 as markers that distinguish between healthy cells and neoplasia cells (e.g. cancer/esophageal adenocarcinoma cells). In other embodiments, the application provides methods and assays using the informative loci disclosed herein (e.g., chromosomal loci Up15-1, Up35-1, Up35-2, Up3, Up27, and Up10) and the status of somatic mutation(s) in TPS3 as markers that distinguish between healthy cells and cells derived from neoplasias of the upper gastrointestinal tract. In one aspect, a molecular marker of the invention is a differentially methylated sequence of an informative locus.

In certain embodiments, the application provides assays for detecting differentially methylated nucleotide sequences (e.g., vimentin and/or SqBE18). Thus, a differentially methylated nucleotide sequence, in its methylated state, can serve as a target for detection using various methods described herein and the methods that are well within the purview of the skilled artisan in view of the teachings of this application.

In certain aspects, such methods for detecting methylated nucleotide sequences (e.g., vimentin and/or SqBE18) are based on treatment of genomic DNA with a chemical compound which converts non-methylated C, but not methylated C (i.e., 5mC), to a different nucleotide base. One such compound is sodium bisulfite (also referred to simply as "bisulfite" herein), which converts C, but not 5mC, to U. Methods for bisulfite treatment of DNA are known in the art (Herman, et al., 1996, Proc Natl Acad Sci USA, 93:9821-6; Herman and Baylin, 1998, Current Protocols in Human Genetics, N. E. A. Dracopoli, ed., John Wiley & Sons, 2:10.6.1-10.6.10; U.S. Pat. No. 5,786,146). To illustrate, when a DNA molecule that contains unmethylated C nucleotides is treated with sodium bisulfite to become a compound-converted DNA, the sequence of that DNA is changed (C→U). Detection of the U in the converted nucleotide sequence is indicative of an unmethylated C.

The different nucleotide base (e.g., U) present in compound-converted nucleotide sequences can subsequently be detected in a variety of ways. In a particular embodiment, the present invention provides a method of detecting U in compound-converted DNA sequences by using "methylation sensitive PCR" (MSP) (see, e.g., Herman, et al., 1996, Proc. Natl. Acad. Sci. USA, 93:9821-9826; U.S. Pat. Nos. 6,265,171; 6,017,704; 6,200,756). In MSP, one set of primers (i.e., comprising a forward and a reverse primer) amplifies the compound-converted template sequence if C bases in CpG dinucleotides within the DNA are methylated. This set of primers is called "methylation-specific primers." Another set of primers amplifies the compound-converted template sequence if C bases in CpG dinucleotides within the 5' flanking sequence are not methylated. This set of primers is called "unmethylation-specific primers."

In MSP, the reactions use the compound-converted DNA from a sample in a subject. In assays for methylated DNA, methylation-specific primers are used. In the case where C within CpG dinucleotides of the target sequence of the DNA are methylated, the methylation-specific primers will amplify the compound-converted template sequence in the presence of a polymerase and an MSP product will be produced. If C within CpG dinucleotides of the target sequence of the DNA is not methylated, the methylation-specific primers will not amplify the compound-converted template sequence in the presence of a polymerase and an MSP product will not be produced. In some embodiments, any of the bisulfite converted methylated sequences disclosed herein is used as a marker for a particular indication.

It is often also useful to run a control reaction for the detection of unmethylated DNA. The reaction uses the compound-converted DNA from a sample in a subject and unmethylation-specific primers are used. In the case where C within CpG dinucleotides of the target sequence of the DNA are unmethylated, the unmethylation specific primers will amplify the compound-converted template sequence in the presence of a polymerase and an MSP product will be produced. If C within CpG dinucleotides of the target sequence of the DNA is methylated, the unmethylation-specific primers will not amplify the compound-converted template sequence in the presence of a polymerase and an MSP product will not be produced. Note that a biologic sample will often contain a mixture of both neoplastic cells that give rise to a signal with methylation specific primers, and normal cellular elements that give rise to a signal with unmethylation-specific primers. The unmethylation specific signal is often of use as a control reaction, but does not in this instance imply the absence of neoplasia as indicated by the positive signal derived from reactions using the methylation specific primers. In some embodiments, any of the bisulfite converted unmethylated sequences disclosed herein are used as controls. In some embodiments, the unmethylated control sequences are any of the bisulfite converted sequences of SEQ ID NOs: 857-1284, 3425-3852, 5927-6321, 7559-7584, 7715-7740, 7867-7890, 7991-8004, 8075-8088, 8157-8169, 8223-8236, 8307-8320, 8410-8414, 8819-9004, 9935-10120, 10973-11119, 11663-11713, 11969-12019, 12267-12313, 12467-12472, 12503-12508, or 12539-12544, 12569-12574, 12605-12610, 12650-12652, 1713-2140, 4281-4708, 6717-7111, 7611-7636, 7767-7792, 7915-7938, 8019-8032, 8103-8116, 8183-8195, 8265-8278, 8349-8362, 8425-8429, 9191-9376, 10307-10492, 11267-11413, 11765-11815, 12071-12121, 12361-12407, 12479-12484, 12515-12520, 12551-12556, 12587-12592, 12623-12628, or 12659-12661 in which every "Y" position is a "T."

Primers for a MSP reaction are derived from the compound-converted template sequence. Herein, "derived from" means that the sequences of the primers are chosen such that the primers amplify the compound-converted template sequence in a MSP reaction. Each primer comprises a single-stranded DNA fragment which is at least 8 nucleotides in length. In some embodiments, the primers are less than 50 nucleotides in length, or in some embodiments, from 15 to 35 nucleotides in length. Because the compound-converted template sequence can be either the Watson strand or the Crick strand of the double-stranded DNA that is treated with sodium bisulfite, the sequences of the primers is dependent upon whether the Watson or Crick compound-converted template sequence is chosen to be amplified in the MSP. Either the Watson or Crick strand can be chosen to be amplified.

The compound-converted template sequence, and therefore the product of the MSP reaction, is, in some embodiments, between 20 to 3000 nucleotides in length. In other embodiments, the product of the MSP reaction is between 50 to 1000 nucleotides in length. In other embodiments, the product of the MSP reaction is between 50 to 500 nucleotides in length. In other embodiments, the product of the MSP reaction is between 80-150 nucleotides in length. In some embodiments, the product of the MSP reaction is at least 20, 30, 40, 50, 60, 70, 80, 90, 100, 110, 120, 130, 140, 150, 160, 170, 180, 190, 200, 210, 220, 230, 240 or 250 nucleotides in length. In some embodiments, the methylation-specific primers result in an MSP product of a different length than the MSP product produced by the unmethylation-specific primers.

A variety of methods can be used to determine if an MSP product has been produced in a reaction assay. One way to determine if an MSP product has been produced in the reaction is to analyze a portion of the reaction by agarose gel electrophoresis. For example, a horizontal agarose gel of from 0.6 to 2.0% agarose is made and a portion of the MSP reaction mixture is electrophoresed through the agarose gel. After electrophoresis, the agarose gel is stained with ethidium bromide. MSP products are visible when the gel is viewed during illumination with ultraviolet light. By comparison to standardized size markers, it is determined if the MSP product is of the correct expected size.

Other methods can be used to determine whether a product is made in an MSP reaction. One such method is called "real-time PCR." Real-time PCR utilizes a thermal cycler (i.e., an instrument that provides the temperature changes necessary for the PCR reaction to occur) that incorporates a fluorimeter (i.e. an instrument that measures fluorescence). The real-time PCR reaction mixture also contains a reagent whose incorporation into a product can be quantified and whose quantification is indicative of copy number of that sequence in the template. One such reagent is a fluorescent dye, called SYBR Green I (Molecular Probes, Inc.; Eugene, Oregon) that preferentially binds double-stranded DNA and whose fluorescence is greatly enhanced by binding of double-stranded DNA. When a PCR reaction is performed in the presence of SYBR Green I, resulting DNA products bind SYBR Green I and fluoresce. The fluorescence is detected and quantified by the fluorimeter. Such technique is particularly useful for quantification of the amount of the product in the PCR reaction. Additionally, the product from the PCR reaction may be quantitated in "real-time PCR" by the use of a variety of probes that hybridize to the product including TaqMan probes and molecular beacons. Quantitation may be on an absolute basis, or may be relative to a constitutively methylated DNA standard, or may be relative to an unmethylated DNA standard. In one instance the ratio of methylated derived product to unmethylated derived product may be constructed.

Methods for detecting methylation of the DNA according to the present disclosure are not limited to MSP, and may cover any assay for detecting DNA methylation. Another example method of detecting methylation of the DNA is by using "methylation-sensitive" restriction endonucleases. Such methods comprise treating the genomic DNA isolated from a subject with a methylation-sensitive restriction endonuclease and then using the restriction endonuclease-treated DNA as a template in a PCR reaction. Herein, methylation-sensitive restriction endonucleases recognize and cleave a specific sequence within the DNA if C bases within the recognition sequence are not methylated. If C bases within the recognition sequence of the restriction endonuclease are methylated, the DNA will not be cleaved. Examples of such methylation-sensitive restriction endonucleases include, but are not limited to HpaII, SmaI, SacII, EagI, BstUI, and BssHII. In this technique, a recognition sequence for a methylation-sensitive restriction endonuclease is located within the template DNA, at a position between the forward and reverse primers used for the PCR reaction. In the case that a C base within the methylation-sensitive restriction endonuclease recognition sequence is not methylated, the endonuclease will cleave the DNA template and a PCR product will not be formed when the DNA is used as a template in the PCR reaction. In the case that a C base within the methylation-sensitive restriction endonuclease recognition sequence is methylated, the endonuclease will not cleave the DNA template and a PCR product will be formed when the DNA is used as a template in the PCR reaction. Therefore, methylation of C bases can be determined by the absence or presence of a PCR product (Kane, et al., 1997, Cancer Res, 57:808-11). No sodium bisulfite is used in this technique.

Yet another exemplary method of detecting methylation of the DNA is called the modified MSP, which method utilizes primers that are designed and chosen such that products of the MSP reaction are susceptible to digestion by restriction endonucleases, depending upon whether the compound-converted template sequence contains CpG dinucleotides or UpG dinucleotides.

Yet other methods for detecting methylation of the DNA include the MS-SnuPE methods. This method uses compound-converted DNA as a template in a primer extension reaction wherein the primers used produce a product, dependent upon whether the compound-converted template contains CpG dinucleotides or UpG dinucleotides (see e.g., Gonzalgo, et al., 1997, *Nucleic Acids Res.*, 25:2529-31).

Another exemplary method of detecting methylation of the DNA is called COBRA (i.e., combined bisulfite restriction analysis). This method has been routinely used for DNA methylation detection and is well known in the art (see, e.g., Xiong, et al., 1997, *Nucleic Acids Res*, 25:2532-4). In this technique, methylation-sensitive restriction endonucleases recognize and cleave a specific sequence within the DNA if C bases within the recognition sequence are methylated. If C bases within the recognition sequence of the restriction endonuclease are not methylated, the DNA will not be cleaved. In some embodiments, the method utilizes methylation-sensitive restriction endonucleases.

Another exemplary method of detecting methylation of DNA requires hybridization of a compound converted DNA to arrays that include probes that hybridize to sequences derived from a methylated template.

Another exemplary method of detecting methylation of DNA includes precipitation of methylated DNA with antibodies that bind methylated DNA or with other proteins that bind methylated DNA, and then detection of DNA sequences in the precipitate. The detection of DNA could be done by PCR based methods, by hybridization to arrays, or by other methods known to those skilled in the art.

Another exemplary method of detecting methylated DNA is bisulfite sequencing that involves amplification of a target region of bisulfite converted DNA using methylation indifferent PCR primers that amplify converted DNAs derived from both methylated and unmethylated templates. The methylation indifferent primers are often designed to be both methylation indifferent and bisulfite specific, i.e. to amplify only bisulfite converted target DNAs and not to amplify non-converted target sequences. In some embodiments, the amplified DNAs then may be characterized by Next Generation Sequencing methods that allow each cytosine base in the original template to be assessed within each DNA sequence read for the presence of methylation (retention of cytosine) or the absence of methylation (conversion to thymidine). The percent of methylation at each cytosine base in the original template can then be calculated by the percent of DNA reads in which the cytosine is preserved as cytosine versus is converted to thymidine. Similarly, the percent of methylation across a region of interest can be assessed by determining a rule for assessing the region as methylated or unmethylated in an individual DNA read (i.e. determining a cutoff for methylation in the region that will categorize the region as "methylated"), and then determining the percent of DNA reads in which the region qualifies as methylated.

In certain embodiments, the disclosure provides methods that involve directly sequencing the product resulting from an MSP reaction to determine if the compound-converted template sequence contains CpG dinucleotides or UpG dinucleotides. Molecular biology techniques such as directly sequencing a PCR product are well known in the art.

In some embodiments, methylation of DNA may be measured as a percentage of total DNA. High levels of methylation may be 1-100% methylation, for example, 1%, 10%, 20%, 30%, 40%, 50%, 60%, 70%, 80%, 90%, or 100% methylation. Low levels of methylation may be 0%-0.99% methylation, for example, 0%, 0.1%, 0.5%, 0.6%, 0.7%, 0.8%, 0.9%. At least some normal tissues, for example, normal esophagus samples, may not have any detectable methylation.

The skilled artisan will appreciate that the present disclosure is based in part, on the recognition that any one of the informative loci disclosed herein may include nucleotide sequences that encode polypeptides that, for example, may function as a tumor suppressor gene. Accordingly, the application further provides methods for detecting such polypeptides in cell samples. In some embodiments, the disclosure provides detection methods by assaying such polypeptides so as to determine whether a patient has or does not have a disease condition. Further, such a disease condition may be characterized by decreased levels of such polypeptides. In certain embodiments, the disclosure provides methods for determining whether a patient is or is not likely to have cancer by detecting such polypeptides. In further embodiments, the disclosure provides methods for determining whether the patient is having a relapse or determining whether a patient's cancer is responding to treatment.

Optionally, such methods involve obtaining a quantitative measure of the protein in the sample. In view of this specification, one of skill in the art will recognize a wide range of techniques that may be employed to detect and optionally quantitate the presence of a protein. In some embodiments, a protein is detected with an antibody. In many embodiments, an antibody-based detection assay involves bringing the sample and the antibody into contact so that the antibody has an opportunity to bind to proteins having the corresponding epitope. In many embodiments, an antibody-based detection assay also typically involves a system for detecting the presence of antibody-epitope complexes, thereby achieving a detection of the presence of the proteins having the corresponding epitope. Antibodies may be used in a variety of detection techniques, including enzyme-linked immunosorbent assays (ELISAs), immunoprecipitations, Western blots. Antibody-independent techniques for identifying a protein may also be employed. For example, mass spectroscopy, particularly coupled with liquid chromatography, permits detection and quantification of large numbers of proteins in a sample. Two-dimensional gel electrophoresis may also be used to identify proteins, and may be coupled with mass spectroscopy or other detection techniques, such as N-terminal protein sequencing. RNA aptamers with specific binding for the protein of interest may also be generated and used as a detection reagent. Samples should generally be prepared in a manner that is consistent with the detection system to be employed. For example, a sample to be used in a protein detection system should generally be prepared in the absence of proteases. Likewise, a sample to be used in a nucleic acid detection system should generally be prepared in the absence of nucleases. In many instances, a sample for use in an antibody-based detection system will not be subjected to substantial preparatory steps. For example, urine may be used directly, as may saliva and blood, although blood will, in certain embodiments, be separated into fractions such as plasma and serum.

In certain embodiments, a method of the disclosure comprises detecting the presence of an informative loci-expressed nucleic acid, such as an mRNA, in a sample. Optionally, the method involves obtaining a quantitative measure of the informative loci-expressed nucleic acid in the sample. In view of this specification, one of skill in the art will recognize a wide range of techniques that may be employed to detect and optionally quantitate the presence of a nucleic acid. Nucleic acid detection systems generally involve preparing a purified nucleic acid fraction of a sample, and subjecting the sample to a direct detection assay or an amplification process followed by a detection assay. Amplification may be achieved, for example, by polymerase chain reaction (PCR), reverse transcriptase (RT) and coupled RT-PCR. Detection of a nucleic acid is generally accomplished by probing the purified nucleic acid fraction with a probe that hybridizes to the nucleic acid of interest, and in many instances, detection involves an amplification as well. Northern blots, dot blots, microarrays, quantitative PCR, and quantitative RT-PCR are all well known methods for detecting a nucleic acid in a sample.

In certain embodiments, the disclosure provides nucleic acid probes that bind specifically to an informative loci nucleic acid. Such probes may be labeled with, for example, a fluorescent moiety, a radionuclide, an enzyme or an affinity tag such as a biotin moiety. For example, the TaqMan® system employs nucleic acid probes that are labeled in such a way that the fluorescent signal is quenched when the probe is free in solution and bright when the probe is incorporated into a larger nucleic acid.

Immunoscintigraphy using monoclonal antibodies directed at the informative loci may be used to detect and/or diagnose a cancer. For example, monoclonal antibodies against the informative loci labeled with $^{99}$Technetium, $^{111}$Indium, $^{123}$Iodine—may be effectively used for such imaging. As will be evident to the skilled artisan, the amount of radioisotope to be administered is dependent upon the radioisotope. Those having ordinary skill in the art can readily formulate the amount of the imaging agent to be administered based upon the specific activity and energy of a given radionuclide used as the active moiety. Typically 0.1-100 millicuries per dose of imaging agent, 1-10 millicuries, or often 2-5 millicuries are administered. Thus, compositions according to the present invention useful as imaging agents comprising a targeting moiety conjugated to a radioactive moiety comprise 0.1-100 millicuries, in some embodiments 1-10 millicuries, in some embodiments 2-5 millicuries, in some embodiments 1-5 millicuries.

A variety of methods can be used to determine if TPS3 contains a somatic mutation, as will be evident to the skilled artisan. In some embodiments, the TP53 gene or protein sequence is determined and any change in the determined sequence relative to the wildtype sequence is detected. In some embodiments, the TP53 gene sequence is determined by PCR, RT-PCR, Northern Blot, Southern Blot, and/or in situ hybridization. Another way to determine if TPS3 contains a somatic mutation may involve the use of an antibody-based detection assay (e.g. ELISA, immunohistochemistry, and/or Western Blot). In some embodiments, the antibody-based detection assay utilizes an antibody that binds to a mutant TPS3 protein with a tighter affinity than it binds to a wildtype TP53 protein. The skilled artisan will also readily appreciate methods of determining somatic mutations in TPS3 based on the disclosures of U.S. Pat. Nos. 5,843,654, 5,620,848, EP0390323 and U.S. Pat. No. 5,527,676, all of which are herein incorporated by reference in their entirely.

In some embodiments, the disclosure provides for a device useful for detecting the methylation status of any of the informative loci, or fragments or complements thereof, disclosed herein. In some embodiments, the disclosure provides for a kit comprising components useful for detecting the methylation status of the informative loci, or fragments, or complements thereof, disclosed herein. In some embodiments, the kit comprises a swallowable balloon for collecting an esophageal sample from the subject. In some embodiments, the kit comprises any of the swallowable balloon devices disclosed in WO 2015/089422, which is incorporated herein in its entirety. In some embodiments, the disclosure provides for a kit comprising primers for amplifying any of the informative loci described herein, and instructions for performing any of the methods disclosed herein. In some embodiments, the kit further comprises bisulfite. In some embodiments, the kit further comprises an object suitable for collecting a sample from a subject (e.g., a brush and or balloon). In some embodiments, the disclosure provides for a kit comprising any of the therapeutic agents disclosed herein and instructions for performing any of the therapeutic methods disclosed herein.

In certain embodiments, the present disclosure provides drug screening assays for identifying test compounds which potentiate the tumor suppressor function of polypeptides encoded by sequences located in the informative loci disclosed herein. In one aspect, the assays detect test compounds which potentiate the expression level of polypeptides encoded by sequences located in the informative loci disclosed herein. In another aspect, the assays detect test compounds which inhibit the methylation of DNA. In certain embodiments, drug screening assays can be generated which detect test compounds on the basis of their ability to interfere with stability or function of polypeptides encoded by sequences located in the informative loci disclosed herein.

A variety of assay formats may be used and, in light of the present disclosure, those not expressly described herein will nevertheless be considered to be within the purview of ordinary skill in the art. Assay formats can approximate such conditions as protein expression level, methylation status of nucleotide sequences, tumor suppressing activity, and may be generated in many different forms. In many embodiments, the disclosure provides assays including both cell-free systems and cell-based assays which utilize intact cells.

Compounds to be tested can be produced, for example, by bacteria, yeast or other organisms (e.g., natural products), produced chemically (e.g., small molecules, including peptidomimetics), or produced recombinantly. The efficacy of the compound can be assessed by generating dose response curves from data obtained using various concentrations of the test compound. Moreover, a control assay can also be performed to provide a baseline for comparison. In the control assay, the formation of complexes is quantitated in the absence of the test compound.

In many drug screening programs which test libraries of compounds and natural extracts, high throughput assays are desirable in order to maximize the number of compounds surveyed in a given period of time. Assays of the present invention which are performed in cell-free systems, such as may be developed with purified or semi-purified proteins or with lysates, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or changes in enzymatic properties of the molecular target.

In certain embodiments, test compounds identified from these assays may be used in a therapeutic method of treating cancer.

Still another aspect of the application provides transgenic non-human animals which express a gene located within any one of the informative loci disclosed herein, or which have had one or more of such genomic gene(s) disrupted in at least one of the tissue or cell-types of the animal.

In another aspect, the application provides an animal model for cancer, which has a mis-expressed allele of a gene located within any one of the informative loci disclosed herein. Such a mouse model can then be used to study disorders arising from mis-expression of genes located within any one of the informative loci disclosed herein.

Genetic techniques which allow for the expression of transgenes can be regulated via site-specific genetic manipulation in vivo are known to those skilled in the art. For instance, genetic systems are available which allow for the regulated expression of a recombinase that catalyzes the genetic recombination a target sequence. As used herein, the phrase "target sequence" refers to a nucleotide sequence that is genetically recombined by a recombinase. The target sequence is flanked by recombinase recognition sequences and is generally either excised or inverted in cells expressing recombinase activity. Recombinase catalyzed recombination events can be designed such that recombination of the target sequence results in either the activation or repression of expression of the polypeptides. For example, excision of a target sequence which interferes with the expression of a recombinant gene can be designed to activate expression of that gene. This interference with expression of the protein can result from a variety of mechanisms, such as spatial separation of the gene from the promoter element or an internal stop codon. Moreover, the transgene can be made wherein the coding sequence of the gene is flanked recombinase recognition sequences and is initially transfected into cells in a 3' to 5' orientation with respect to the promoter element. In such an instance, inversion of the target sequence will reorient the subject gene by placing the 5' end of the coding sequence in an orientation with respect to the promoter element which allow for promoter driven transcriptional activation.

In an illustrative embodiment, either the cre/loxP recombinase system of bacteriophage P1 (Lakso et al., (1992) *Proc. Natl. Acad. Sci. USA* 89:6232-6236; Orban et al., (1992) *Proc. Natl. Acad. Sci. USA* 89:6861-6865) or the FLP recombinase system of *Saccharomyces cerevisiae* (O'Gorman et al., (1991) *Science* 251:1351-1355; PCT publication WO 92/15694) can be used to generate in vivo site-specific genetic recombination systems. Cre recombinase catalyzes the site-specific recombination of an intervening target sequence located between loxP sequences. loxP sequences are 34 base pair nucleotide repeat sequences to which the Cre recombinase binds and are required for Cre recombinase mediated genetic recombination. The orientation of loxP sequences determines whether the intervening target sequence is excised or inverted when Cre recombinase is present (Abremski et al., (1984) *J. Biol. Chem.* 259:1509-1514); catalyzing the excision of the target sequence when the loxP sequences are oriented as direct repeats and catalyzes inversion of the target sequence when loxP sequences are oriented as inverted repeats.

V. Subjects and Samples

In certain aspects, the invention relates to a subject suspected of having or has: a cancer, a metaplasia, or a neoplasia of the upper gastrointestinal tract (e.g., esophageal cancer). Alternatively, a subject may be undergoing routine screening and may not necessarily be suspected of having such metaplasia or neoplasia. In some embodiments, the subject is a human subject, and the neoplasia is a neoplasia of the upper gastrointestinal tract, such as the esophagus. In some embodiments, the subject is a human subject, and the metaplasia is Barrett's esophagus.

Assaying for biomarkers discussed above in a sample from subjects not known to have, e.g., a metaplasia or neoplasia of the upper or lower gastrointestinal tract can aid in diagnosis of such a metaplasia or neoplasia in the subject. To illustrate, detecting the methylation status of the nucleotide sequences by MSP can be used by itself, or in combination with detecting the somatic mutation status of TP53 or other various assays, to 1948493-0002-098-303 improve the sensitivity and/or specificity for detecting, e.g., a neoplasia of the upper or lower gastrointestinal tract. In some embodiments, such detection is made at an early stage in the development of cancer, so that treatment is more likely to be effective.

In some embodiments, an informative loci in a subject is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma) if the loci is at least 10%, 20%, 30%, 40%, 50%, 60%, 70%, 80%, 90%, or 100% methylated. In some embodiments, a DNA sample from a subject is treated with bisulfite, and the resulting bisulfite sequence corresponds to any of the nucleotide sequences disclosed herein comprising a "Y" nucleotide. In some embodiments, if at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, a DNA sample from a subject is treated with bisulfite, and the resulting bisulfite sequence corresponds to any of the nucleotide sequences disclosed herein comprising a "Y" nucleotide. In some embodiments, if at least 10%, 20%, 30%, 40%, 50%, 60%, 70%, 80%, 90%, or 100% of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, a subject is determined to be prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma) if a certain number of "Y" nucleotides in a bisulfite converted sequence are cytosines. In some embodiments, the certain number is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues of the bisulfite-converted sequence. In some embodiments, the certain number is least 10%, 20%, 30%, 40%, 50%, 60%, 70%, 80%, 90%, or 100% of the Y residues of the bisulfite-converted sequence. In certain embodiments, a subject is determined to be prone to developing and/or has developed a metaplasia in the esophagus (e.g., Barrett's esophagus) or neoplasia (e.g., esophageal cancer such as esophageal adenocarcinoma) (e.g., Barrett's esophagus with dysplasia such as high-grade or low-grade dysplasia) if a certain percentage of DNA molecules from a sample from a subject are determined to be "methylated," as defined herein. In some embodiments, the certain percentage of DNA molecules is at least 10%, 20%, 30%, 40%, 50%, 60%, 70%, 80%, 90%, or 100% of the DNA molecules from the sample are determined to be "methylated." In some embodiments, the the percentage of methylated DNA molecules is determined using next-generation sequencing. Exemplary cut-offs of DNA methylation and DNA molecule percentages may be found in the Examples section provided herein.

In particular embodiments, a vimentin sequence is considered "methylated" or a "methylated read" if at least 70%, 75%, 80%, 90% or 100% of the CpG cytosines in a vimentin sequence, or portion thereof, are methylated. In some embodiments, if at least 8, 9 or 10 of the "Y" nucleotides in a portion of a vimentin sequence (such as the sequence of SEQ ID NOs: 16207 and/or 16208, or a portion thereof, such as the sequence of SEQ ID NOs: 16209 and/or 16210) have a C, then the vimentin sequence is considered "methylated" or a "read." In some embodiments, the primers used to amplify the portion of the vimentin nucleic acid sequence comprise the nucleotide sequences of SEQ ID NOs: 16209 and/or 16210. In some embodiments, if at least 0.5%, 0.8%, 0.9%, 1%, 2%, 3%, 4%, 5%, 6%, 7%, 8%, or 9% of the vimentin nucleic acid sequences in a sample from a subject are considered methylated or a read, then the subject is determined to have an esophageal metaplasia and/or neoplasia. In particular embodiments, if at least 1% (e.g., at least 1.05%) of the vimentin nucleic acid sequences in a sample from a subject are considered methylated or a read, then the subject is determined to have an esophageal metaplasia and/or neoplasia.

In particular embodiments, a SqBE18 sequence is considered "methylated" or a "methylated read" if at least 65%, 70%, 75%, 80%, 90% or 100% of the CpG cytosines in a SqBE18 sequence (e.g., a nucleotide sequence at least 80%, 85%, 90%, 91%, 92%, 93%, 94%, 95%, 96%, 97%, 98%, 99% or 100% identity to the sequence of SEQ ID NO: 8220, 8262, 8304 or 8346), or a portion thereof, are methylated. In some embodiments, if at least 0.5%, 0.8%, 0.9%, 1%, 2%, 3%, 4%, 5%, 6%, 7%, 8%, or 9% of the SqBE18 nucleic acid sequences in a sample from a subject are considered methylated or a read, then the subject is determined to have an esophageal metaplasia and/or neoplasia. In particular embodiments, if at least 2%, 2.5%, or 3% (e.g., at least 3.11%) of the SqBE18 nucleic acid sequences in a brushing sample from a subject are considered methylated or a read, then the subject is determined to have an esophageal metaplasia and/or neoplasia. In particular embodiments, if at least 1% of the SqBE18 nucleic acid sequences in a balloon sample from a subject are considered methylated or a read, then the subject is determined to have an esophageal metaplasia and/or neoplasia.

In some embodiments, the disclosure provides for a method of diagnosing whether a subject has an esophageal neoplasia or metaplasia, comprising: obtaining a sample from a subject; measuring the amount of methylated cytosines in CpG dinucleotides in a vimentin nucleic acid sequence, or portion thereof, obtained from the sample; wherein if at least 65%, at least 70%, at least 75%, or preferably at least 80% of the cytosines in CpG dinucleotides in the vimentin nucleic acid sequence, or portion thereof, are methylated, than the vimentin nucleic acid sequence, or portion thereof, is considered a read; and measuring the number of reads present in the sample; wherein if at least 1% of the vimentin nucleic acid sequences, or portions thereof, in the sample are reads, than the subject is determined to have an esophageal neoplasia or metaplasia. In some embodiments, the vimentin nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the bisulfite converted vimentin nucleic acid sequence obtained from the subject. In some embodiments, the amplified portion comprises 10 CpGs. In some embodiments, the primers used to amplify the portion of the vimentin nucleic acid sequence comprise SEQ ID NOs: 16209 and 16210. In some embodiments, the amplified portion comprises the nucleotide sequence of SEQ ID NOs: 16207 and/or 16208, and the region between the amplification primers comprises the nucleotide sequences of SEQ ID Nos: 16209 and/or 162010. In some embodiments, if at least 0.5% to 5% of the vimentin nucleic acid sequences, or portions thereof, in the sample are reads, than the subject is determined to have an esophageal neoplasia or metaplasia. In some embodiments, if at least 0.5% to 3% of the vimentin nucleic acid sequences, or portions thereof, in the sample are reads, than the subject is determined to have an esophageal neoplasia or metaplasia. In some embodiments, if at least 0.5% to 1.5% of the vimentin nucleic acid sequences, or portions thereof, in the sample are reads, than the subject is determined to have an esophageal neoplasia or metaplasia. In some embodiments, if at least 0.95% to 1.16% of the vimentin nucleic acid sequences, or portions thereof, in the sample are reads, than the subject is determined to have an esophageal neoplasia or metaplasia. In some embodiments, if at least 1.02% of the vimentin nucleic acid sequences, or portions thereof, in the sample are reads, than the subject is determined to have an esophageal neoplasia or metaplasia. In some embodiments, if at least 3% of the vimentin nucleic acid sequences, or portions thereof, in the sample are reads, than the subject is determined to have an esophageal neoplasia or metaplasia. In some embodiments, if at least 5% of the vimentin nucleic acid sequences, or portions thereof, in the sample are reads, than the subject is determined to have an esophageal neoplasia or metaplasia. In some embodiments, if the sample is obtained from a brushing, and if at least 0.5% to 1.5% of the vimentin nucleic acid sequences, or portions thereof, in the sample are reads, than the subject is determined to have an esophageal neoplasia or metaplasia. In some embodiments, if the sample is obtained from a brushing, and if at least 1.05% of the vimentin nucleic acid sequences, or portions thereof, in the sample are reads, than the subject is determined to have an esophageal neoplasia or metaplasia. In some embodiments, if the sample is obtained from a balloon, and if at least 0.5% to 1.5% of the vimentin nucleic acid sequences, or portions thereof, in the sample are reads, than the subject is determined to have an esophageal neoplasia or metaplasia. In some embodiments, if the sample is obtained from a balloon, and if at least 0.95% to 1.16% of the vimentin nucleic acid sequences, or portions thereof, in the sample are reads, than the subject is determined to have an esophageal neoplasia or metaplasia. In some embodiments, if the sample is obtained from a balloon, and if at least 1% of the vimentin nucleic acid sequences, or portions thereof, in the sample are reads, than the subject is determined to have an esophageal neoplasia or metaplasia. In some embodiments, if the subject is determined to have an esophageal neoplasia or metaplasia, then the subject may be administered any of cryotherapy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of diagnosing whether a subject has an esophageal neoplasia or metaplasia, comprising: obtaining a sample from a subject; measuring the amount of methylated cytosines in CpG dinucleotides in a SqBE18 nucleic acid sequence, or portion thereof, obtained from the sample; wherein if at least 65%, at least 70%, or at least 75% (e.g., at least 71% or at least 76%) of the cytosines in CpG dinucleotides in the SqBE18 nucleic acid sequence, or portion thereof, are methylated, than the SqBE18 nucleic acid sequence, or portion thereof, is considered a read; and measuring the number of reads present in the sample; wherein if at least 0.5%, at least 1%, at least 2%, or at least 3% (e.g. least 3.11%) of the SqBE18 nucleic acid sequences, or portions thereof, in the sample are reads, than the subject is determined to have an esophageal neoplasia or metaplasia. In some embodiments, the SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the bisulfite converted SqBE18 nucleic acid sequence obtained from the subject. In some embodiments, if at least 0.5% to 5% of the SqBE18 nucleic acid sequences, or portions thereof, in the sample are reads, than the subject is determined to have an esophageal neoplasia or metaplasia. In some embodiments, if at least 0.5% to 3.5% of the SqBE18 nucleic acid sequences, or portions thereof, in the sample are reads, than the subject is determined to have an esophageal neoplasia or metaplasia. In some embodiments, if at least 1% to 3.11% of the SqBE18 nucleic acid sequences, or portions thereof, in the sample are reads, than the subject is determined to have an esophageal neoplasia or metaplasia. In some embodiments, if at least 0.76% to 1.06% of the SqBE18 nucleic acid sequences, or portions thereof, in the sample are reads, than the subject is determined to have an esophageal neoplasia or metaplasia. In some embodiments, if at least 3.11% of the SqBE18 nucleic acid sequences, or portions thereof, in the sample are reads, than the subject is determined to have an esophageal neoplasia or metaplasia. In some embodiments, if at least 0.1% of the SqBE18 nucleic acid sequences, or portions thereof, in the sample are reads, than the subject is determined to have an esophageal neoplasia or metaplasia. In some embodiments, if at least 1% of the SqBE18 nucleic acid sequences, or portions thereof, in the sample are reads, than the subject is determined to have an esophageal neoplasia or metaplasia. In some embodiments, if the sample is obtained from a brushing, and if at least 2% to 3.11% of the SqBE18 nucleic acid sequences, or portions thereof, in the sample are reads, than the subject is determined to have an esophageal neoplasia or metaplasia. In some embodiments, if the sample is obtained from a brushing, and if at least 3.11% of the SqBE 18 nucleic acid sequences, or portions thereof, in the sample are reads, than the subject is determined to have an esophageal neoplasia or metaplasia. In some embodiments, if the sample is obtained from a balloon, and if at least 0.5% to 1.5% of the SqBE18 nucleic acid sequences, or portions thereof, in the sample are reads, than the subject is determined to have an esophageal neoplasia or metaplasia. In some embodiments, if the sample is obtained from a balloon, and if at least 0.76% to 1.06% of the SqBE18 nucleic acid sequences, or portions thereof, in the sample are reads, than the subject is determined to have an esophageal neoplasia or metaplasia. In some embodiments, if the sample is obtained from a balloon, and if at least 1% of the SqBE18 nucleic acid sequences, or portions thereof, in the sample are reads, than the subject is determined to have an esophageal neoplasia or metaplasia. In some embodiments, if the subject is determined to have an esophageal neoplasia or metaplasia, then the subject may be administered any of cryotherapy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of diagnosing whether a subject has an esophageal neoplasia or metaplasia, comprising: obtaining a sample from a subject; measuring the amount of methylated cytosines in CpG dinucleotides in a vimentin nucleic acid sequence and in a SqBE18 nucleic acid sequence, or portions thereof, obtained from the sample; wherein if at least 65%, at least 70%, at least 75%, or preferably at least 80% of the cytosines in CpG dinucleotides in the vimentin nucleic acid sequence, or portion thereof, are methylated, than the vimentin nucleic acid sequence, or portion thereof, is considered a read for VIM (vimentin); wherein if at least 65%, at least 70%, or at least 75% (e.g., at least 71% or at least 76%) of the cytosines in CpG dinucleotides in the SqBE18 nucleic acid sequence, or portion thereof, are methylated, than the SqBE18 nucleic acid sequence, or portion thereof, is considered a read for SqBE18; and measuring the number of VIM and SqBE18 reads present in the sample; wherein if at least 1% of the vimentin nucleic acid sequences, or portions thereof, in the sample are VIM reads and if at least 0.5%, at least 1%, at least 2%, or at least 3% (e.g. least 3.11%) of the SqBE18 nucleic acid sequences, or portions thereof, in the sample are SqBE18 reads, than the subject is determined to have an esophageal neoplasia or metaplasia. In some embodiments, the vimentin or SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the bisulfite converted vimentin or SqBE18 nucleic acid sequence obtained from the subject. In some embodiments, the amplified vimentin portion comprises 10 CpGs. In some embodiments, the amplified SqBE18 portion comprises 21 CpGs. In some embodiments, the primers used to amplify the portion of the bisulfite converted vimentin nucleic acid sequence comprise SEQ ID NOs: 16209 and 16210. In some embodiments, the amplified portion comprises the nucleotide sequence of SEQ ID NOs: 16207 and/or 16208, and the region between the amplification primers comprises the nucleotide sequences of SEQ ID Nos: 16209 and/or 16210. In some embodiments, the primers used to amplify the portion of the bisulfite converted SqBE18 nucleic acid sequence comprise SEQ ID NOs: 8388 and 8402. In some embodiments, the amplified portion comprises the nucleotide sequence of SEQ ID NOs: 8318 and/or 8360, or fragments and/or reverse complements thereof. In some embodiments, the amplified portion comprises the nucleotide sequences of SEQ ID NOs: 8332 and/or 8374, or fragments and/or reverse complements thereof, which may be generated from fully methylated parental templates. In some embodiments, if at least 0.5% to 5% of the vimentin nucleic acid sequences, or portions thereof, in the sample are VIM reads, and if at least 0.5% to 5% of the SqBE18 nucleic acid sequences, or portions thereof, in the sample are SqBE18 reads, than the subject is determined to have an esophageal neoplasia or metaplasia. In some embodiments, if at least 0.5% to 3% of the vimentin nucleic acid sequences, or portions thereof, in the sample are VIM reads, and if at least 0.5% to 3.5% of the SqBE18 nucleic acid sequences, or portions thereof, in the sample are SqBE18 reads, than the subject is determined to have an esophageal neoplasia or metaplasia. In some embodiments, if at least 0.5% to 1.5% of the vimentin nucleic acid sequences, or portions thereof, in the sample are VIM reads, and if at least 1% to 3.11% of the SqBE18 nucleic acid sequences, or portions thereof, in the sample are SqBE18 reads, than the subject is determined to have an esophageal neoplasia or metaplasia. In some embodiments, if at least 1% of the vimentin nucleic acid sequences, or portions thereof, in the sample are VIM reads, and if at least 1% of the SqBE18 nucleic acid sequences, or portions thereof, in the sample are SqBE18 reads, than the subject is determined to have an esophageal neoplasia or metaplasia. In some embodiments, if at least 1.05% of the vimentin nucleic acid sequences, or portions thereof, in the sample are VIM reads, and if at least 3.11% of the SqBE18 nucleic acid sequences, or portions thereof, in the sample are SqBE18 reads, than the subject is determined to have an esophageal neoplasia or metaplasia. In some embodiments, if the sample is obtained from a brushing, and if at least 0.5% to 1.5% of the vimentin nucleic acid sequences, or portions thereof, in the sample are VIM reads, and if at least 2% to 3.11% of the SqBE18 nucleic acid sequences, or portions thereof, in the sample are SqBE18 reads, than the subject is determined to have an esophageal neoplasia or metaplasia. In some embodiments, if the sample is obtained from a brushing, and if at least 1.05% of the vimentin nucleic acid sequences, or portions thereof, in the sample are VIM reads, and if at least 3.11% of the SqBE18 nucleic acid sequences, or portions thereof, in the sample are SqBE18 reads, than the subject is determined to have an esophageal neoplasia or metaplasia. In some embodiments, if the sample is obtained using a balloon, and if at least 0.5% to 1.5% of the vimentin nucleic acid sequences, or portions thereof, in the sample are VIM reads, and if at least 0.5% to 1.5% of the SqBE18 nucleic acid sequences, or portions thereof, in the sample are SqBE18 reads, than the subject is determined to have an esophageal neoplasia or metaplasia. In some embodiments, if the sample is obtained using a balloon, and if at least 0.95% to 1.16% of the vimentin nucleic acid sequences, or portions thereof, in the sample are reads, and if at least 0.76% to 1.06% of the SqBE18 nucleic acid sequences, or portions thereof, in the sample are SqBE18 reads, than the subject is determined to have an esophageal neoplasia or metaplasia. In some embodiments, if the sample is obtained from a balloon, and if at least 1% of the vimentin nucleic acid sequences, or portions thereof, in the sample are reads, and if at least 1% of the SqBE18 nucleic acid sequences, or portions thereof, in the sample are SqBE18 reads, than the subject is determined to have an esophageal neoplasia or metaplasia. In some embodiments, if the subject is determined to have an esophageal neoplasia or metaplasia, then the subject may be administered any of cryotherapy, photodynamic therapy (PDT); radiofrequency ablation (RFA); laser ablation; argon plasma coagulation (APC); electrocoagulation (electrofulguration); esophageal stent, surgery, and/or a therapeutic agent.

In addition to diagnosis, assaying of a marker in a sample from a subject not known to have, e.g., a metaplasia or neoplasia of the upper gastrointestinal tract, can be prognostic for the subject (i.e., indicating the probable course of the disease). To illustrate, subjects having a predisposition to develop a metaplasia or neoplasia of the upper gastrointestinal tract may possess methylated nucleotide sequences. Assaying of methylated informative loci (e.g., vimentin and/or SqBE18) in a sample from subjects either by itself, or in combination with assaying for somatic mutation(s) in TP53, can also be used to select a particular therapy or therapies which are particularly effective against, e.g., a neoplasia or metaplasia of the upper gastrointestinal tract in the subject, or to exclude therapies that are not likely to be effective.

Assaying of methylated informative loci (e.g., vimentin and/or SqBE18) in samples from subjects that are known to have, or to have had, a cancer is also useful. For example, the present methods can be used to identify whether therapy is effective or not for certain subjects. One or more samples are taken from the same subject prior to and following therapy, and assayed for any one or more of the informative loci markers either by itself or themselves, or in combination with assaying for somatic mutation(s) in TP53. A finding that an informative locus is methylated in the sample taken prior to therapy and absent (or at a lower level) after therapy may indicate that the therapy is effective and need not be altered. In those cases where the informative locus is methylated in the sample taken before therapy and in the sample taken after therapy, it may be desirable to alter the therapy to increase the likelihood that the cancer will be reduced in the subject. Thus, the present method may obviate the need to perform more invasive procedures which are used to determine a patient's response to therapy.

Cancers frequently recur following therapy in patients with advanced cancers. In this and other instances, the assays of the invention are useful for monitoring over time the status of a cancer associated with silencing of genes located in the informative loci disclosed herein. For subjects in whom a cancer is progressing, there can be no DNA methylation in some or all samples when the first sample is taken and then appear in one or more samples when the second sample is taken. For subjects in which cancer is regressing, DNA methylation may be present in one or a number of samples when the first sample is taken and then be absent in some or all of these samples when the second sample is taken.

Samples for use with the methods described herein may be essentially any biological material of interest, e.g., a collection of cells taken from a subject. For example, a sample may be a bodily fluid sample from a subject, a tissue sample from a subject, a solid or semi-solid sample from a subject, a primary cell culture or tissue culture of materials derived from a subject, cells from a cell line, or medium or other extracellular material from a cell or tissue culture, or a xenograft (meaning a sample of a cancer from a first subject, e.g., a human, that has been cultured in a second subject, e.g., an immuno-compromised mouse). The term "sample" as used herein is intended to encompass both a biological material obtained directly from a subject (which may be described as the primary sample) as well as any manipulated forms or portions of a primary sample. A sample may also be obtained by contacting a biological material with an exogenous liquid, resulting in the production of a lavage liquid containing some portion of the contacted biological material. Furthermore, the term "sample" is intended to encompass the primary sample after it has been mixed with one or more additive, such as preservatives, chelators, anti-clotting factors, etc. In some embodiments, a sample is obtained by means of a cytology brushing and/or a balloon. In some embodiments, the sample is obtained from a subject's gastroesophageal junction.

In certain embodiments, a bodily fluid sample is a blood sample. In this case, the term "sample" is intended to encompass not only the blood as obtained directly from the patient but also fractions of the blood, such as plasma, serum, cell fractions (e.g., platelets, erythrocytes, and lymphocytes), protein preparations, nucleic acid preparations, etc. In some embodiments, the bodily fluid may be derived from the stomach, for example, gastric secretions, acid reflux, or vomit. In other embodiments, the bodily fluid may be a fluid secreted by the pancreas or bladder. In other embodiments, the body fluid may be saliva, spit, or an esophageal washing. In certain embodiments, a tissue sample is a biopsy taken from the mucosa of the gastrointestinal tract. In other embodiments, a tissue sample is the brushings from, e.g., the esophagus of a subject.

A subject is in some embodiments a human subject, but it is expected that the molecular markers disclosed herein, and particularly their homologs from other animals, are of similar utility in other animals. In certain embodiments, it may be possible to detect a biomarker described herein (e.g., DNA methylation or protein expression level) directly in an organism without obtaining a separate portion of biological material. In such instances, the term "sample" is intended to encompass that portion of biological material that is contacted with a reagent or device involved in the detection process.

In certain embodiments, DNA which is used as the template is obtained from a bodily fluid sample. Examples of bodily fluids are blood, saliva, spit or an esophageal washing. Other body fluids can also be used. Because they can be easily obtained from a subject and can be used to screen for multiple diseases, blood or blood-derived fractions are especially useful. Blood-derived fractions can comprise blood, serum, plasma, or other fractions. For example, a cellular fraction can be prepared as a "buffy coat" (i.e., leukocyte-enriched blood portion) by centrifuging 5 ml of whole blood for 10 min at 800 times gravity at room temperature. Red blood cells sediment most rapidly and are present as the bottom-most fraction in the centrifuge tube. The buffy coat is present as a thin creamy white colored layer on top of the red blood cells. The plasma portion of the blood forms a layer above the buffy coat. Fractions from blood can also be isolated in a variety of other ways. One method is by taking a fraction or fractions from a gradient used in centrifugation to enrich for a specific size or density of cells.

In some embodiments, DNA is isolated from samples. Procedures for isolation of DNA from such samples are well known to those skilled in the art. Commonly, such DNA isolation procedures comprise lysis of any cells present in the samples using detergents, for example. After cell lysis, proteins are commonly removed from the DNA using various proteases. RNA is removed using RNase. The DNA is then commonly extracted with phenol, precipitated in alcohol and dissolved in an aqueous solution.

VI. Therapeutic Methods

In some embodiments, the disclosure provides for a method of determining whether a subject has any one or more of the methylated informative loci disclosed herein (e.g., vimentin and/or SqBE18) that are indicative of the presence of a metaplasia in the esophagus (e.g., Barrett's esophagus), wherein if the subject is determined to have a metaplasia in the esophagus (e.g., Barrett's esophagus), the subject is treated with an agent that treats the metaplasia in the esophagus (e.g., Barrett's esophagus). In some embodiments, the disclosure provides for a method of treating a subject determined to have a metaplasia in the esophagus (e.g., Barrett's esophagus). In some embodiments, the treatment of a metaplasia in the esophagus (e.g., Barrett's esophagus) encompasses administration of any one or more of the following compounds: proton pump inhibitors (PPIs) such as omeprazole (Prilosec, Zegerid), lansoprazole (Prevacid), pantoprazole (Protonix), rabeprazole (AcipHex), esomeprazole (Nexium), dexlansoprazole (Dexilant). Histamine H2 receptor blocking agents such as cimetidine (Tagamet), ranitidine (Zantac), famotidine (Pepcid) and nizatidine (Axid). Tums, Rolaids, or other quick-acting reflux medications. Prokinetic agents, or drugs that help move food through the gastrointestinal tract more quickly, offer an attractive alternative either alone or in combination with acid inhibition. In some embodiments, the treatment of a metaplasia in the esophagus (e.g., Barrett's esophagus) is endoscopic mucosal resection (EMR); photodynamic therapy (PDT); radiofrequency ablation (RFA); argon plasma coagulation (APC); cryotherapy, and/or surgery (e.g. esophagectomy, anti-reflux surgery).

In some embodiments, the disclosure provides for a method of determining whether a subject has any one or more of the methylated informative loci disclosed herein that are indicative of esophageal neoplasia (e.g., esophageal cancer), wherein if the subject is determined to have an esophageal neoplasia (e.g., esophageal cancer), the subject is treated with an agent that treats the esophageal neoplasia (e.g., esophageal cancer). In some embodiments, the disclosure provides for a method of determining whether a subject has any one or more of the methylated informative loci disclosed herein in combination with any of the TP53 somatic mutations disclosed herein that are indicative of esophageal neoplasia (e.g., esophageal cancer), wherein if the subject is determined to have an esophageal neoplasia (e.g., esophageal cancer), the subject is treated with an agent that treats the esophageal neoplasia (e.g., esophageal cancer). In some embodiments, the disclosure provides for a method of treating a subject determined to have esophageal neoplasia (e.g., esophageal cancer). In some embodiments, the esophageal neoplasia is Barrett's esophagus with low grade dysplasia, Barrett's esophagus with high grade dysplasia (HGD) and/or esophageal adenocarcinoma (EAC). In some embodiments, the treatment of esophageal neoplasia (e.g., esophageal cancer) encompasses surgery (e.g. esophagectomy), radiation therapy, chemoradiation therapy and/or chemotherapy. In some embodiments, the treatment of esophageal neoplasia (e.g., esophageal cancer) encompasses administering one or more chemotherapeutic agent, such as any one or more therapeutic agent selected from the group consisting of: carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®). In some embodiments, for some esophagus cancers that overexpress the HER2 protein on the surface of their cells, chemotherapy may be used along with the targeted drug trastuzumab. Ramucirumab may be used to treat cancers that start at the gastroesophageal (GE) junction when they are advanced. In some embodiments, the treatment encompasses endoscopic treatments, such as endoscopic mucosal resection (EMR) followed by treatment with proton pump inhibitors, photodynamic therapy (PDT); radiofrequency ablation (RFA); laser ablation; argon plasma coagulation (APC); electrocoagulation (electrofuilguration); or esophageal stent.

The terms "treatment", "treating", "alleviation" and the like are used herein to generally mean obtaining a desired pharmacologic and/or physiological effect, and may also be used to refer to improving, alleviating, and/or decreasing the severity of one or more symptoms of a condition being treated. The effect may be prophylactic in terms of completely or partially delaying the onset or recurrence of a disease, condition, or symptoms thereof, and/or may be therapeutic in terms of a partial or complete cure for a disease or condition and/or adverse effect attributable to the disease or condition. "Treatment" as used herein covers any treatment of a disease or condition of a mammal, particularly a human, and includes: (a) preventing the disease or condition from occurring in a subject which may be predisposed to the disease or condition but has not yet been diagnosed as having it; (b) inhibiting the disease or condition (e.g., arresting its development); or (c) relieving the disease or condition (e.g., causing regression of the disease or condition, providing improvement in one or more symptoms).

Treating a metaplasia (e.g., Barrett's esophagus) and/or a neoplasia (e.g., esophageal cancer) in a subject refers to improving (improving the subject's condition), alleviating, delaying or slowing progression or onset, decreasing the severity of one or more symptoms associated with a metaplasia (e.g., Barrett's esophagus) and/or a neoplasia (e.g., esophageal cancer). For example, treating a metaplasia or neoplasia includes any one or more of: reducing growth, proliferation and/or survival of metaplastic/neoplastic cells, killing metaplastic/neoplastic cells (e.g., by necrosis, apoptosis or autophagy), decreasing metaplasia/neoplasia size, decreasing rate of metaplasia/neoplasia size increase, halting increase in metaplasia/neoplasia size, improving ability to swallow, decreasing internal bleeding, decreasing incidence of vomiting, reducing fatigue, decreasing the number of metastases, decreasing pain, increasing survival, and increasing progression free survival.

EXEMPLIFICATION

The invention now being generally described, it will be more readily understood by reference to the following examples, which are included merely for purposes of illustration of certain aspects and embodiments of the present invention, and are not intended to limit the invention.

Example 1: Identification of Esophageal Cancer Informative Loci

Methylated informative loci were initially identified using the technique of reduced representation bisulfite sequencing (RRBS) in a discovery set of 23 paired biopsies of normal squamous esophagus and matched esophageal adenocarcinomas, along with biopsies of 8 Barrett's esophagus tissue, and along with brushings of 8 Barrett's esophagus tissues (one BE brushing case also having a matched biopsy).

Discovery data were initially analyzed for each individual CpG residue in the RRBS data set. Individual CpGs were considered methylated in EAC if they showed methylation in less than 10% of DNA sequence reads in all of the informative squamous samples, where at least 4 squamous samples were informative, where an informative sample had equal to or greater than 20 reads covering the CpG, and if 8 or more of the informative EAC samples demonstrated percent methylation at a level that was at least 20 percentage points greater than the methylation level of the most methylated normal squamous sample. CpGs were similarly defined as methylated in Barrett's esophagus if they showed methylation of less than 10% of DNA sequence reads of all informative squamous samples, where an informative sample had equal to or greater than 20 reads covering the CpG, and if 3 or more of the informative BE samples demonstrated percent methylation at a level that was at least 20 percentage points greater than the methylation level of the most methylated normal squamous sample. CpGs meeting criteria for methylation in both EACs and BE were defined as methylated in both EAC and BE. Such methylated CpGs were then aggregated into patches by grouping together methylated CpGs that were within 200 bp of one another. Patches may consist of 1 CpG up to any number of CpGs that meet the above criteria.

The names assigned to 428 genomic patches defined as methylated in both EAC and BE by the criteria above were recorded, and the sequences of these loci correspond to SEQ ID NOs: 1-856. The genomic coordinates of the genomic patches defined as methylated by the above criteria were also recorded. The genomic sequences of these patches on the respective genomic (+) and (−) strands were determined and recorded. (Upper and lower case designations were used according to those of the UCSC browser, where lower case sequences are lower complexity DNA sequences). The bisulfite converted sequences of these corresponding patches (i.e. the bisulfite converted sequence of the (+) strand and the bisulfite converted sequence of the (−) strand) were determined and recorded (see sequences of SEQ ID NOs: 857-1281 and 1713-2140 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding patches (i.e. in which all Y bases in every bisulfite converted sequence are retained as a C), corresponding to the (+) strand the (−) strand were determined and recorded (see sequences of SEQ ID NOs: 1285-1712 and 2141-2568 for the bisulfite converted sequences of the fully methylated form of the (+) and (−) strands respectively of the corresponding patches). The reverse complements of the bisulfite converted methylated (+) stand and (−) stand sequences will be obvious to one of ordinary skill in the art and are also included by implication in this disclosure.

Patches were expanded by 100 base pairs on either side so as to accommodate either the design of amplification primers or to enclude additional presumptively methylated bases. The sequences of these expanded patches correspond to SEQ ID NOs: 2569-3424 and their genomic coordinates were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding expanded patches (i.e. the bisulfite converted sequence of the (+) strand and the bisulfite converted sequence of the (−) strand) were determined and recorded (see sequence of SEQ ID NOs: 3425-3852 and 4281-4708 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding expanded patches (i.e. in which all Y bases in every bisulfite converted sequence are retained as a C), corresponding to the (+) strand the (−) strand were determined and recorded (see sequences of SEQ ID NOs: 3853-4280 and 4789-5136 for the bisulfite converted sequences of the fully methylated form of the (+) and (−) strands respectively of the corresponding expanded patches). The reverse complements of the bisulfite converted methylated (+) stand and (−) stand sequences will be obvious to one of ordinary skill in the art and are also included by implication in this disclosure.

CpG islands overlapping patches that may contain additional CpGs that are methylated coordinately with patches were also defined. The sequences of these CpG islands correspond to SEQ ID NOs: 5137-5926. The genomic coordinates of the CpG islands were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding CpG islands (i.e. the bisulfite converted sequence of the (+) strand and the bisulfite converted sequence of the (−) strand) were determined and recorded (see sequences of SEQ ID NOs: 5927-6321 and 6717-7111 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding CpG islands (i.e. in which all Y bases in every bisulfite converted sequence are retained as a C), corresponding to the (+) strand the (−) strand were determined and recorded (see sequences of SEQ ID NOs: 6322-6716 and 7112-7506 for the bisulfite converted sequences of the fully methylated form of the (+) and (−) strands respectively of the corresponding CpG islands). The reverse complements of the bisulfite converted methylated (+) stand and (−) stand sequences will be obvious to one of ordinary skill in the art and are also included by implication in this disclosure.

Regions of Interest (ROI) were defined that provided preferred regions for design of PCR amplicons that would encompass preferred patches. The genomic coordinates of the ROI were also recorded. The sequences of the (+) strands of the Regions of Interest correspond to SEQ ID NOs: 8209-8222, and the sequences of the (−) strands Regions of Interest correspond to SEQ ID NOs: 8251-8261. (Upper and lower case designations were used according to those of the UCSC browser, where lower case sequences are lower complexity DNA sequences). The bisulfite converted sequences of these corresponding Regions of Interest (i.e. the bisulfite converted sequence of the (+) strand and the bisulfite converted sequence of the (−) strand) were determined and recorded (see sequences of SEQ ID NOs: 8223-8236 and 8265-8278 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Regions of Interest (i.e. in which all Y bases in every bisulfite converted sequence are retained as a C), corresponding to the (+) strand the (−) strand were determined and recorded (see sequences of SEQ ID NOs: 8237-8250 and 8279-8292 for the bisulfite converted sequences of the fully methylated form of the (+) and (−) strands respectively of the corresponding Regions of Interest). The reverse complements of the bisulfite converted methylated (+) stand and (−) stand sequences will be obvious to one of ordinary skill in the art and are also included by implication in this disclosure.

Specific PCR Amplicons were defined within the Regions of Interest (ROI). The genomic coordinates of the Amplicons were recorded. The sequences of the (+) strands of the Amplicons correspond to SEQ ID NOs: 8293-8306 and 8405-8409, and the sequences of the (−) strands of the Amplicons correspond to SEQ ID NOs: 8335-8348 and 8420-8424. (Upper and lower case designations were used according to those of the UCSC browser, where lower case sequences are lower complexity DNA sequences). The bisulfite converted sequences of these Amplicons (i.e. the bisulfite converted sequence of the (+) strand and the bisulfite converted sequence of the (−) strand) were determined and recorded (see sequences of SEQ ID NOs: 8307-8320 and 8410-8414 for the bisulfite converted sequences of the (+) strands and see sequences of SEQ ID NOs: 8349-8362 and 8425-8429 and for the bisulfite converted sequences of the (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Amplicons (i.e. in which all Y bases in every bisulfite converted sequence are retained as a C), corresponding to the (+) strand the (−) strand were determined and recorded (see sequences of SEQ ID NOs: 8321-8334 and 8415-8419 for the bisulfite converted sequences of the fully methylated form of the (+) strands and see sequences of SEQ ID NOs: 8363-8376 and 8430-8434 for the bisulfite converted sequences of the fully methylated form of the (−) strands). The reverse complements of the bisulfite converted methylated (+) stand and (−) stand sequences will be obvious to one of ordinary skill in the art and are also included by implication in this disclosure. Sequences of PCR primers used in amplification of the Amplicons are provided as SEQ ID NOs: 8377-8404 and 8435-8444.

Confirmatory analysis of candidate loci was then done using bisulfite sequencing of candidate loci that were amplified using bisulfite specific but methylation independent amplification primers. This employed a new sample set of biopsies from: 23 EACs, 8 HGD, 15 non-dysplastic BE from individuals without known higher grade lesions. In addition, biopsies were obtained from 5 cases of BE adjacent to HGD, and from 11 cases of BE adjacent to an EAC. These were not included in analyses of non-dysplastic BE. In addition biopsies were obtained from 33 normal squamous mucosa samples.

Table 1 describes the performance in the confirmatory sample set using bisulfite sequencing analysis of amplicons of select loci having strong performance characteristics and identified in the studies discussed above. In Table 1, columns C-S disclose the performance of the select amplicons. For each DNA sequence read across each amplicon, the number of CpGs that were methylated between the amplification primers was counted, and the read was classified as methylated or unmethyled using cutoffs for a required number of methylated CpGs on the amplicon. Table 1, row 3 lists the number of CpGs between the amplification primers for each of the amplicons. Table 1, row 4 lists the number of CpGs that need to be methylated on an individual read to count that read as methylated (e.g. for SqBE 2 there are 16 CpG residues between the primers, and 14+(meaning >14) CpGs must be methylated on a read to score it as methylated. Table 1, rows 6, 7, and 8 record the sensitivity for detecting esophageal adenocarcinomas (EACs) (row 6), high grade dysplasias (HGD) (row 7) and non-dysplastic Barrett's esophagus (non-dysplastic BE) (row 8), using criteria in which a sample was detected if it demonstrated methylation in greater than 10% (0.1) of all DNA reads. Table 1, row 9 records the specificity of each amplicon for not detecting normal squamous mucosa again using criteria in which a sample was detected if it demonstrated methylation in greater than 10% (0.1) of all DNA reads. Table 1, row 11 records the specificity of each amplicon for not detecting normal squamous mucosa now using criteria in which a sample was detected if it demonstrated methylation in greater than 1% (0.01) of all DNA reads. As a comparator, Table 1, column B provides the same data for detecting methylation in the Vimentin (VIM) locus amplified using primers disclosed in Li et al. (Li M, et al. (2009) Sensitive digital quantification of DNA methylation in clinical samples. Nat Biotechnol 27(9):858-863). These primers correspond to SEQ ID NOs: 8445-8446. The amplicon amplified using these primers is derived from the parental (−) strand and is as follows:

```
Vimentin amplicon (-) strand (SEQ ID NO: 16208):
GtTGtttAGGtTGTAGGTGYGGGTGGAYGTAGTtAYGTAGtTtYGGtTGG AGtTYGGtYGGtTYGYGGTGttYGGGtYGtYGAAtATttTGYGGTAGGAG

GAYGAG
```

The reverse complement of SEQ ID NO: 16208 is also generated.

The region of this amplicon lying between the amplification primers, in which methylation is analyzed, is as follows:

```
Vimentin amplicon (-) strand (SEQ ID NO: 16212):
GGAYGTAGTtAYGTAGtTtYGGtTGGAGtTYGGtYGGtTYGYGGTGttYG GGtYGtYGA
```

The reverse complement of SEQ ID NO:16212 is also generated and analyzed.

For reference, the bisulfite converted sequence that would be derived from amplifying the corresponding bisulfite converted region derived from the Vimentin (+) strand would be.

```
Vimentin amplicon (+) strand (SEQ ID NO: 16207):
tTYGTttTttTAtYGtAGGATGTTYGGYGGttYGGGtAtYGYGAGtYGGt YGAGtTttAGtYGGAGtTAYGTGAtTAYGTttAttYGtAttTAtAGttTG GGtAGt
```

Along with the reverse complement of SEQ ID NO:16207. And the corresponding portion of SEQ ID NO: 16211 that falls between the primers used to amplify the Vimentin (−) strand amplicon is:

```
Vimentin amplicon (+) strand (SEQ ID NO: 16211):
TYGGYGGttYGGGtAtYGYGAGtYGGtYGAGtTttAGtYGGAGtTAYGTG AtTAYGTtt
```

Along with reverse complement of SEQ ID NO: 16211.

Amplicons (and patches) need not be used individually, but can be combined into panels for detection of esophageal neoplasia. Examples of such panels, and their associated performance statistics, are provided in Table 1, columns T through AG that provide the markers in the panel and the sensitivity and specificity resulting from the marker combination (when the combination is positive if any member of the combination is positive).

The sensitivity for detection of EAC (100%), HGD (88%), and BE (100%) is the same among the combinations shown of: all amplicons, 17 amplicons, 15 amplicons, 4 amplicons, three of four combinations of 3 amplicons (columns Y, Z, AA), and for one combination of 2 amplicons (column AF). Specificity for not detecting normal squamous (97%), at a detection cutoff of 10% of reads being methylated, is the same for all combinations shown of: 15 amplicons, 4 amplicons, 3 amplicons, or 2 amplicons. When specificity is determined using a cutoff of 1% of reads being methylated, then among amplicons with the highest sensitivity, the highest specificity is 94%, demonstrated by the combination of 3 amplicons of Table 1, column Z, followed by 91% specificity demonstrated by combinations shown of: 4 amplicons, two combinations of three amplicons, and one combination of 2 amplicons

TABLE 1

| A | B | C | D | E | F | G | H | I | J |
|---|---|---|---|---|---|---|---|---|---|
|   | VIM | SqBE 2 | SqBE 5 | SqBE 7 | SqBE 9 | SqBE 10 | SqBE 11-1 | SqBE 11-2 | SqBE 13 |
| Number of CpGs in amplicon analysis | 10 | 16 | 15 | 27 | 31 | 10 | 17 | 10 | 19 |
| Number of CpGs used for methylation call | 5+ | 14+ | 8+ | 10+ | 16+ | 5+ | 8+ | 5+ | 10+ |

TABLE 1-continued

| Cut-off = 0.1 | | | | | | | | | |
|---|---|---|---|---|---|---|---|---|---|
| Sensitivity EAC | 70% | 74% | 100% | 40% | 65% | 96% | 4% | 87% | 38% |
| Sensitivity HGD | 63% | 50% | 100% | 57% | 50% | 75% | 0% | 63% | 33% |
| Sensitivity for non-dysplastic Barrets | 100% | 81% | 70% | 56% | 69% | 88% | 0% | 94% | 21% |
| Specificity Sq | 97% | 97% | 100% | 100% | 97% | 97% | 100% | 97% | 97% |
| Cut-off = 0.01 | | | | | | | | | |
| Specificity Sq | 91% | 94% | 100% | 100% | 94% | 94% | 91% | 91% | 93% |

| A | K<br>SqBE<br>14-2 | L<br>SqBE<br>15 | M<br>SqBE<br>16-1 | N<br>SqBE<br>16-2 | O<br>SqBE<br>17-1 | P<br>SqBE<br>18 | Q<br>SqBE<br>22-1 | R<br>SqBE<br>22-2 | S<br>SqBE<br>23 |
|---|---|---|---|---|---|---|---|---|---|
| Number of CpGs in amplicon analysis | 22 | 11 | 26 | 26 | 22 | 21 | 9 | 20 | 10 |
| Number of CpGs used for methylation call | 14+ | 5+ | 9+ | 8+ | 12+ | 9+ | 6+ | 11+ | 6+ |
| Cut-off = 0.1 | | | | | | | | | |
| Sensitivity EAC | 64% | 74% | 52% | 9% | 74% | 91% | 87% | 82% | 59% |
| Sensitivity HGD | 43% | 63% | 50% | 0% | 63% | 63% | 88% | 88% | 43% |
| Sensitivity for non-dysplastic Barrets | 56% | 100% | 44% | 13% | 100% | 81% | 100% | 88% | 63% |
| Specificity Sq | 97% | 94% | 97% | 100% | 97% | 97% | 97% | 97% | 97% |
| Cut-off = 0.01 | | | | | | | | | |
| Specificity Sq | 91% | 91% | 94% | 94% | 94% | 94% | 94% | 94% | 94% |

| A | T<br>All amplicon together, including VIM | U<br>All 17 SqBE amplicons: SqBE 2 SqBE 5 SqBE 7 SqBE 9 SqBE 10 SqBE 11-1 SqBE 11-2 SqBE 13 SqBE 14-2 SqBE 15 SqBE 16-1 SqBE 16-2 SqBE 17-1 SqBE 18 SqBE 22-1 SqBE 22-2 SqBE 23 | V<br>15 SqBE amplicons: SqBE 5 SqBE 7 SqBE 9 SqBE 10 SqBE 11-1 SqBE 11-2 SqBE 13 SqBE 14-2 SqBE 16-1 SqBE 16-2 SqBE 17-1 SqBE 18 SqBE 22-1 SqBE 22-2 SqBE 23 | W<br>4 best amplicons with highest EAC calls (SqBE 10 SqBE 11-2 SqBE 18 SqBE 22-1) perform as well as 16 amplicons | X<br>trio1 (SqBE 10 SqBE 11-2 SqBE 18) | Y<br>trio2 (SqBE 10 SqBE 11-2 SqBE 22-1) | Z<br>trio3 (SqBE 10 SqBE 18 SqBE 22-1) |
|---|---|---|---|---|---|---|---|
| Number of CpGs in amplicon analysis | | | | | | | |
| Number of CpGs used for methylation call | | | | | | | |
| Cut-off = 0.1 | | | | | | | |
| Sensitivity EAC | 100% | 100% | 100% | 100% | 100% | 100% | 100% |
| Sensitivity HGD | 88% | 88% | 88% | 88% | 75% | 88% | 88% |
| Sensitivity for non-dysplastic Barrets | 100% | 100% | 100% | 100% | 100% | 100% | 100% |
| Specificity Sq | 91% | 91% | 97% | 97% | 97% | 97% | 97% |
| Cut-off = 0.01 | | | | | | | |
| Specificity Sq | 82% | 85% | 85% | 91% | 91% | 91% | 94% |

| A | AA<br>trio4<br>(SqBE 11-2<br>SqBE 18<br>SqBE 22-1) | AB<br>double1<br>(SqBE 10<br>SqBE 11-2) | AC<br>double2<br>(SqBE 10<br>SqBE 18) | AD<br>double3<br>(SqBE 11-2<br>SqBE 18) | AE<br>double4<br>(SqBE 10<br>SqBE 22-1) | AF<br>double5<br>(SqBE 11-2<br>SqBE 22-1) | AG<br>double6<br>(SqBE 18<br>SqBE 22-1) |
|---|---|---|---|---|---|---|---|
| Number of CpGs in amplicon analysis | | | | | | | |
| Number of CpGs used for methylation call | | | | | | | |
| Cut-off = 0.1 | | | | | | | |
| Sensitivity EAC | 100% | 100% | 100% | 100% | 96% | 100% | 96% |
| Sensitivity HGD | 88% | 75% | 75% | 63% | 88% | 88% | 88% |
| Sensitivity for non-dysplastic Barrets | 100% | 100% | 94% | 100% | 100% | 100% | 100% |

TABLE 1-continued

| | | | | | | | |
|---|---|---|---|---|---|---|---|
| Specificity Sq Cut-off = 0.01 | 97% | 97% | 97% | 97% | 97% | 97% | 97% |
| Specificity Sq | 91% | 91% | 94% | 91% | 94% | 91% | 94% |

Confirmatory analysis of candidate loci was further done using bisulfite sequencing of candidate loci that were amplified using the bisulfite specific but methylation independent amplification primers described above. This employed a new sample set of esophageal brushings obtained using a cytology brush under endoscopic guidance that were obtained first from 59 control subjects with or without symptomatic gastroesophageal reflux disease (GERD), but all without Barrett's esophagus (BE). These controls included persons with normal endoscopic findings or with erosive esophagitis. In these controls brushings were obtained from the gastroesophageal junction to sample the glandular mucosa, and brushings were also obtained from squamous esophagus mucosa. Brushing were also obtained from esophageal lesions of 107 cases that included 60 individuals with cancers, either adenocarcinoma of the esophagus (EAC)(N=46) or adenocarcinoma of the gastroesophageal junction (JCA) (N=14), and included 47 individuals with BE. Of BE cases, 12 had non-dysplastic short-segment BE (SSBE, <3 cm), 17 had nondysplastic long segment BE (LSBE≥3 cm), 8 had low-grade dysplasia (LGD), and 10 had high-grade dysplasia (HGD).

Table 1.5 Columns B-F disclose the performance of individual amplicons of select loci having strong performance characteristics and identified in the studies discussed above in the esophageal brushings sample set analyzed using bisulfite sequencing performed on a Next Generation DNA sequencing instrument (an Illumina MiSeq instrument). Table 1.5, row 3 lists the number of CpGs between the amplification primers for each of the amplicons. Table 1.5, row 4, provides the coordinates in hg19 of the genomic interval that covers the the CpGs that lie between the primers (and that may include several non CpG bases within the primers).

Table 1.5, row 5 lists the number of CpGs lying between the primers that were required to be methylated on an individual DNA read to count that read as methylated (e.g. for VIM there are 10 CpG residues between the primers, and 8+ (meaning >=8) CpGs were required to be methylated on a read to score the read as methylated). Table 1.5 row 6 lists the minimum percent of methylated reads (cut-off) identified by bisulfite sequencing that were required in order to score a sample as methylated and thus detected (e.g. for VIM>=0.0102 fraction of total reads were required to be methylated). Table 1.5 rows 7, 8, 9, 10 and 11 record the sensitivity of each amplicon for detecting: esophageal adenocarcinomas (EACs) (row 7), adenocarcinomas of the gastroesophageal junction (JCAs) (row 8), low grade dysplasias (LGD) (row 9), high grade dysplasias (HGD) (row 10), and non-dysplastic Barrett's esophagus (non-dysplastic BE) (row 11), using criteria in which a sample was detected if it demonstrated methylation at greater than the cut-off value of row 5. Table 1.5 row 12 records the specificity of each amplicon for not detecting normal squamous esophagus mucosa (normal Sq) and row 13 records the specificity of each amplicon for not detecting normal gastroesophageal junction (GEJ).

In Table 1.5, column B provides data for detecting methylation in the Vimentin (VIM) locus amplified using primers disclosed in Li et al. (Li M, et al. (2009) Sensitive digital quantification of DNA methylation in clinical samples. Nat Biotechnol 27(9):858-863). These primers are:

```
Forward Primer:
                                    (SEQ ID 16209)
CTCRTCCTCCTACCRCAAAATATTC
and Reverse Primer:
                                    (SEQ ID 16210)
GTTGTTTAGGTTGTAGGTGYGGG
```

(In these notations R denotes alternative sequences that may have either an A or G base, and Y denotes alternative sequences that may have either a C or T base).
The amplicon amplified using these primers is derived from the parental (−) strand and is as follows:

```
Vimentin amplicon (-) strand (SEQ ID NO: 16208):
GtTGtttAGGtTGTAGGTGYGGGTGGAYGTAGTtAYGTAGtTtYGGtTGG AGtTYGGtYGGtTYGYGGTGttYGGGtYGtYGAAtATttTGYGGTAGGAG

GAYGAG
```

The reverse complement of SEQ ID NO: 16208 is also generated.
The region of this amplicon lying between the amplification primers, in which methylation is analysed, is as follows:

```
Vimentin amplicon (-) strand (SEQ ID NO: 16212):
GGAYGTAGTtAYGTAGtTtYGGtTGGAGtTYGGtYGGtTYGYGGTGttYGG GGtYGtYGA
```

The reverse complement of SEQ ID NO: 16212 is also generated and analyzed.
For reference, the bisulfite converted sequence that would be derived from amplifying the corresponding bisulfite converted region derived from the Vimentin (+) strand would be.

```
Vimentin amplicon (+) strand (SEQ ID NO: 16207):
tTYGTttTttTAtYGtAGGATGTTYGGYGGttYGGGtAtYGYGAGtYGGtY GAGtTttAGtYGGAGtTAYGTGAtTAYGTttAttYGtAttTAtAGttTGGG tAGt
```

Along with the reverse complement of SEQ ID NO: 16207. And the corresponding portion of SEQ ID NO: 16211 that falls between the primers used to amplify the Vimentin (−) strand amplicon is:

```
Vimentin amplicon (+) strand (SEQ ID NO: 16211):
TYGGYGGttYGGGtAtYGYGAGtYGGtYGAGtTttAGtYGGAGtTAYGTGA tTAYGTtt
```

Along with reverse complement of SEQ ID NO: 16211.
DNA sequencing reads from each sample were aligned to bisulfite converted and unconverted versions of the human reference genome (hg18) using Bowtie2, and the aligned reads were classified as methylated if they had 8 or more CpG dinucleotides methylated (out of total of 10 CpGs present between the primers in the VIM Bisulfite-seq PCR fragment). These analyses were facilitated by the Bismark software, developed for processing bisulfite-sequencing data.

A sample was considered methylated for VIM if the methylated vimentin allele frequency was greater than 1.02%, i.e. if more than 1.02% of the sequence reads were classified as methylated (a cut-off that maximized the sum of sensitivity plus specificity on the receiver operating curve of all the samples studied). Alternative cutoffs in the range of 0.5-3.0% are also possible. The performance of VIM methylation in detecting esophageal lesions is shown in rows 3-12. Overall, at the cutoff of 1.02% methylation, VIM Examples of such panels, and their associated performance statistics, are provided in Table 1.5, columns G through L, that specify the markers in the panel and the sensitivity and specificity resulting from the marker combination (when the combination is scored positive if any member of the combination is positive). In these marker combinations, each individual member of the panel is analysed using the conditions specified for that marker individually in rows 4 and 5 of columns B-F. The marker combination of methylation in amplicons of VIM or of SqBE18 is of particular interest, as the combination of these two markers show detection of 96% of esophageal adenocarcinomas, 93% of carcinomas of the gastroesophageal junction, 100% of high grade dysplasias, 100% of low grade dysplasias, and 94% of non-dysplastic long segment Barrett's esophagus, while preserving a specificity of 91% for normal gastroesophageal junction.

TABLE 1.5

| A | B VIM | C SqBE 5 | D SqBE 16-1 | E SqBE 18 | F VIM + SqBE 5 | F VIM + SqBE 16-1 | F VIM + SqBE 18 | I SqBE 5 + SqBE 16-1 | J SqBE 5 + SqBE 18 | K SqBE 16-1 + SqBE 18 | L SqBE 5 + SqBE 16-1 + SqBE 18 |
|---|---|---|---|---|---|---|---|---|---|---|---|
| Number of CpGs in amplicon analysis | 10 | 15 | 26 | 21 | | | | | | | |
| hg19 Interval covering CpGs in the amplicon analysis | chr10: 17271466-17271524 | chr5: 1,883,203-1,883,380 | chr11: 110,582,495-110,582,696 | chr13: 37,005,877-37,006,009 | | | | | | | |
| Number of CpGs used for methylation call | 8+ | 13+ | 15+ | 16+ | | | | | | | |
| Cut-off = | 0.0105 | 0.0046 | 0.0106 | 0.0312 | | | | | | | |
| Sensitivity EAC | 89% | 86% | 80% | 96% | 96% | 89% | 96% | 90% | 98% | 96% | 98% |
| Sensitivity JCA | 79% | 57% | 50% | 86% | 79% | 79% | 93% | 64% | 86% | 93% | 93% |
| Sensitivity LGD | 88% | 63% | 75% | 86% | 88% | 88% | 100% | 75% | 86% | 86% | 86% |
| Sensitivity HGD | 100% | 78% | 80% | 100% | 100% | 100% | 100% | 89% | 100% | 100% | 100% |
| Sensitivity for non-dysplastic Barrets | 94% | 89% | 67% | 78% | 100% | 94% | 94% | 100% | 100% | 78% | 100% |
| Specificity Normal Sq | 87% | 97% | 93% | 98% | 83% | 83% | 87% | 93% | 95% | 92% | 92% |
| Specificity Normal GEJ | 93% | 93% | 97% | 98% | 86% | 89% | 91% | 92% | 93% | 97% | 90% | methylation showed sensitivity of 90.7% for identifying BE or esophageal neoplasia and showed specificity for rejecting normal gastroesophageal junction of 93%. When the cutoff for VIM methylation is varied from 0-100%, and sensitivity is plotted versus (100—specificity) (a receiver operating curve), the area under the curve for the VIM assay=0.949.

In this same sample set, we compared assay of VIM methylation by next generation bisulfite sequencing and the analysis algorithm above (in which >=8 methylated CpG is required to score a read as methylated and >1% of methylated reads defines a cutoff of scoring a sample as methylated and detected) versus performing assay of VIM methylation by quantitative methylated specific PCR (qMSP) (as described in Moinova et al. Cancer Epidemiol Biomarkers Prev. 2012; 21(4):594-600.). The bisulfite sequencing method showed superiority with both better sensitivity and better specificity. In particular, area under the receiver operating curve for the qMSP assay=0.925, and at the optimal cutoff of 2.2% VIM methylation measured by qMSP (as defined by the receiver operating curve), assay sensitivity was 82.9% and assay specificity was 91.3%, which are all inferior to the results obtained with the next generation bisulfite sequencing assay and the analysis algorithm laid out in Table 1.5.

Amplicons need not be used individually, but can be combined into panels for detection of esophageal neoplasia.

Figure 1B:
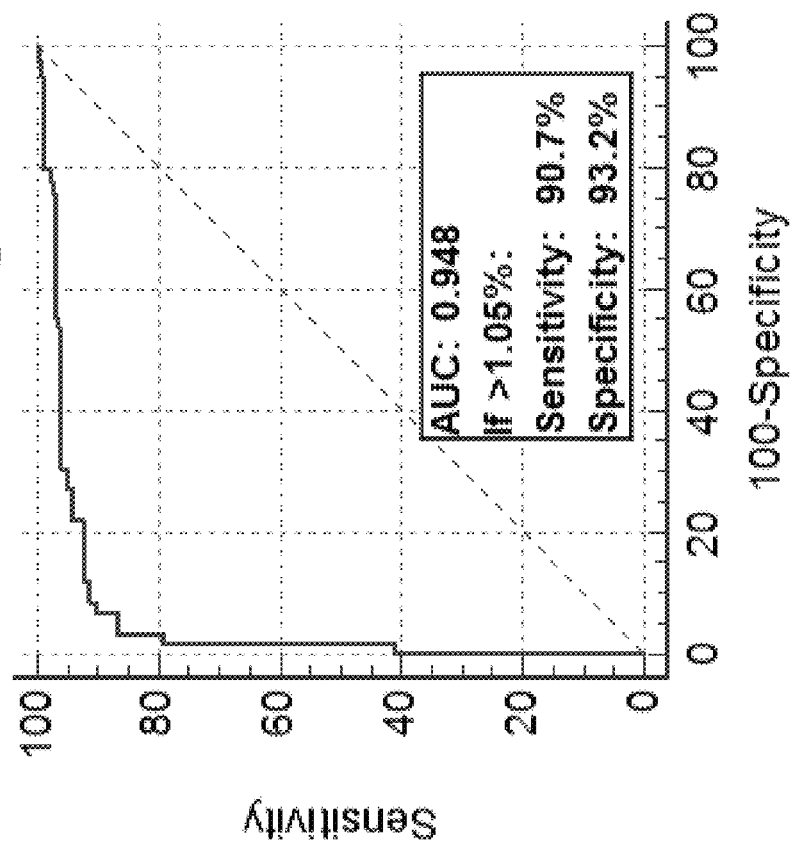
Figure 1C:
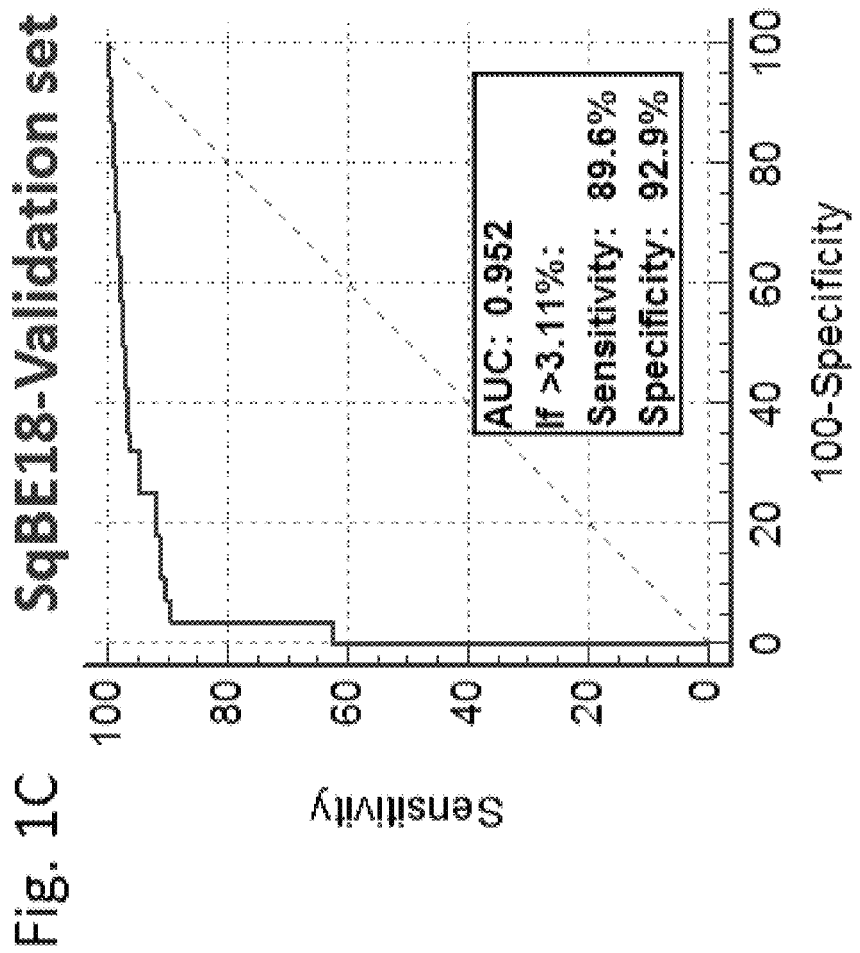
Figure 1D:
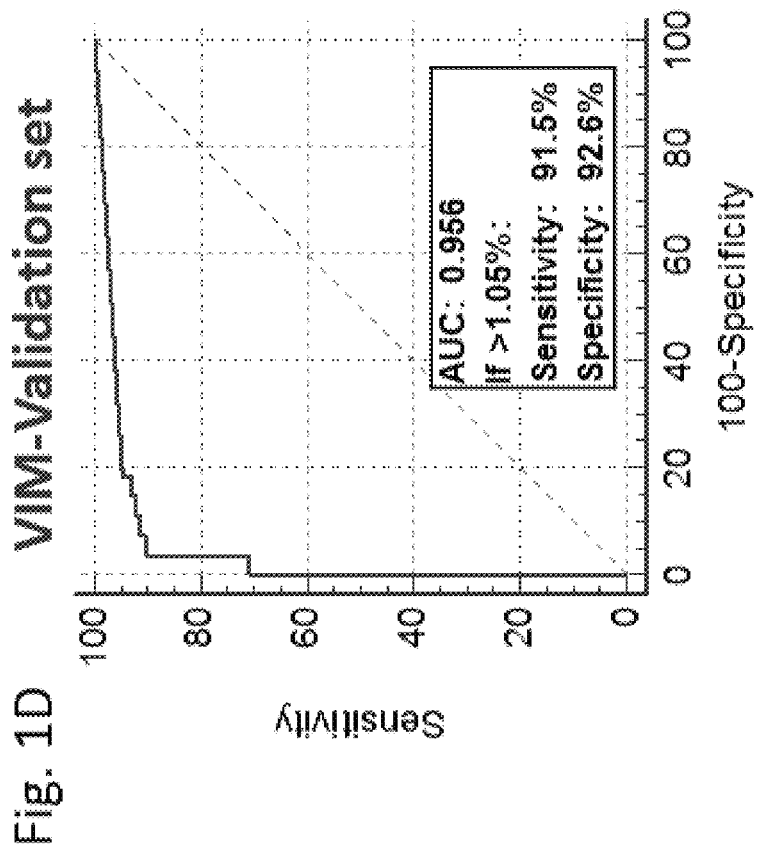
Figure 2B:
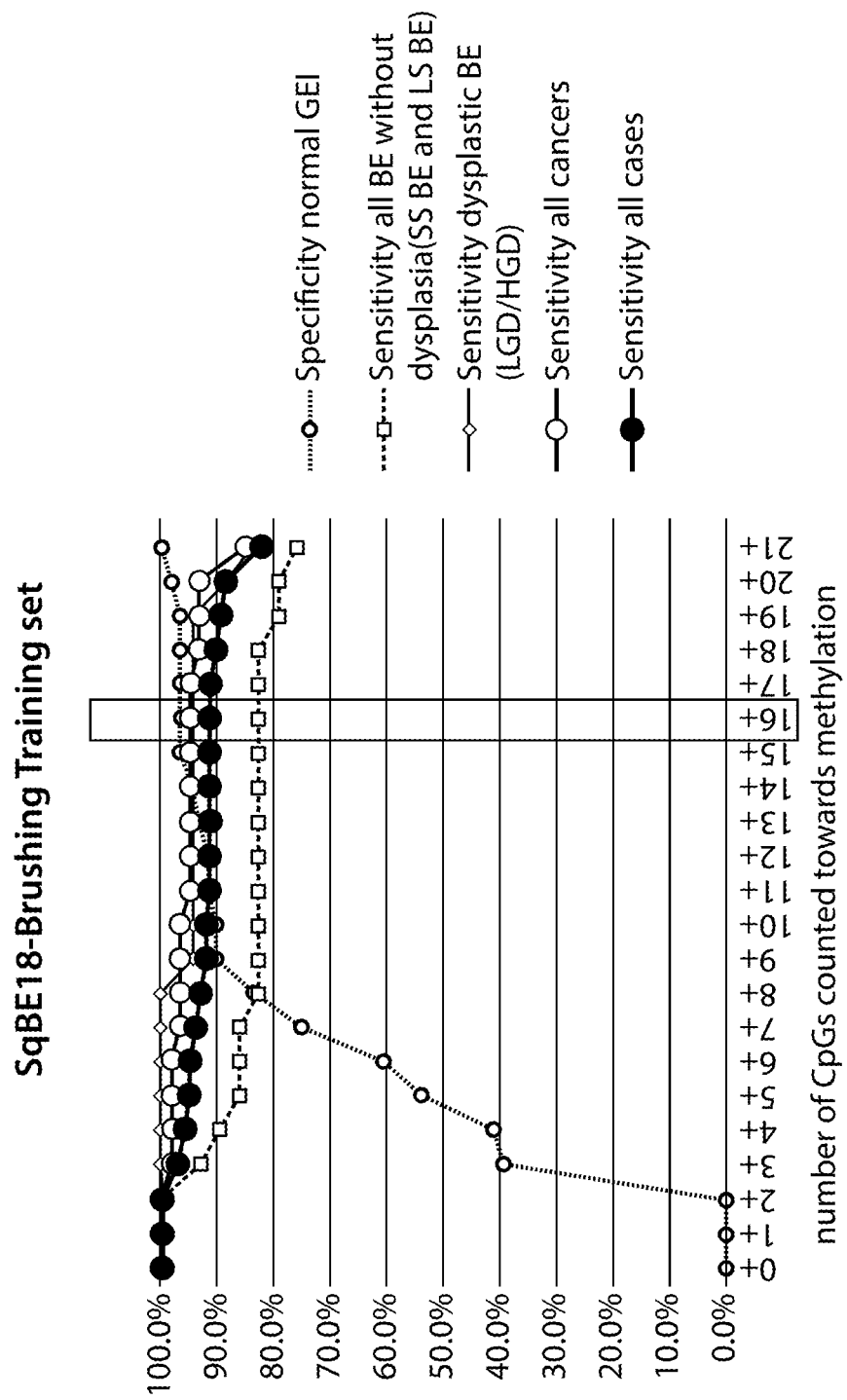

The marker combination of methylation in amplicons of VIM or of SqBE18 was further assessed in esophageal cytology brushings of normal-appearing gastroesophageal junction (GEJ) or of endoscopically visualized BE or EAC. In these experiments, the same vimentin amplicons described above were used and contained 10 CpGs. Vimentin specificity for Normal GEJ samples increases with the requirement that more CpGs in the read should be unmethylated, in order for the sample to be called "unmethylated." Conversely, Vimentin Sensitivity for BE/Cancer decreases with the requirement that more CpGs in the read are required to be called "methylated." The 8+ CpG cutoff (blue box in FIG. 2A), maximizes the sum of specificity for controls and sensitivity for cases. As such, a VIM read was considered methylated if any 8 CpGs out of 10 were methylated. The output for each sample was the fraction of methylated reads in the total number of reads for each sample. These values were then used to generate the Receiver Operating Characteristic (ROC) curve. See FIGS. 1B and 1D that respectively describe training and validation sets of esophageal brushings samples.

The SqBE18 amplicon used on the same samples described in the paragraph above contained 21 CpGs. These amplicons were generated as described above, and were obtained by amplifying bisulfite converted DNA with PCR primers having the nucleotide sequence of SEQ ID Nos:

8388 and 8402 to derive amplicon sequences having the nucleotide sequence of SEQ ID NO: 8318. SqBE18 specificity for Normal GEJ samples increases with the requirement that more CpGs in the read should be unmethylated, in order for the sample to be called "unmethylated." Conversely, SqBE18 Sensitivity for BE/Cancer decreases with the requirement that more CpGs in the read are required to be called "methylated." The 15+, 16+, and 17+ CpG cutoffs offer identical maximum sensitivity+specificity sum for SqBE18. 16+ CpGs (blue box of FIG. 2B), was chosen as the middle of this range. As such, a read was considered methylated for the SqBE18 amplicon if any 16 CpGs out of 21 were methylated. The output for each sample was the fraction of methylated reads in the total number of reads for each sample. These values were then used to generate the ROC curve. See FIGS. 1A and 1C.

Due to the patchy nature of methylation, normal samples can contain a few random methylated CpGs, while, conversely, the methylated DNA could contain some unmethylated CpGs. Different CpG islands have different methylation density, and as a result, a cutoff was established for each region that would optimally differentiate methylated and unmethylated DNA. In this study, if greater than 1.05% of VIM reads were methylated, this sample was considered "positive" for VIM methylation, and if greater than 3.11% of SqBE18 reads were methylated, this sample was considered "positive" for VIM methylation.

Vimentin and SqBE18 gene methylation (mVIM and mSqBE18) was assayed in DNA samples from either a training set or a validation set of cytology brushings of the distal esophagus. Both the training and validation sets of brushings of the distal esophagus were from: Unaffected controls (individuals with GERD, erosive esophagitis, or no pathology detected during endoscopy—each brushed at the GE Junction); SSBE (short-segment Barrett's Esophagus (1 to 3 cm)); LSBE (Barrett's Esophagus (3 cm or more); LGD (Barret's Esophagus with Low-Grade Dysplasia); HGD (Barrett's Esophagus with High-Grade Dysplasia); Cancer—includes EAC (Esophageal adenocarcinoma) and JCA (Junctional cancer of the esophagus). In the case of the training sets, samples were scored as methylated when the mVIM methylated allele frequency was measured as >1.05%, and mSqBE18 methylated allele frequency was measured as >3.11% by bisulfite sequencing (representing the ROC cutpoints that provide optimal performance for each of these assays, respectively). In the case of the validation sets, samples were scored as methylated when the mVIM methylated allele frequency was measured as >1.05%, and mSqBE18 methylated allele frequency was measured as >3.11% by bisulfite sequencing (representing the ROC cutpoints from the training set of brushings for each of these assays, respectively). For the combination of the two markers, the calculations were performed in two ways:
  One-marker fails censored: if either mVIM or mSqBE18 sequencing failed, the sample was excluded from analysis
  One-marker fails allowed: if one marker failed, the sample was still included in the analysis and scored as positive or negative based on the performance of the one working marker.
The data from the training set analyses are summarized in FIG. 3, and the data from the validation set analyses are summarized in FIG. 4.

All the samples from the training and validation sets of brushings described in the paragraph above were combined and then scored as methylated when the mVIM methylated allele frequency was measured as >1.05%, and mSqBE18 methylated allele frequency was measured as >3.11% by bisulfite sequencing (representing the ROC cutpoints from the training set of brushings for each of these assays, respectively). For the combination of the two markers, the calculations were performed as follows:
  Controls—One-marker fails censored: if either mVIM or mSqBE18 sequencing failed, the sample was excluded from analysis. This underscores the specificity of the assay.
  Cases—One-marker fails allowed: if one marker failed, the sample was still included in the analysis and scored as positive or negative based on the performance of the one working marker. This underscores the sensitivity of the assay.
For controls: if one marker failed, the sample was censored in order not to overestimate the specificity. For cases: if one marker failed, and the other marker worked, the sample was still counted. The results of these analyses are provided in FIG. 5.

Figure 6B:
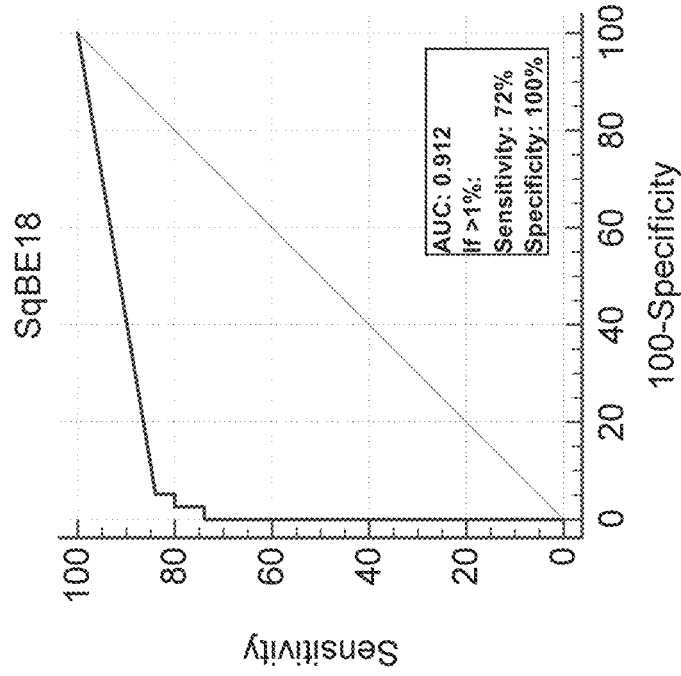
FIGS. 6A and 6B show Receiver Operating Characteristic (ROC) curves of methylated VIM assayed on esophageal balloon samplings of the distal esophagus.
Figure 6A:
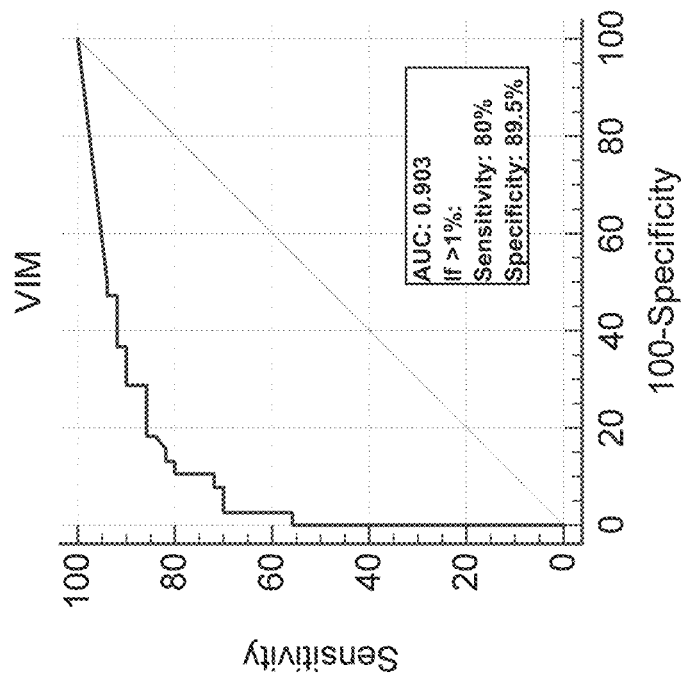

Esophageal balloon samplings of the distal esophagus were assayed for VIM methylation and ROC curves were obtained. FIG. 6A shows a ROC curve based on next-generation bisulfite sequencing assay for VIM in the training set of 38 controls and 50 cases. Similar to the experiments described above, the vimentin amplicon that was used contained 10 CpGs, and a read was considered methylated, if any 8 CpGs out of 10 are methylated (based on the analysis of data in slide 3). The output for each sample was the fraction of methylated reads in the total number of reads for each sample. These values were then used to generate the ROC curve. Optimal ROC cutpoint for mVIM assay on balloons was between 0.95% and 1.16%, and 1% was chosen as a convenient number in the middle of this range. The actual cutoff picked by MedCalc for VIM balloons was 0.95%.

Esophageal balloon samplings of the distal esophagus were also assayed for SqBE18 methylation and ROC curves were obtained. FIG. 6B shows a ROC curve based on next-generation bisulfite sequencing SqBE18 assay in the training set of 38 controls and 50 cases. Similar to the experiments described above, the SqBE18 amplicon that was used contained 21 CpGs, and a read was considered methylated if any 16 CpGs out of 21 were methylated. The output for each sample was the fraction of methylated reads in the total number of reads for each sample. These values were then used to generate the ROC curve. Optimal ROC cutpoint for SqBE18 assay on balloons was between 0.1%, based on maximizing the sum of sensitivity and specificity. However, a higher cutpoint was chosen to maintain higher specificity of the assay. Any cutpoint between 0.76% and 1.06%, would give the same value of sensitivity and specificity. 1% was chosen as the convenient number in the middle of this range. The actual cutoff picked by MedCalc for SqBE18 balloons was 0.1%. However, 1% was chosen as the cutoff to maximize specificity. Any number between 0.76% and 1.06% would have worked the same as 1%. If >0.1%, then the sensitivity: 84.0%, and the specificity: 94.7%.

Vimentin and SqBE18 gene methylation (mVIM and mSqBE18) was assayed in esophageal balloon DNA samples of the distal esophagus from: Unaffected controls (individuals with GERD, erosive esophagitis, or no pathology detected during endoscopy; SSBE (short-segment Barrett's Esophagus (1 cm to less than 3 cm)); LSBE (Barrett's Esophagus (3 cm or more); LGD (Barret's Esophagus with Low-Grade Dysplasia); HGD (Barrett's Esophagus with High-Grade Dysplasia); Cancer—includes EAC (Esophageal adenocarcinoma) and JCA (Junctional cancer of the esophagus). Samples were scored as methylated when the mVIM and SqBE18 methylated allele frequency was measured as >1%, based on balloon ROC curves described in the preceding two paragraphs. The results from these analyses are provided in FIG. 7.

Example 2: Identification of Esophageal Cancer Informative Loci to Detect Progression of Esophageal Neoplasia Discovery data were also analyzed for each individual CpG residue in the RRBS data set to identify loci that could be used to distinguish EAC from BE. Individual CpGs were considered methylated in EAC versus BE if they showed methylation of less than 10% of reads of all informative BE samples, where at least 3 BE samples were informative, and if they showed methylation of less than 10% of reads of all informative normal squamous samples, and where an informative sample had equal to or greater than 20 reads covering the CpG, and if 6 or more of the EAC samples demonstrated percent methylation at a level that was at least 20 percentage points greater than the methylation level of the most methylated BE sample. CpGs meeting criteria for methylation in EAC versus and BE are defined as methylated in EAC vs BE. Such methylated CpGs were then aggregated into patches in instances in which methylated CpGs were within 200 bp one another.

186 genomic patches defined as methylated in EACs versus BE in the discovery set were identified (see SEQ ID NOs: 8447-8818). The genomic coordinates of the genomic patches defined as methylated by the above criteria were also recorded. The genomic sequences of these patches on the respective genomic (+) and (−) strands were determined and recorded. (Upper and lower case designations were used according to those of the UCSC browser, where lower case sequences are lower complexity DNA sequences). The bisulfite converted sequences of these corresponding patches (i.e. the bisulfite converted sequence of the (+) strand and the bisulfite converted sequence of the (−) strand) were determined and recorded (see sequences of SEQ ID NOs: 8819-9004 and 9191-9376 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding patches (i.e. in which all Y bases in every bisulfite converted sequence are retained as a C), corresponding to the (+) strand the (−) strand were determined and recorded (see sequences of SEQ ID NOs: 9005-9190 and 9377-9562 for the bisulfite converted sequences of the fully methylated form of the (+) and (−) strands respectively of the corresponding patches). The reverse complements of the bisulfite converted methylated (+) stand and (−) stand sequences will be obvious to one of ordinary skill in the art and are also included by implication in this disclosure.

Patches were expanded by 100 base pairs on either side so as to accommodate either the design of amplification primers or to exclude additional presumptively methylated bases. The sequences of these expanded patches correspond to SEQ ID NOs: 9563-9934 and their genomic coordinates were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding expanded patches (i.e. the bisulfite converted sequence of the (+) strand and the bisulfite converted sequence of the (−) strand) were determined and recorded (see sequences of SEQ ID NOs: 9935-10120 and 10307-10492 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding expanded patches (i.e. in which all Y bases in every bisulfite converted sequence are retained as a C), corresponding to the (+) strand the (−) strand were determined and recorded (see sequences of SEQ ID NOs: 10121-10306 and 10493-10678 for the bisulfite converted sequences of the fully methylated form of the (+) and (−) strands respectively of the corresponding expanded patches). The reverse complements of the bisulfite converted methylated (+) stand and (−) stand sequences will be obvious to one of ordinary skill in the art and are also included by implication in this disclosure.

CpG islands overlapping patches that may contain additional CpGs that are methylated coordinately with patches were also defined. The sequences of these CpG islands correspond to SEQ ID NOs: 10679-10972. The genomic coordinates of the CpG islands were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding CpG islands (i.e. the bisulfite converted sequence of the (+) strand and the bisulfite converted sequence of the (−) strand) were determined and recorded (see sequences of SEQ ID NOs: 10973-11119 and 11267-11413 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding CpG islands (i.e. in which all Y bases in every bisulfite converted sequence are retained as a C), corresponding to the (+) strand the (−) strand were determined and recorded (see sequences of SEQ ID NOs: 11120-11266 and 11414-11266 for the bisulfite converted sequences of the fully methylated form of the (+) and (−) strands respectively of the corresponding CpG islands). The reverse complements of the bisulfite converted methylated (+) stand and (−) stand sequences will be obvious to one of ordinary skill in the art and are also included by implication in this disclosure.

Regions of Interest (ROI) were defined that provided preferred regions for design of PCR amplicons that would encompass preferred patches. The genomic coordinates of the ROI were also recorded. The sequences of the (+) strands of the Regions of Interest correspond to SEQ ID NOs: 12563-12568, and the sequences of the (−) strands Regions of Interest correspond to SEQ ID NOs: 12581-12586. (Upper and lower case designations were used according to those of the UCSC browser, where lower case sequences are lower complexity DNA sequences). The bisulfite converted sequences of these corresponding Regions of Interest (i.e. the bisulfite converted sequence of the (+) strand and the bisulfite converted sequence of the (−) strand) were determined and recorded (see sequences of SEQ ID NOs: 12569-12574 and 12587-12592 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Regions of Interest (i.e. in which all Y bases in every bisulfite converted sequence are retained as a C), corresponding to the (+) strand the (−) strand were determined and recorded (see sequences of SEQ ID NOs: 12575-12580 and 12593-12598 for the bisulfite converted sequences of the fully methylated form of the (+) and (−) strands respectively of the corresponding Regions of Interest). The reverse complements of the bisulfite converted methylated (+) stand and (−) stand sequences will be obvious to one of ordinary skill in the art and are also included by implication in this disclosure.

Specific PCR Amplicons were defined within the Regions of Interest (ROI). The genomic coordinates of the Amplicons were recorded. The sequences of the (+) strands of the Amplicons correspond to SEQ ID NOs: 12599-12604 and 12647-12649, and the sequences of the (−) strands of the Amplicons correspond to SEQ ID NOs: 12617-12622 and 12656-12658. (Upper and lower case designations were used according to those of the UCSC browser, where lower case sequences are lower complexity DNA sequences). The bisulfite converted sequences of these Amplicons (i.e. the bisulfite converted sequence of the (+) strand and the bisulfite converted sequence of the (−) strand) were determined and recorded (see sequences of SEQ ID NOs: 12605-12610 and 12650-12652 for the bisulfite converted sequences of the (+) strands and see sequences of SEQ ID NOs: 12623-12628 and 12659-12661 and for the bisulfite converted sequences of the (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Amplicons (i.e. in which all Y bases in every bisulfite converted sequence are retained as a C), corresponding to the (+) strand the (−) strand were determined and recorded (see sequences of SEQ ID NOs: 12611-12616 and 12653-12655 for the bisulfite converted sequences of the fully methylated form of the (+) strands and see sequences of SEQ ID NOs: 12629-12634 and 12662-12664 for the bisulfite converted sequences of the fully methylated form of the (−) strands). The reverse complements of the bisulfite converted methylated (+) stand and (−) stand sequences will be obvious to one of ordinary skill in the art and are also included by implication in this disclosure. Sequences of PCR primers used in amplification of the Amplicons are provided as SEQ ID NOs: 12635-12646 and 12665-12670.

Confirmatory analysis of candidate loci was then done using bisulfite sequencing of candidate loci that were amplified using bisulfite specific but methylation independent amplification primers. This employed a new sample set of biopsies from: 23 EACs, 8 HGD, 15 non-dysplastic BE from individuals without known higher grade lesions. In addition, biopsies were obtained from 5 cases of BE adjacent to HGD, and from 11 cases of BE adjacent to an EAC. These are not included in analyses of non-dysplastic BE. In addition biopsies were obtained from 33 normal squamous mucosa samples.

Table 2 describes the performance in the confirmatory sample set using bisulfite sequencing analysis of amplicons from select loci defined as methylated in EACs versus BE and having preferred marker characteristics. In Table 2, Columns B-J disclose the performance of the amplicons in the confirmatory data set. In this data set, methylation was calculated as the average level of methylation of all CpGs in between the primers for amplifying the amplicon. For each read across each amplicon the number of CpGs that were methylated was counted and the read was classified as methylated or unmethyled using cutoffs for a required number of methylated CpGs on the amplicon. Table 2, row 3 lists the number of CpGs between the amplification primers for each of the amplicons. Table 2, row 4 lists the number of CpGs that need to be methylated on an individual read to count that read as methylated (e.g. for Up3 there are 36 CpG residues between the primers, and 25+ (meaning >=25) CpGs must be methylated on a read to score it as methylated). Table 2, rows 6 and 7 record the sensitivity for detecting EACs (row 6) and HGD (row 7) using criteria in which a sample was detected if it demonstrated methylation in greater than 10% (0.1) of all DNA reads. Table 2, rows 8 and 9 record the specificity of each amplicon for not detecting non-dysplastic BE (row 8) and for not detecting normal squamous mucosa (row 9) again using criteria in which a sample was detected if it demonstrated methylation in greater than 10% (0.1) of all DNA reads. Table 2, rows 11 and 12 record the specificity of each amplicon for not detecting non-dysplastic BE (row 11) and for not detecting normal squamous mucosa (row 12) using criteria in which a sample was detected if it demonstrated methylation in greater than 1% (0.01) of all DNA reads. Amplicons (and patches) need not be used individually, but can be combined into panels for detection of esophageal neoplasia. Performance statistics of selected panels of amplicons are provided in Table 2 columns K through V that provides the sensitivity and specificity of the panels (when the combination is positive if any member of the combination is positive).

TABLE 2A

| Cut-off = 0.01 | | | | | | | | Cut-off = 0.1 | |
|---|---|---|---|---|---|---|---|---|---|
| Specificity Sq | Specificity for non-dysplastic BE | Sensitivity HGD | Sensitivity EAC | Number of CpGs used for methylation call | Number of CpGs in amplicon analysis | | A | Specificity Sq | Specificity for non-dysplastic BE |
| 100% | 100% | 0% | 15% | 25+ | 36 | Up3 | B | 100% | 100% |
| 100% | 100% | 25% | 40% | 17+ | 30 | Up10 | C | 88% | 100% |
| 100% | 100% | 13% | 22% | 15+ | 25 | Up15_ampl1 | D | 100% | 100% |
| 97% | 94% | 0% | 26% | 15+ | 26 | Up15_ampl2 | E | 91% | 94% |
| 100% | 100% | 33% | 37% | 11+ | 21 | Up20_ampl1 | F | 90% | 94% |
| 100% | 100% | 0% | 0% | 6+ | 16 | Up20_ampl2 | G | 100% | 100% |
| 97% | 100% | 17% | 20% | 11+ | 21 | Up27 | H | 93% | 100% |
| 100% | 100% | 17% | 45% | 14+ | 26 | Up35_ampl1 | I | 100% | 100% |
| 100% | 100% | 25% | 30% | 10+ | 18 | Up35_ampl2 | J | 100% | 100% |

TABLE 2B

| Specificity Sq | Specificity for non-dysplastic BE | Sensitivity HGD | Sensitivity EAC | Cut-off = 0.1 | Number of CpGs used for methylation call | Number of CpGs in amplicon analysis | A | |
|---|---|---|---|---|---|---|---|---|
| 94% | 94% | 50% | 65% | | | | All amplicons together: Up3, Up10, Up15-1, Up15-2, Up20-1, Up20-2, Up27, Up35-1, Up35-2 | K |
| 94% | 94% | 38% | 65% | | | | 6 core amplicon: Up3, Up15-1, Up15-2, Up20-1, Up27, Up35-1_ | L |
| 94% | 94% | 50% | 65% | | | | 7 amplicon combo 1: up10 and Up3, Up15-1, Up15-2, Up20-1, Up27, Up35-1 | M |
| 94% | 94% | 50% | 65% | | | | 7 amplicon combo 2: Up35-2 and Up3, Up15-1, Up15-2, Up20-1, Up27, Up35-1 | N |
| 100% | 100% | 25% | 52% | | | | 2 amplicon combo: Up15-1, Up35-1 | O |
| 100% | 100% | 38% | 57% | | | | 3 mplicon combo 1 Up15-1, Up35-1, Up10 | P |
| 100% | 100% | 38% | 57% | | | | 3 amplicon combo 2: Up15-1, Up35-1, Up20-1 | Q |
| 97% | 94% | 38% | 61% | | | | 4 amplicon combo 1: Up15-1, Up35-1, Up10, Up15-2 | R |
| 97% | 100% | 38% | 61% | | | | 4 amplicon combo 2: Up15-1, Up35-1, Up10, Up27 | S |
| 97% | 94% | 38% | 61% | | | | 4 amplicon combo 3: Up15-1, Up35-1, Up15-2, Up20-1 | T |
| 94% | 94% | 25% | 61% | | | | 4 amplicon combo 4: Up15-1, Up35-1, Up15-2, Up27 | U |
| 97% | 100% | 38% | 61% | | | | 4 amplicon combo 5: Up15-1, Up35-1, Up20-1, Up27 | V |
| 82% | 88% | | | | | | All amplicons together: Up3, Up10, Up15-1, Up15-2, Up20-1, Up20-2, Up27, Up35-1, Up35-2 | K |
| 82% | 88% | | | | | | 6 core amplicon: Up3, Up15-1, Up15-2, Up20-1, Up27, Up35-1 | L |
| 82% | 88% | | | | | | 7 amplicon combo 1: up10 and Up3, Up15-1, Up15-2, Up20-1, Up27, Up35-1 | M |
| 82% | 88% | | | | | | 7 amplicon combo 2: Up35-2 and Up3, Up15-1, Up15-2, Up20-1, Up27, Up35-1 | N |
| 100% | 100% | | | | | | 2 amplicon combo: Up15-1, Up35-1 | O |
| 94% | 100% | | | | | | 3 amplicon combo 1 Up15-1, Up35-1, Up10 | P |
| 91% | 94% | | | | | | 3 amplicon combo 2: Up15-1, Up35-1, Up20-1 | Q |
| 88% | 94% | | | | | | 4 amplicon combo 1: Up15-1, Up35-1, Up10, Up15-2 | R |
| 91% | 100% | | | | | | 4 amplicon combo 2: Up15-1, Up35-1, Up10, Up27 | S |
| 85% | 88% | | | | | | 4 amplicon combo 3: Up15-1, Up35-1, Up15-2, Up20-1 | T |

TABLE 2B-continued

| Specificity Sq | Specificity for non-dysplastic BE | Sensitivity HGD | Sensitivity EAC | Cut-off = 0.1 | Number of CpGs used for methylation call | Number of CpGs in amplicon analysis | | A |
|---|---|---|---|---|---|---|---|---|
| 88% | 94% | | | | | | 4 amplicon combo 4: Up15-1, Up35-1, Up15-2, Up27 | U |
| 88% | 94% | | | | | | 4 amplicon combo 5: Up15-1, Up35-1, Up20-1, Up27 | V |

In addition, RRBS discovery data was analyzed to identify CpG residues that demonstrated: i) at least 3 informative BE, which in every informative BE demonstrated at least 90% h methylation; and where ii) no more than 5% of informative normal squamous samples demonstrated methylation level below 90%, and that iii) demonstrated at least 6 informative EAC, where in these informative EACs the level of methylation was at least 20 percentage points lower than the methylation level of the least methylated BE. CpGs meeting these criteria are defined as unmethylated in EAC versus BE. Such unmethylated CpGs were then aggregated into patches by grouping together unmethylated CpGs that were within 200 bp of one another. Unmethylated in EAC patches may consist of 1 CpG up to any number of CpGs that meet the above criteria.

Example 3: Identification of Esophageal Cancer Informative Loci to Detect Progression of Esophageal Neoplasia Biopsy samples (that overlapped with the confirmatory biopsy sample set) were further analyzed in tests of panels of markers for detecting the progression of Barrett's esophagus to Barrett's esophagus high grade dysplasia (HGD) or to esophageal adenocarcinoma (EAC). Three panels of markers were selected for study. The first marker panel consisted of detecting at least one of the following four methylated markers: Up15-1, Up35-1, Up27, and Up10 (using bisulfite sequencing analysis of the corresponding amplicons and using the criteria for detection specified in table 2A). The second panel consisted of testing for somatic non-synonymous mutations in TP53 in assays in which TP53 was amplified from genomic DNA using a set of PCR amplicons that spanned the TP53 coding region and in which Next Generation DNA Sequencing was then used to compare TP53 sequences from esophageal lesions versus matched normal esophagus tissue. Samples were classified as detected if a TP53 mutant allele frequency of greater than or equal to 10% was identified. The third panel was a combination of detection of methylation in any of Up15-1, Up35-1, Up27, and Up10 or detection of mutation in TP53.

Table 3 shows the individual performance of biomarkers in detecting the different sample types of the 1st validation biopsies set using different cut-off criteria for methylation than the analysis of table 2. Shown is the performance for detection of different sample types of 5 different methylated DNA markers tested by bisulfite sequencing analysis of the corresponding amplicons (Up3, Up10, Up27, Up35-1, Up35-2). Table 3 specifies the number of CpGs required to be methylated on a DNA sequence read to classify that read as methylated for this analysis. Results are presented when samples are considered methylated if greater than or equal to 1% of all DNA sequence reads are classified as methylated, or if greater than or equal to 10% of all DNA sequence reads are classified as methylated. Also shown is the performance for detecting samples of testing for non-synonymous somatic mutation in assays in which TP53 was amplified from genomic DNA using a set of PCR amplicons that spanned the TP53 coding region and in which Next Generation DNA Sequencing was then used to compare TP53 sequences from esophageal lesions versus matched normal esophagus tissue. Shown are rates of sample detection (expressed as sensitivity or specificity) when samples are classified as TP53 mutant if greater than or equal to 3% of TP53 reads are scored as mutant, or if greater than or equal to 10% of TP53 reads are scored as mutant.

TABLE 3

| Category | Unchanged CpG # cut-off applied to all sample sets | | | Updated CpG # Cut-off applied to all sample sets | | p53 >3% |
|---|---|---|---|---|---|---|
| | Up3 25 + CpGs >1% = positive | Up35-1 14 + CpGs >1% = positive | Up35-2 10 + CpGs >1% = positive | Up10 26 + CpGs >1% = positive | Up27 15 + CpGs >1% = positive | |
| Sensitivity EAC | 20% | 50% | 35% | 30% | 20% | 70% |
| Sensitivity for BEs synchronous to EAC or HGD | 7% | 20% | 19% | 0% | 7% | 25% |
| Sensitivity HGD | 17% | 33% | 38% | 0% | 17% | 25% |
| Specificity Sq | 100% | 100% | 100% | 100% | 97% | 100% |
| Specificity for non-dysplastic BE | 100% | 100% | 100% | 100% | 100% | 100% |

TABLE 3-continued

| | >10% = positive | >10% = positive | >10% = positive | >10% = positive | >10% = positive | >10% = positive |
|---|---|---|---|---|---|---|
| Sensitivity EAC | 15% | 45% | 30% | 10% | 15% | 61% |
| Sensitivity for BEs matching higher pathologies, either EAC or HGD | 7% | 7% | 6% | 0% | 7% | 19% |
| Sensitivity HGD | 0% | 17% | 25% | 0% | 17% | 25% |

Table 4 shows the performance of selected combinations of the methylated DNA markers (Up3, Up10, Up27, Up35-1, Up35-2) for detection of different sample types in the experiment presented in Table 3. Samples are scored as methylated if any member of the marker combination panel scores the sample as methylated. Results are presented when the individual markers are considered methylated if greater than or equal to 1% of all DNA sequence reads are classified as methylated, or if greater than or equal to 10% of all DNA sequence reads are classified as methylated.

TABLE 4A

| Sensitivity for BEs matching higher pathologi | 10% Sensitivity EAC | 1% Specificity for non-dysplastic BE | 1% Specificity Sq | 1% Sensitivity HGD | 1% Sensitivity for BEs synchronous to EAC or | 1% Sensitivity EAC | Cut-off for positivity (e.i. samples is positive if more than this % of reads are methylated at the given number of CpGs) Category | 10% Sensitivity HGD |
|---|---|---|---|---|---|---|---|---|
| 13% | 45% | 100% | 100% | 33% | 20% | 50% | Up3 and Up35-1 | 17% |
| 13% | 35% | 100% | 100% | 33% | 20% | 45% | Up3 and Up35-2 | 33% |
| 11% | 30% | 100% | 100% | 25% | 11% | 50% | Up3 and Up10 | 0% |
| 13% | 25% | 100% | 97% | 33% | 13% | 35% | Up3 and Up27 | 17% |
| 7% | 45% | 100% | 100% | 33% | 27% | 50% | Up35-1 and Up35-2 | 33% |
| 0% | 50% | 100% | 100% | 50% | 11% | 60% | Up35-1 and Up10 | 25% |
| 13% | 50% | 100% | 97% | 50% | 20% | 60% | Up35-1 and Up27 | 33% |
| 0% | 30% | 100% | 100% | 50% | 11% | 50% | Up35-2 and Up10 | 50% |
| 13% | 40% | 100% | 97% | 50% | 27% | 50% | Up35-2 and Up27 | 50% |
| 0% | 20% | 100% | 94% | 0% | 0% | 40% | Up10 and Up27 | 0% |
| 13% | 45% | 100% | 100% | 33% | 27% | 50% | Up3. Up35-1, Up35-2 | 33% |
| 11% | 50% | 100% | 100% | 50% | 11% | 60% | Up3. Up35-1, Up10 | 25% |

TABLE 4B

| Cut-off for positivity (e.i. samples is positive if more than this % of reads are methylated at the given number of CpGs) | Category | Up3. Up35-1, Up27 | Up3. Up35-2, Up10 | Up3. Up35-2, Up27 | Up3. Up10, Up27 | Up35-1, Up10, up27 | Up35-2, Up10, up27 | Up3. Up35-1, Up35-2, Up10 | Up3. Up35-1, Up35-2, Up27 | Up35-1, Up35-2, Up10 Up27 | Up3, Up35-2, Up10 Up27 | Up3, Up35-1, Up10 Up27 | All 5 markers together |
|---|---|---|---|---|---|---|---|---|---|---|---|---|---|
| 1% | Sensitivity EAC | 60% | 60% | 55% | 60% | 70% | 60% | 60% | 60% | 70% | 70% | 70% | 70% |
| 1% | Sensitivity for BEs synchronous to EAC or HGD | 20% | 11% | 27% | 11% | 11% | 11% | 11% | 27% | 11% | 11% | 11% | 11% |
| 1% | Sensitivity HGD | 50% | 50% | 50% | 25% | 50% | 50% | 50% | 50% | 50% | 50% | 50% | 50% |
| 1% | Specificity Sq | 97% | 100% | 97% | 94% | 94% | 94% | 100% | 97% | 94% | 94% | 94% | 94% |
| 1% | Specificity for non-dysplastic BE | 100% | 100% | 100% | 100% | 100% | 100% | 100% | 100% | 100% | 100% | 100% | 100% |

TABLE 4B-continued

| Cut-off for positivity (e.i. samples is positive if more than this % of reads are methylated at the given number of CpGs) | Category | Up3, Up35-1, Up27 | Up3, Up35-2, Up10 | Up3, Up35-2, Up27 | Up3, Up10, Up27 | Up35-1, Up10, up27 | Up35-2, Up10, up27 | Up3, Up35-1, Up35-2, Up10 | Up3, Up35-1, Up35-2, Up27 | Up35-1, Up35-2, Up10 Up27 | Up3, Up35-2, Up10 Up27 | Up3, Up35-1, Up10 Up27 | All 5 markers together |
|---|---|---|---|---|---|---|---|---|---|---|---|---|---|
| 10% | Sensitivity EAC | 50% | 30% | 40% | 40% | 60% | 40% | 50% | 50% | 40% | 40% | 60% | 60% |
|  | Sensitivity for BEs matching higher pathologies, either EAC or HGD | 20% | 11% | 20% | 11% | 0% | 0% | 11% | 20% | 11% | 11% | 11% | 11% |
| 10% | Sensitivity HGD | 33% | 50% | 50% | 0% | 25% | 50% | 50% | 50% | 50% | 50% | 25% | 50% |

Samples summarized in Table 3 and Table 4 were additionally tested for non-synonymous somatic mutations in TP53. Table 5 shows performance of selected combinations of methylated DNA markers (Up3, Up10, Up27, Up35-1, Up35-2) plus testing for mutations in TP53 (p53) for detection of different sample types. Samples are scored as detected if any member of the marker combination panel scores the sample as methylated or if analysis for TP53 mutations scores the sample as TP53 mutant. Shown is the performance of the marker panel in which samples are scored as detected if any methylation marker is detected as methylated at greater than or equal to 1% of DNA reads, or if TP53 is detected as mutant at greater than or equal to 10% of the DNA sequence reads. Also shown is the performance of the marker panel in which samples are scored as detected if any methylation marker is detected as methylated at greater than or equal to 10% of DNA reads, or if TP53 is detected as mutant at greater than or equal to 10% of the DNA sequence reads.

TABLE 5A

| Cut-off for positivity (e.i. sample is positive if more than this % of reads are methylated at the given number of CpGs) | P53 cut-off | Category | Up-3 and p53 | Up35-1 and p53 | Up35-2 and p53 | Up10 and p53 | Up27 and p53 |
|---|---|---|---|---|---|---|---|
| 1% | 10% | Sensitivity EAC | 70% | 80% | 70% | 60% | 70% |
| 1% | 10% | Sensitivity for BEs synchronous to EAC or HGD | 20% | 20% | 19% | 11% | 27% |
|  | 10% | Sensitivity HGD | 33% | 50% | 38% | 25% | 33% |
| 1% | 10% | Specificity Sq | 100% | 100% | 100% | 100% | 97% |
| 1% | 10% | Specificity for non-dysplastic BE | 100% | 100% | 100% | 100% | 100% |
|  |  |  | Individual Methylation Markers + P53 | | | | |
| 10% | 10% | Sensitivity EAC | 70% | 80% | 70% | 60% | 70% |
|  | 10% | Sensitivity for BEs matching higher pathologies, either EAC or HGD | 20% | 20% | 19% | 11% | 27% |
| 10% | 10% | Sensitivity HGD | 33% | 50% | 38% | 25% | 33% |

TABLE 5B

| Cut-off for positivity (e.i. sample is positive if more than this % of reads are methylated at the given number of CpGs) | P53 cut-off | Category | Up3 and Up35-2 and p53 | Up3 and Up10 and p53 | Up3 and Up27 and p53 | Up35-2 and Up10 and p53 | Up35-2 and Up27 and p53 | Up10 and Up27 and p53 | Up3. Up35-2, Up10 and p53 | Up3. Up35-2, Up27 and p53 | Up3. Up10, Up27 and p53 | Up35-2, Up10, Up27 and p53 | Up35-1, Up35-2, Up10 Up27 and p53 | Up3, Up35-2, Up10 Up27 and p53 |
|---|---|---|---|---|---|---|---|---|---|---|---|---|---|---|
| 1% | 10% | Sensitivity EAC | 80% | 80% | 80% | 70% | 80% | 80% | 60% | 85% | 90% | 80% | 90% | 90% |
| 1% | 10% | Sensitivity for BEs synchronous to EAC or HGD | 20% | 11% | 27% | 11% | 27% | 11% | 11% | 27% | 11% | 11% | 11% | 11% |
| | 10% | Sensitivity HGD | 50% | 25% | 33% | 50% | 50% | 25% | 50% | 50% | 25% | 50% | 50% | 50% |
| 1% | 10% | Specificity Sq | 100% | 100% | 97% | 100% | 97% | 94% | 100% | 97% | 94% | 94% | 94% | 94% |
| 1% | 10% | Specificity for non-dysplastic BE | 100% | 100% | 100% | 100% | 100% | 100% | 100% | 100% | 100% | 100% | 100% | 100% |
| | | Methylation Marker Combinations Merged with P53 Mutation | | | | | | | | | | | | |
| 10% | 10% | Sensitivity EAC | 75% | 70% | 75% | 70% | 80% | 70% | 30% | 80% | 80% | 80% | 80% | 80% |
| | 10% | Sensitivity for BEs matching higher pathologies, either EAC or HGD | 20% | 11% | 27% | 11% | 27% | 11% | 11% | 27% | 11% | 11% | 11% | 11% |
| 10% | 10% | Sensitivity HGD | 50% | 25% | 33% | 50% | 50% | 25% | 50% | 50% | 25% | 50% | 50% | 50% |

DNA was also extracted from esophageal samples that were also obtained by cytology brushings of the esophagus. The sample set included brushings from 49 esophageal adenocarcinomas (EAC); 14 carcinomas of the gastroesophageal junction (JCA); 8 Barrett's esophagus with low grade dysplasia (LGD); 9 Barrett's esophagus with high-grade dysplasia (HGD); 33 cases of Barrett's esophagus without dysplasia from cases without HGD or EAC, otherwise termed non-dysplastic BE, that included 13 cases of short segment Barrett's esophagus (SSBE). Also included were brushings of the gastroesophageal junction (normal GEJ) from 62 individuals without Barrett's esophagus, without HGD, without EAC. This included individuals with gastroesophageal reflux disease, with eosinophilic esophagitis, or without any disease. Also included were 176 brushings of normal squamous esophagus from each of the above individuals. These DNA samples were analyzed for methylation by bisulfite sequencing of selected amplicons and were also analyzed for non-synonymous somatic mutations in TP53.

Table 6 shows the individual performance of biomarkers in detecting the different sample types of the validation brushings set. Shown is the performance for detection of different sample types of 5 different methylated DNA markers analyzed by bisulfite sequencing of selected amplicons (Up3, Up10, Up27, Up35-1, Up35-2). The table specifies the number of CpGs required to be methylated on a DNA sequence read to classify that read as methylated. Results are presented when samples are considered methylated if greater than or equal to 1% of all DNA sequence reads are classified as methylated, or if greater than or equal to 10% of all DNA sequence reads are classified as methylated. Also shown is the performance for detecting samples of testing for somatic mutation in assays in which TP53 was amplified from genomic DNA using a set of PCR amplicons that spanned the TP53 coding region and in which Next Generation DNA Sequencing was then used to compare TP53 sequences from esophageal lesions versus matched normal esophagus tissue. Shown are rates of sample detection (expressed as sensitivity or specificity) when samples are classified as TP53 mutant if greater than or equal to 3% of TP53 reads are scored as mutant, or if greater than or equal to 10% of TP53 reads are scored as mutant.

TABLE 6A

| Category | Unchanged CpG # cut-off applied to all sample sets | | |
|---|---|---|---|
| | Up-3<br>25 + CpGs<br>>1% = positive | Up35-1<br>14 + CpGs<br>>1% = positive | Up35-2<br>10 + CpGs<br>>1% = positive |
| Sensitivity EAC | 44% | 57% | 57% |
| Sensitivity JCA | 14% | 43% | 21% |
| Sensitivity LGD | 25% | 38% | 25% |
| Sensitivity HGD | 67% | 56% | 50% |
| Specificity normal GEJ | 98% | 98% | 98% |
| Specificity for "non-dysplastic BE"- excluding SSBE | 95% | 100% | 100% |
| Specificity for all BE without dysplasia (including SSBE and non-dysplastic BE | 97% | 85% | 94% |
| | >10% = positive | >10% = positive | >10% = positive |
| Sensitivity EAC | 21% | 57% | 45% |
| Sensitivity JCA | 7% | 29% | 7% |
| Sensitivity LGD | 13% | 38% | 25% |
| Sensitivity HGD | 33% | 56% | 100% |
| Specificity normal GEJ | 100% | 100% | 100% |
| Specificity for "non-dysplastic BE"- excluding SSBE | 100% | 100% | 100% |
| Specificity for all BE without dysplasia (including SSBE and non-dysplastic BE) | 100% | 88% | 97% |

TABLE 6B

| Category | Updated CpG # Cut-off applied to all sample sets | | |
|---|---|---|---|
| | Up10<br>26 + CpGs<br>>1% = positive | Up27<br>15 + CpGs<br>>1% = positive | p53<br>>3% |
| Sensitivity EAC | 31% | 43% | 59% |
| Sensitivity JCA | 43% | 14% | 50% |
| Sensitivity LGD | 0% | 13% | 13% |
| Sensitivity HGD | 22% | 20% | 40% |
| Specificity normal GEJ | 98% | 100% | 100% |
| Specificity for "non-dysplastic BE"- excluding SSBE | 100% | 95% | 100% |
| Specificity for all BE without dysplasia (including SSBE and non-dysplastic BE | 100% | 94% | 97% |
| | >10% = positive | >10% = positive | >10% = positive |
| Sensitivity EAC | 25% | 29% | 47% |
| Sensitivity JCA | 29% | 7% | 29% |
| Sensitivity LGD | 0% | 13% | 0% |
| Sensitivity HGD | 11% | 20% | 40% |
| Specificity normal GEJ | 100% | 100% | 100% |
| Specificity for "non-dysplastic BE"-excluding SSBE | 100% | 95% | 100% |
| Specificity for all BE without dysplasia (including SSBE and non-dysplastic BE) | 100% | 97% | 97% |

Table 7 shows the performance of selected combinations of the methylated DNA markers (Up3, Up10, Up27, Up35-1, Up35-2) for detection of different sample types in the esophageal brushings samples presented in Table 6. Samples are scored as methylated if any member of the marker combination panel scores the sample as methylated. Results are presented when the individual markers are considered methylated if greater than or equal to 1% of all DNA sequence reads are classified as methylated, or if greater than or equal to 10% of all DNA sequence reads are classified as methylated.

TABLE 7A

| Cut-off for positivity (e.i. sample is positive if more than this % of reads are methylated at the given number of CpGs) | Category | Up3 and Up35-1 | Up3 and Up35-2 | Up3 and Up10 | Up3 and Up27 | Up35-1 and Up35-2 | Up35-1 and Up10 | Up35-1 and Up27 | Up35-2 and Up10 | Up35-2 and Up27 | Up10 and Up27 | Up3. Up35-1, Up35-2 |
|---|---|---|---|---|---|---|---|---|---|---|---|---|
| 1% | Sensitivity EAC | 63% | 60% | 57% | 56% | 61% | 71% | 67% | 71% | 63% | 58% | 63% |
| 1% | Sensitivity JCA | 43% | 21% | 50% | 29% | 43% | 57% | 50% | 50% | 36% | 43% | 43% |
| 1% | Sensitivity LGD | 38% | 38% | 14% | 25% | 38% | 29% | 38% | 29% | 25% | 14% | 38% |
| 1% | Sensitivity HGD | 78% | 78% | 78% | 67% | 56% | 78% | 67% | 67% | 60% | 33% | 78% |
| 1% | Specificity normal GEJ | 98% | 98% | 97% | 98% | 98% | 97% | 98% | 97% | 98% | 98% | 98% |
| 1% | Specificity for non-dyspl BE | 95% | 95% | 95% | 90% | 100% | 100% | 95% | 100% | 95% | 95% | 95% |
| 1% | Specificity all BE without dysplasia(including SSBE, and non-dysplastic BE) | 84% | 94% | 97% | 91% | 85% | 85% | 82% | 94% | 91% | 94% | 84% |
| 10% | Sensitivity EAC | 56% | 48% | 38% | 38% | 57% | 67% | 65% | 58% | 55% | 42% | 63% |
| 10% | Sensitivity JCA | 29% | 7% | 29% | 14% | 29% | 43% | 36% | 29% | 14% | 36% | 29% |
| 10% | Sensitivity LGD | 38% | 38% | 0% | 25% | 38% | 29% | 38% | 29% | 25% | 14% | 38% |
| 10% | Sensitivity HGD | 67% | 44% | 33% | 44% | 56% | 67% | 67% | 44% | 50% | 22% | 78% |

TABLE 7B

| Cut-off for positivity (e.i. sample is positive if more than this % of reads are methylated at the given number of CpGs) | Category | Up3. Up35-1, Up10 | Up3. Up35-1, Up27 | Up3. Up35-2, Up10 | Up3. Up35-2, Up27 | Up3. Up10, Up27 | Up35-1, Up10, up27 | Up35-2, Up10, up27 | Up3. Up35-1, Up35-2, Up10 | Up3. Up35-1, Up35-2, Up27 | Up35-1, Up35-2, Up10 Up27 | Up3, Up35-2, Up10 Up27 | Up3, Up35-1, Up10 Up27 | All 5 Markers together |
|---|---|---|---|---|---|---|---|---|---|---|---|---|---|---|
| 1% | Sensitivity EAC | 72% | 69% | 70% | 67% | 64% | 77% | 75% | 72% | 69% | 74% | 74% | 77% | 77% |
| 1% | Sensitivity JCA | 57% | 50% | 50% | 36% | 50% | 57% | 50% | 57% | 50% | 50% | 50% | 57% | 57% |
| 1% | Sensitivity LGD | 29% | 38% | 29% | 38% | 14% | 29% | 29% | 29% | 38% | 29% | 29% | 29% | 29% |
| 1% | Sensitivity HGD | 89% | 78% | 89% | 78% | 78% | 89% | 78% | 89% | 78% | 89% | 89% | 89% | 89% |
| 1% | Specificity normal GEJ | 97% | 98% | 97% | 98% | 97% | 97% | 97% | 97% | 98% | 97% | 97% | 97% | 97% |
| 1% | Specificity for non-dysol BE | 95% | 90% | 95% | 90% | 90% | 95% | 95% | 95% | 90% | 90% | 90% | 90% | 90% |

TABLE 7B-continued

| Cut-off for positivity (e.i. sample is positive if more than this % of reads are methylated at the given number of CpGs) | Category | Up3, Up35-1, Up10 | Up3, Up35-1, Up27 | Up3, Up35-2, Up10 | Up3, Up35-2, Up27 | Up3, Up10, Up27 | Up35-1, Up10, up27 | Up35-2, Up10, up27 | Up3, Up35-1, Up35-2, Up10 | Up3, Up35-1, Up35-2, Up27 | Up35-1, Up35-2, Up10 Up27 | Up3, Up35-2, Up10 Up27 | Up3, Up35-1, Up10 Up27 | All 5 Markers together |
|---|---|---|---|---|---|---|---|---|---|---|---|---|---|---|
| 1% | Specificity all BE without dysplasia (including SSBE, and non-dysplastic BE) | 84% | 81% | 94% | 91% | 91% | 82% | 91% | 84% | 81% | 91% | 91% | 81% | 81% |
| 10% | Sensitivity EAC | 66% | 65% | 57% | 56% | 49% | 71% | 63% | 66% | 65% | 62% | 62% | 70% | 70% |
| 10% | Sensitivity JCA | 43% | 36% | 29% | 14% | 36% | 50% | 36% | 43% | 36% | 36% | 36% | 50% | 50% |
| 10% | Sensitivity LGD | 29% | 38% | 29% | 38% | 14% | 29% | 29% | 29% | 38% | 29% | 29% | 29% | 29% |
| 10% | Sensitivity HGD | 67% | 78% | 44% | 56% | 44% | 78% | 56% | 67% | 78% | 56% | 56% | 78% | 78% |

Table 8 shows the performance of selected combinations of methylated DNA markers (Up3, Up10, Up27, Up35-1, Up35-2) plus testing for mutations in TP53 (p53) for detection of different sample types in the esophageal brushings samples presented in Tables 6 and 7. Samples are scored as detected if any member of the marker combination panel scores the sample as methylated or if analysis for TP53 mutations scores the sample as TP53 mutant. Shown is the performance of the marker panel in which samples are scored as detected if any methylation marker is detected as methylated at greater than or equal to 1% of DNA reads, or if TP53 is detected as mutant at greater than or equal to 3% or at greater than or equal to 10% of the DNA sequence reads. Also shown is the performance of the marker panel in which samples are scored as detected if any methylation marker is detected as methylated at greater than or equal to 10% of DNA reads, or if TP53 is detected as mutant at greater than or equal to 3% or at greater than or equal to 10% of the DNA sequence reads. Marker combination with greater than 90% specificity in all BE without dysplasia are preferred yellow. Marker combinations that additionally show superior sensitivity for EAC are further preferred. Particularly preferred marker combinations are: Up35-2 methylation plus TP53 mutation; Up35-2 methylation plus Up3 methylation plus TP53 mutation; Up10 methylation plus Up3 methylation plus TP53 mutation; Up35-2 methylation plus Up10 methylation plus TP53 mutation; Up10 methylation plus Up27 methylation plus TP53 mutation; Up35-2 methylation plus Up3 methylation plus Up10 methylation plus TP53 mutation.

TABLE 8A

| Methyl cut-off (samples are positive if more than this % of reads are methylated at the required number of CpGs) | P53 cut-off | Category | Up-3 and p53 | Up35-1 and p53 | Up35-2 and p53 | Up10 and p53 | Up27 and p53 | Up3 Up35-2 and p53 | Up3 and Up10 and p53 | Up3 and Up27 and p53 |
|---|---|---|---|---|---|---|---|---|---|---|
| 1% | 1% | Sensitivity EAC | 81% | 84% | 86% | 75% | 80% | 88% | 85% | 85% |
| 1% | 1% | Sensitivity JCA | 50% | 64% | 50% | 57% | 57% | 50% | 57% | 57% |
| 1% | 1% | Sensitivity LGD | 25% | 38% | 25% | 14% | 13% | 38% | 14% | 25% |
| 1% | 1% | Sensitivity HGD | 78% | 78% | 70% | 33% | 50% | 89% | 78% | 78% |
| 1% | 1% | Specificity normal GEJ | 98% | 98% | 98% | 98% | 100% | 98% | 97% | 98% |

TABLE 8A-continued

| Methyl cut-off (samples are positive if more than this % of reads are methylated at the required number of CpGs) | P53 cut-off | Category | Up-3 and p53 | Up35-1 and p53 | Up35-2 and p53 | Up10 and p53 | Up27 and p53 | Up3 Up35-2 and p53 | Up3 and Up10 and p53 | Up3 and Up27 and p53 |
|---|---|---|---|---|---|---|---|---|---|---|
| 1% | 1% | Specificity for non-dysplastic BE | 95% | 100% | 100% | 100% | 95% | 95% | 95% | 90% |
| 1% | 1% | Specificity all be without dysplasia (including SSBE, and non-dysplastic BE) | 94% | 82% | 91% | 97% | 91% | 91% | 94% | 88% |
| 1% | 3% | Sensitivity EAC | 77% | 82% | 84% | 73% | 78% | 85% | 83% | 83% |
| 1% | 3% | Sensitivity JCA | 50% | 64% | 50% | 57% | 57% | 50% | 57% | 57% |
| 1% | 3% | Sensitivity LGD | 25% | 38% | 25% | 14% | 13% | 38% | 14% | 25% |
| 1% | 3% | Sensitivity HGD | 78% | 78% | 70% | 33% | 50% | 89% | 78% | 78% |
| 10% | 3% | Sensitivity EAC | 69% | 82% | 80% | 71% | 71% | 79% | 79% | 75% |
| 10% | 3% | Sensitivity JCA | 50% | 57% | 50% | 57% | 50% | 50% | 57% | 50% |
| 10% | 3% | Sensitivity LGD | 25% | 38% | 25% | 14% | 13% | 38% | 14% | 25% |
| 10% | 3% | Sensitivity HGD | 44% | 78% | 60% | 33% | 50% | 56% | 44% | 56% |
| 10% | 10% | Sensitivity EAC | 60% | 73% | 69% | 60% | 65% | 71% | 70% | 69% |
| 10% | 10% | Sensitivity JCA | 29% | 43% | 29% | 43% | 29% | 29% | 43% | 29% |
| 10% | 10% | Sensitivity LGD | 13% | 38% | 25% | 0% | 13% | 38% | 0% | 25% |
| 10% | 10% | Sensitivity HGD | 44% | 78% | 60% | 33% | 50% | 56% | 44% | 56% |

TABLE 8B

| Methyl cut-off (samples are positive if more than this % of reads are methylated at the required number of CpGs) | P53 cut-off | Category | Up35-2 and Up10 and p53 | Up35-2 and Up27 and p53 | Up10 and Up27 and p53 | Up3. Up35-2, Up10 and p53 | Up3. Up35-2, Up27 and p53 | Up3. Up35-2, Up10, Up27 and p53 | Up35-2, Up10, Up27 and p53 | Up35-1, Up35-2, Up10 Up27 and p53 | Up3, Up35-2, Up10 Up27 and p53 |
|---|---|---|---|---|---|---|---|---|---|---|---|
| 1% | 1% | Sensitivity EAC | 92% | 90% | 85% | 91% | 92% | 87% | 94% | 94% | 94% |
| 1% | 1% | Sensitivity JCA | 57% | 57% | 57% | 57% | 57% | 57% | 57% | 57% | 57% |
| 1% | 1% | Sensitivity LGD | 29% | 25% | 14% | 29% | 38% | 14% | 29% | 29% | 29% |
| 1% | 1% | Sensitivity HGD | 67% | 80% | 44% | 89% | 89% | 78% | 78% | 89% | 89% |
| 1% | 1% | Specificity normal GEJ | 97% | 98% | 98% | 97% | 98% | 97% | 97% | 97% | 97% |
| 1% | 1% | Specificity for non-dysplastic BE | 100% | 95% | 95% | 95% | 90% | 90% | 95% | 90% | 90% |
| 1% | 1% | Specificity all BE without dysplasia (including SSBE, and non-dysplastic BE) | 91% | 88% | 91% | 91% | 88% | 88% | 88% | 88% | 88% |
| 1% | 3% | Sensitivity EAC | 90% | 88% | 83% | 89% | 90% | 85% | 92% | 91% | 91% |
| 1% | 3% | Sensitivity JCA | 57% | 57% | 57% | 57% | 57% | 57% | 57% | 57% | 57% |
| 1% | 3% | Sensitivity LGD | 29% | 25% | 14% | 29% | 38% | 14% | 29% | 29% | 29% |
| 1% | 3% | Sensitivity HGD | 67% | 80% | 44% | 89% | 89% | 78% | 78% | 89% | 89% |
| 10% | 3% | Sensitivity EAC | 85% | 86% | 77% | 85% | 85% | 81% | 88% | 87% | 87% |
| 10% | 3% | Sensitivity JCA | 57% | 50% | 57% | 57% | 50% | 57% | 57% | 57% | 57% |
| 10% | 3% | Sensitivity LGD | 29% | 25% | 14% | 29% | 38% | 14% | 29% | 29% | 29% |
| 10% | 3% | Sensitivity HGD | 56% | 70% | 44% | 56% | 67% | 56% | 67% | 67% | 67% |
| 10% | 10% | Sensitivity EAC | 77% | 80% | 71% | 77% | 79% | 74% | 81% | 81% | 81% |
| 10% | 10% | Sensitivity JCA | 43% | 29% | 43% | 43% | 29% | 43% | 43% | 43% | 43% |
| 10% | 10% | Sensitivity LGD | 29% | 25% | 14% | 29% | 38% | 14% | 29% | 29% | 29% |
| 10% | 10% | Sensitivity HGD | 56% | 70% | 44% | 56% | 67% | 56% | 67% | 67% | 67% |

Example 4: Analysis of Esophageal Cancer Informative Loci in Formalin Fixed Paraffin Embedded Tissues Additional studies were performed on DNAs extracted from formalin fixed paraffin embedded (FFPE) tissue samples of the stomach and esophagus that capture different diagnostic categories other than Barrett's with high grade dysplasia and esophageal adenocarcinoma. Bisulfite converted DNAs from each sample were amplified with bisulfite specific methylation indifferent primers corresponding to selected amplicons and the amplicons were then analyzed by bisulfite sequencing to determine methylation status on the parental DNA templates.

Table 9 summarizes the side by side comparison of 8 methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Table 9 denotes for each marker the number of methylated cytosine bases required to be detected on a DNA sequence read to classify that read as methylated. Samples are detected as methylated if greater than or equal to 1% of DNA sequence reads are classified as methylated.

TABLE 9A

| | Marker | | | | | | | |
|---|---|---|---|---|---|---|---|---|
| | VIM | | SqBE5 | | SqBE Up7 | | SqBE11-2 | |
| | | | | CpG cut-off | | | | |
| | 6+ | | 13+ | | 23+ | | 5+ | |
| | Value (% positive samples or total number of samples sequenced) | | | | | | | |
| | % positive | Total number | % positive | Total number | % positive | Total number | % positive | Total number |
| BE (IM) | 90% | 30 | 50% | 12 | 50% | 16 | 83% | 30 |
| GEJ/Cardia with IM | 82% | 11 | 0% | 5 | 33% | 6 | 100% | 11 |
| GEJ/Cardia without IM | 0% | 58 | 0% | 33 | 2% | 47 | 31% | 58 |
| columnar mucosa without IM taken from patients with concurrent IM at the same endoscopy | 30% | 10 | 0% | 4 | 20% | 5 | 30% | 10 |
| Normal Distal Esophagus-Squamous | 9% | 23 | 8% | 13 | 0% | 16 | 13% | 23 |
| Squamous Mucosa with REFLUX Esophagus | 0% | 10 | 0% | 6 | 0% | 5 | 0% | 10 |
| Eosinophilic Eosphagitis | 0% | 15 | 0% | 5 | 0% | 11 | 0% | 15 |
| Gastic Mucosa with IM | 22% | 9 | 0% | 2 | 20% | 5 | 44% | 9 |
| Gastric Fundic Mucosa without IM | 0% | 24 | 0% | 14 | 5% | 21 | 8% | 24 |
| *Helicobactor Pylori* Gastritis without IM | 8% | 13 | 22% | 9 | 13% | 8 | 69% | 13 |

TABLE 9B

| | Marker | | | | | | | |
|---|---|---|---|---|---|---|---|---|
| | SqBE14-2 | | SqBE16 | | SqBE17 | | SqBE18 | |
| | CpG cut-off | | | | | | | |
| | 20+ | | 14+ | | 17+ | | 16+ | |
| | Value (% positive samples or total number of samples sequenced) | | | | | | | |
| | % positive | Total number | % positive | Total number | % positive | Total number | % positive | Total number |
| BE (IM) | 50% | 16 | 50% | 26 | 69% | 26 | 86% | 29 |
| GEJ/Cardia with IM | 22% | 9 | 18% | 11 | 73% | 11 | 70% | 10 |
| GEJ/Cardia without IM | 2% | 43 | 2% | 55 | 7% | 55 | 0% | 57 |
| columnar mucosa without IM taken from patients with concurrent IM at the same endoscopy | 0% | 5 | 11% | 9 | 11% | 9 | 11% | 9 |
| Normal Distal Esophagus-Squamous | 10% | 20 | 5% | 22 | 4% | 23 | 4% | 23 |
| Squamous Mucosa with REFLUX Esophagus | 17% | 6 | 0% | 8 | 0% | 9 | 0% | 10 |
| Eosinophilic Eosphagitis | 0% | 8 | 0% | 12 | 8% | 13 | 0% | 12 |
| Gastic Mucosa with IM | 0% | 5 | 0% | 7 | 25% | 8 | 14% | 7 |
| Gastric Fundic Mucosa without IM | 0% | 14 | 0% | 24 | 0% | 24 | 8% | 24 |
| *Helicobactor Pylori* Gastritis without IM | 14% | 7 | 8% | 13 | 46% | 13 | 15% | 13 |

Table 10 summarizes the side by side comparison of 8 methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Table 10 denotes for each marker the number of methylated cytosine bases required to be detected on a DNA sequence read to classify that read as methylated. Samples are detected as methylated if greater than or equal to 10% of DNA sequence reads are classified as methylated.

TABLE 10A

| | Marker | | | | | | | |
|---|---|---|---|---|---|---|---|---|
| | VIM | | SqBE5 | | SqBE Up7 | | SqBE11-2 | |
| | CpG cut-off | | | | | | | |
| | 6+ | | 13+ | | 23+ | | 5+ | |
| | Value (% positive samples or total number of samples sequenced) | | | | | | | |
| | % positive | Total number | % positive | Total number | % positive | Total number | % positive | Total number |
| BE (IM) | 87% | 30 | 50% | 12 | 44% | 16 | 70% | 30 |
| GEJ/Cardia with IM | 82% | 11 | 0% | 5 | 33% | 6 | 91% | 11 |
| GEJ/Cardia without IM | 0% | 58 | 0% | 33 | 2% | 47 | 16% | 58 |
| columnar mucosa without IM taken from patients with concurrent IM at the same endoscopy | 0% | 10 | 0% | 4 | 0% | 5 | 10% | 10 |
| Normal Distal Esophagus-Squamous | 9% | 23 | 8% | 13 | 0% | 16 | 13% | 23 |

TABLE 10A-continued

| | Marker | | | | | | | |
|---|---|---|---|---|---|---|---|---|
| | VIM | | SqBE5 | | SqBE Up7 | | SqBE11-2 | |
| | CpG cut-off | | | | | | | |
| | 6+ | | 13+ | | 23+ | | 5+ | |
| | Value (% positive samples or total number of samples sequenced) | | | | | | | |
| | % positive | Total number | % positive | Total number | % positive | Total number | % positive | Total number |
| Squamous Mucosa with REFLUX Esophagus | 0% | 10 | 0% | 6 | 0% | 5 | 0% | 10 |
| Eosinophilic Eosphagitis | 0% | 15 | 0% | 5 | 0% | 11 | 0% | 15 |
| Gastic Mucosa with IM | 11% | 9 | 0% | 2 | 20% | 5 | 22% | 9 |
| Gastric Fundic Mucosa without IM | 0% | 24 | 0% | 14 | 5% | 21 | 4% | 24 |
| *Helicobactor Pylori* Gastritis without IM | 8% | 13 | 22% | 9 | 13% | 8 | 46% | 13 |

TABLE 10B

| | Marker | | | | | | | |
|---|---|---|---|---|---|---|---|---|
| | SqBE14-2 | | SqBE16 | | SqBE17 | | SqBE18 | |
| | CpG cut-off | | | | | | | |
| | 20+ | | 14+ | | 17+ | | 16+ | |
| | Value (% positive samples or total number of samples sequenced) | | | | | | | |
| | % positive | Total number | % positive | Total number | % positive | Total number | % positive | Total number |
| BE (IM) | 50% | 16 | 42% | 26 | 62% | 26 | 76% | 29 |
| GEJ/Cardia with IM | 22% | 9 | 18% | 11 | 64% | 11 | 70% | 10 |
| GEJ/Cardia without IM | 2% | 43 | 2% | 55 | 0% | 55 | 0% | 57 |
| columnar mucosa without IM taken from patients with concurrent IM at the same endoscopy | 0% | 5 | 0% | 9 | 11% | 9 | 11% | 9 |
| Normal Distal Esophagus-Squamous | 10% | 20 | 5% | 22 | 4% | 23 | 4% | 23 |
| Squamous Mucosa with REFLUX Esophagus | 17% | 6 | 0% | 8 | 0% | 9 | 0% | 10 |
| Eosinophilic Eosphagitis | 0% | 8 | 0% | 12 | 0% | 13 | 0% | 12 |
| Gastic Mucosa with IM | 0% | 5 | 0% | 7 | 13% | 8 | 14% | 7 |
| Gastric Fundic Mucosa without IM | 0% | 14 | 0% | 24 | 0% | 24 | 0% | 24 |
| *Helicobactor Pylori* Gastritis without IM | 14% | 7 | 8% | 13 | 46% | 13 | 8% | 13 |

Table 11 summarizes performance of different panels comprised of combinations of methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Tables 9 and 10 denote for each marker the number of methylated cytosine bases required to be detected on a DNA sequence read to classify that read as methylated. Samples are detected as methylated if greater than or equal to 1% of DNA sequence reads are classified as methylated for any member of the marker panel.

TABLE 11A

| Marker combinations | VIM SqBE5 | VIM SqBE7 | VIM SqBE16 | VIM SqBE17 | VIM SqBE18 | SqBE5 SqBE7 | SqBE5 SqBE16 |
|---|---|---|---|---|---|---|---|
| BE (IM) | 92% | 88% | 92% | 88% | 97% | 71% | 70% |
| GEJ/Cardia with IM | 60% | 83% | 82% | 91% | 80% | 50% | 0% |
| GEJ/Cardia without IM | 0% | 2% | 2% | 7% | 0% | 3% | 3% |
| columnar mucosa without IM taken from patients with concurrent IM at the same endoscopy | 25% | 40% | 33% | 33% | 33% | 25% | 0% |
| Normal Distal Esophagus-Squamous | 8% | 6% | 9% | 9% | 9% | 8% | 8% |
| Squamous Mucosa with REFLUX Esophagus | 0% | 0% | 0% | 0% | 0% | 0% | 0% |
| Eosinophilic Eosphagitis | 0% | 0% | 0% | 8% | 0% | 0% | 0% |
| Gastic Mucosa with IM | 0% | 40% | 14% | 38% | 43% | 0% | 0% |
| Gastric Fundic Mucosa without IM | 0% | 5% | 0% | 0% | 8% | 7% | 0% |
| *Helicobactor Pylori* Gastritis without IM | 33% | 13% | 15% | 46% | 15% | 29% | 22% |

TABLE 11B

| Marker combinations | SqBE5 SqBE17 | SqBE5 SqBE18 | SqBE7 SqBE16 | SqBE7 SqBE17 | SqBE7 SqBE18 | SqBE16 SqBE17 | SqBE16 SqBE18 |
|---|---|---|---|---|---|---|---|
| BE (IM) | 80% | 91% | 57% | 79% | 94% | 78% | 92% |
| GEJ/Cardia with IM | 80% | 40% | 33% | 50% | 83% | 73% | 70% |
| GEJ/Cardia without IM | 9% | 0% | 2% | 9% | 2% | 8% | 2% |
| columnar mucosa without IM taken from patients with concurrent IM at the same endoscopy | 25% | 0% | 40% | 20% | 20% | 22% | 22% |
| Normal Distal Esophagus-Squamous | 8% | 8% | 6% | 0% | 6% | 9% | 5% |
| Squamous Mucosa with REFLUX Esophagus | 0% | 0% | 0% | 0% | 0% | 0% | 0% |
| Eosinophilic Eosphagitis | 20% | 0% | 0% | 10% | 0% | 10% | 0% |
| Gastic Mucosa with IM | 50% | 0% | 25% | 40% | 20% | 33% | 17% |
| Gastric Fundic Mucosa without IM | 0% | 7% | 5% | 5% | 5% | 0% | 8% |

TABLE 11B-continued

| Marker combinations | SqBE5 SqBE17 | SqBE5 SqBE18 | SqBE7 SqBE16 | SqBE7 SqBE17 | SqBE7 SqBE18 | SqBE16 SqBE17 | SqBE16 SqBE18 |
|---|---|---|---|---|---|---|---|
| *Helicobactor Pylori* Gastritis without IM | 44% | 44% | 25% | 50% | 25% | 46% | 23% |

Table 12 summarizes performance of different panels comprised of combinations of methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Tables 9 and 10 denote for each marker the number of methylated cytosine bases required to be detected on a DNA sequence read to classify that read as methylated. Samples are detected as methylated if greater than or equal to 10% of DNA sequence reads are classified as methylated for any member of the marker panel.

TABLE 12A

| Marker combinations | VIM SqBE5 | VIM SqBE7 | VIM SqBE16 | VIM SqBE17 | VIM SqBE18 | SqBE5 SqBE7 | SqBE5 SqBE16 |
|---|---|---|---|---|---|---|---|
| BE (IM) | 92% | 81% | 88% | 85% | 90% | 71% | 60% |
| GEJ/Cardia with IM | 60% | 83% | 82% | 91% | 80% | 50% | 0% |
| GEJ/Cardia without IM | 0% | 2% | 2% | 0% | 0% | 3% | 3% |
| columnar mucosa without IM taken from patients with concurrent IM at the same endoscopy | 0% | 0% | 0% | 11% | 11% | 0% | 0% |
| Normal Distal Esophagus-Squamous | 8% | 6% | 9% | 9% | 9% | 8% | 8% |
| Squamous Mucosa with REFLUX Esophagus | 0% | 0% | 0% | 0% | 0% | 0% | 0% |
| Eosinophilic Eosphagitis | 0% | 0% | 0% | 0% | 0% | 0% | 0% |
| Gastic Mucosa with IM | 0% | 20% | 14% | 13% | 29% | 0% | 0% |
| Gastric Fundic Mucosa without IM | 0% | 5% | 0% | 0% | 0% | 7% | 0% |
| *Helicobactor Pylori* Gastritis without IM | 33% | 13% | 15% | 46% | 15% | 29% | 22% |

TABLE 12B

| Marker combinations | SqBE5 SqBE17 | SqBE5 SqBE18 | SqBE7 SqBE16 | SqBE7 SqBE17 | SqBE7 SqBE18 | SqBE16 SqBE17 | SqBE16 SqBE18 |
|---|---|---|---|---|---|---|---|
| BE (IM) | 70% | 91% | 57% | 71% | 81% | 74% | 81% |
| GEJ/Cardia with IM | 80% | 40% | 33% | 50% | 83% | 64% | 70% |
| GEJ/Cardia without IM | 0% | 0% | 2% | 2% | 2% | 2% | 2% |
| columnar mucosa without IM taken from patients with concurrent IM at the same endoscopy | 25% | 0% | 0% | 20% | 0% | 11% | 11% |
| Normal Distal Esophagus-Squamous | 8% | 8% | 6% | 0% | 6% | 9% | 5% |

TABLE 12B-continued

| Marker combinations | SqBE5 SqBE17 | SqBE5 SqBE18 | SqBE7 SqBE16 | SqBE7 SqBE17 | SqBE7 SqBE18 | SqBE16 SqBE17 | SqBE16 SqBE18 |
|---|---|---|---|---|---|---|---|
| Squamous Mucosa with REFLUX Esophagus | 0% | 0% | 0% | 0% | 0% | 0% | 0% |
| Eosinophilic Eosphagitis | 0% | 0% | 0% | 0% | 0% | 0% | 0% |
| Gastic Mucosa with IM | 0% | 0% | 25% | 20% | 20% | 17% | 17% |
| Gastric Fundic Mucosa without IM | 0% | 0% | 5% | 5% | 5% | 0% | 0% |
| *Helicobactor Pylori* Gastritis without IM | 44% | 33% | 25% | 50% | 25% | 46% | 15% |

Methodologies

Somatic mutations in TP53 were detected using the following method. TP53 exons 2-11 were amplified using a multiplexed series of primer pairs covering all coding sequences and splice junctions. The primers contained additional 5' end sequences that were then used for secondary amplification that introduced barcode sequences and Illumina I5 and I7 sequences into the final PCR products. PCR products were mixed, purified and analyzed on an Illumina MiSeq instrument. Data analysis was performed using CLCBio software (Qiagen) and VariantStudio software (Illumina).

SEQUENCE LISTING (16212 sequences)

SEQ ID NO: 1 - DNA, 1017 bp, Homo sapiens
  source 1..1017: mol_type = unassigned DNA
cggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcg

SEQ ID NO: 2 - DNA, 166 bp, Homo sapiens
  source 1..166: mol_type = unassigned DNA
cgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcg

SEQ ID NO: 3-8 - skipped (6 entries)

SEQ ID NO: 9 - DNA, 14 bp, Homo sapiens
  source 1..14: mol_type = unassigned DNA
cgcgtctcagcgcg

SEQ ID NO: 10-12 - skipped (3 entries)

SEQ ID NO: 13 - DNA, 125 bp, Homo sapiens
  source 1..125: mol_type = unassigned DNA
cggctccacttacctgctccgaagagtggccccagctctgcgcctcttcctgcgaccccacacacagggacagccccaggcacagccccagcagcaggagcatggcggggcgagggcgcgggacg

SEQ ID NO: 14 - skipped

SEQ ID NO: 15 - DNA, 131 bp, Homo sapiens
  source 1..131: mol_type = unassigned DNA
cggggtgtgaagtggcggcgggcagaggggctcgcaggggctgggatccgcgtgcccctctctgcctcggtgcggagcacgatgtgcccgggcgggggcgaggacgtccgggaggggctgggctgcgcacg

SEQ ID NO: 16 - DNA, 94 bp, Homo sapiens
  source 1..94: mol_type = unassigned DNA
cgggcctgtcctcggctccgctcggagggtgtgcgggttcccgctccgctggccccgcttgcccaccacggcgcgcccaaacccacgcggcccg

SEQ ID NO: 17-18 - skipped (2 entries)

SEQ ID NO: 19 - DNA, 27 bp, Homo sapiens
  source 1..27: mol_type = unassigned DNA
cgcgatggggaggggaatacttgcgcg

SEQ ID NO: 20 - DNA, 164 bp, Homo sapiens
  source 1..164: mol_type = unassigned DNA
cgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcg

SEQ ID NO: 21-22 - skipped (2 entries)

SEQ ID NO: 23 - DNA, 68 bp, Homo sapiens
  source 1..68: mol_type = unassigned DNA
cgctgggcccgccgaggtcggggctttcccatgggagggaggtggctgcggcggaattttcagatgcg

SEQ ID NO: 24 - DNA, 508 bp, Homo sapiens
  source 1..508: mol_type = unassigned DNA
cggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcg

SEQ ID NO: 25-34 - skipped (10 entries)

SEQ ID NO: 35 - DNA, 396 bp, Homo sapiens
  source 1..396: mol_type = unassigned DNA
cgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccg

SEQ ID NO: 36 - skipped

SEQ ID NO: 37 - DNA, 70 bp, Homo sapiens
  source 1..70: mol_type = unassigned DNA
cgggccgccatttgtctacttgtcccatccaggacatctccctaaataatctctaagtggaaaaatcacg

SEQ ID NO: 38 - skipped

SEQ ID NO: 39 - DNA, 68 bp, Homo sapiens
  source 1..68: mol_type = unassigned DNA
cgcgggggacgcggggcgcggcgcgctgagcgcgggtgccgaggctggagggcgcggccgggctcccg

SEQ ID NO: 40 - DNA, 88 bp, Homo sapiens
  source 1..88: mol_type = unassigned DNA
cgagggtcggctcgctcctggggacccgcggatgtcgcgagggggcgccgcgccactgaaggctgggacgggggcggtgcgcggggcg

SEQ ID NO: 41-42 - skipped (2 entries)

SEQ ID NO: 43 - DNA, 87 bp, Homo sapiens
  source 1..87: mol_type = unassigned DNA
cgagttgctccgtttcctcattttgggggcgaagaagggtcggggagtgggggaaagcgggaggcgccgcggcctgggaggcccccg

SEQ ID NO: 44 - DNA, 45 bp, Homo sapiens
  source 1..45: mol_type = unassigned DNA
cgagcttctgcgctgcctctgtcgtcggagcccgggtttgccacg

SEQ ID NO: 45 - skipped

SEQ ID NO: 46 - DNA, 173 bp, Homo sapiens
  source 1..173: mol_type = unassigned DNA
cggttggaattctcttaagcattgccctgagtctattttcaaatgaaagggggaaaaacccaaaccagattagaatctgaaacagctgaaacagctatcgatttccagcttgctttcaagtctggcagagactgtgaaagtcctaacttctccgcgatgtcagccacggcccg

SEQ ID NO: 47 - skipped

SEQ ID NO: 48 - DNA, 48 bp, Homo sapiens
  source 1..48: mol_type = unassigned DNA
cgaagacgagacgcagagctccaactgcagccagagacaaaggccccg

SEQ ID NO: 49-50 - skipped (2 entries)

SEQ ID NO: 51 - DNA, 36 bp, Homo sapiens
  source 1..36: mol_type = unassigned DNA
cgaccgtggcgccagcttcccgccccctctgccccg

SEQ ID NO: 52-56 - skipped (5 entries)

SEQ ID NO: 57 - DNA, 97 bp, Homo sapiens
  source 1..97: mol_type = unassigned DNA
cgcttgcaaggacgggagtcggggagggtgtagggcgagtttaaaggacgggcagagcaagccccgggaagaggcaggggttttccctcccgggtcg

SEQ ID NO: 58-59 - skipped (2 entries)

SEQ ID NO: 60 - DNA, 67 bp, Homo sapiens
  source 1..67: mol_type = unassigned DNA
cgccagactctcacagtccttcacacgccactcccactgcctcagggaaccacaagcacaggcatcg

SEQ ID NO: 61 - skipped

SEQ ID NO: 62 - DNA, 29 bp, Homo sapiens
  source 1..29: mol_type = unassigned DNA
cgacagggcagagggtcagcagtcacccg

SEQ ID NO: 63 - DNA, 49 bp, Homo sapiens
  source 1..49: mol_type = unassigned DNA
cggccgagcctaagtggctgaagcgcggacgaggatgcgcggggcctcg

SEQ ID NO: 64 - DNA, 188 bp, Homo sapiens
  source 1..188: mol_type = unassigned DNA
cgggagctcgaagtcgcctcgagcgggggtgggcggtgagcggacccccgggtgttgaccaggtgtttggtggtagagcagggaaggggggaacggacgtcgaccctagggatccctcacccgctcacgctccttggcgttggccacacgccgccgctccagcaccaactggaggttttcagtggacg

SEQ ID NO: 65-66 - skipped (2 entries)

SEQ ID NO: 67 - DNA, 113 bp, Homo sapiens
  source 1..113: mol_type = unassigned DNA
cggccgtgggcggctgcggcgcggccgcggcgaggggcgagcggggctggtctcgccgctcgggcgagagcatccctttgggggccaaccctgcggctccgccttcacccgcg

SEQ ID NO: 68 - DNA, 208 bp, Homo sapiens
  source 1..208: mol_type = unassigned DNA
cggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcg

SEQ ID NO: 69 - DNA, 96 bp, Homo sapiens
  source 1..96: mol_type = unassigned DNA
cggcccgcccgcccctcagcagccctggggtgcccggggcggccctgcaagcgggagagagcggcgaggcggcggcgccgagtgcggggggatgcg

SEQ ID NO: 70 - DNA, 236 bp, Homo sapiens
  source 1..236: mol_type = unassigned DNA
cggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcg

SEQ ID NO: 71 - DNA, 211 bp, Homo sapiens
  source 1..211: mol_type = unassigned DNA
cgcccccagccgtgtcctggctgcgcagctggaaaggttgagcagctcactgctgtccctctgttcggccttggacacatcgcctgaactcctgggcgcctctgctgttaagtgggggacagcactatttactggggaggaaaactccaggaatgtggaccctggggccacgcaggggttgggaagtgaagggcagggaacgcgggcggcg

SEQ ID NO: 72 - DNA, 193 bp, Homo sapiens
  source 1..193: mol_type = unassigned DNA
cgcgcgccgaagctgtgacggtttactaagcagagacttgcgaggcacacagagagggaatgaggcggaaccgttcgggggctcgttgacactgcagagcctcccgcagcatcgctgccttaaatcccgcctttccaggcgtgcgcgcacagcgagccagaggaggctccgtcccgacctggggtcccccgcg

SEQ ID NO: 73 - skipped

SEQ ID NO: 74 - DNA, 199 bp, Homo sapiens
  source 1..199: mol_type = unassigned DNA
cgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcg

SEQ ID NO: 75 - DNA, 87 bp, Homo sapiens
  source 1..87: mol_type = unassigned DNA
cggctagcagaggcggcgcctggtcttggatgctgcagcggagacgccaaggagactgaatgcagggagcgaggcgtagcggccgcg

SEQ ID NO: 76 - DNA, 68 bp, Homo sapiens
  source 1..68: mol_type = unassigned DNA
cgcgcgagagtgcccagctgggaaatgcagctccgaattaacatcgtatgtttcataatcagtttacg

SEQ ID NO: 77 - DNA, 61 bp, Homo sapiens
  source 1..61: mol_type = unassigned DNA
cgcccctggcattcagggaatggtttgcaaatctcaatgcaccacagactagttttcaccg

SEQ ID NO: 78 - DNA, 40 bp, Homo sapiens
  source 1..40: mol_type = unassigned DNA
cgggtgctttgccgctgccgcttctgctgccgccgatccg

SEQ ID NO: 79 - DNA, 647 bp, Homo sapiens
  source 1..647: mol_type = unassigned DNA
cgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccg

SEQ ID NO: 80 - DNA, 327 bp, Homo sapiens
  source 1..327: mol_type = unassigned DNA
cgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgtgggactaagggcggcctcagagatgcccggaaaatcgctgccacggccagagtgcggcgcagacgcggcagagttggaggtgtccgcggtgcaggctgctgcccacgccgctcaggccaggtgctgagggctcagcccgcgcctcg

SEQ ID NO: 81 - skipped

SEQ ID NO: 82 - DNA, 324 bp, Homo sapiens
  source 1..324: mol_type = unassigned DNA
cgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcg

SEQ ID NO: 83 - DNA, 77 bp, Homo sapiens
  source 1..77: mol_type = unassigned DNA
cggcgcagcggcgggaacccgaggccgagcgccgcggcggcagcgctagaagcgcacccatcgggcacggcgaggcg

SEQ ID NO: 84 - DNA, 158 bp, Homo sapiens
  source 1..158: mol_type = unassigned DNA
cgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcg

SEQ ID NO: 85 - DNA, 79 bp, Homo sapiens
  source 1..79: mol_type = unassigned DNA
cgctcctaaaaattaaataaatcaataagagaatcaattaataggcagcgctgcgaccgccaggagcgcggagcgcgcg

SEQ ID NO: 86 - DNA, 137 bp, Homo sapiens
  source 1..137: mol_type = unassigned DNA
cgtctcctctgacccccaaggtcagaaagatttattacttccttcgagagggcgcagccacagacccactagagagggcgggcagggtgtcggaagccagagaacggcgctccgcgtcctcccaccgctccagggcg

SEQ ID NO: 87 - DNA, 112 bp, Homo sapiens
  source 1..112: mol_type = unassigned DNA
cgcgggctatgcactgctgctggtgctcactatgctcaacctcctggactacaagtggcacaaggagccgctgcagcagtgcaaccccgatgggccgctgggtgccgcagcg

SEQ ID NO: 88-89 - skipped (2 entries)

SEQ ID NO: 90 - DNA, 282 bp, Homo sapiens
  source 1..282: mol_type = unassigned DNA
cgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccg

SEQ ID NO: 91 - DNA, 81 bp, Homo sapiens
  source 1..81: mol_type = unassigned DNA
cggctgccaactcgcccaacttgctgcgcgggtggccgctcagagccgcgggcttgcggggcgccccccgccgccgcgccg

SEQ ID NO: 92 - DNA, 53 bp, Homo sapiens
  source 1..53: mol_type = unassigned DNA
cggccgtggagaccctaaccgagctcacgctggcgcaaaaggcaaaagccgcg

SEQ ID NO: 93 - DNA, 40 bp, Homo sapiens
  source 1..40: mol_type = unassigned DNA
cgcgccgagggggcgccagcggggacgtgagctggcgccg

SEQ ID NO: 94 - DNA, 206 bp, Homo sapiens
  source 1..206: mol_type = unassigned DNA
cggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccg

SEQ ID NO: 95 - DNA, 38 bp, Homo sapiens
  source 1..38: mol_type = unassigned DNA
cgagggcacggcggccgccgccccgcgcagcagcagcg

SEQ ID NO: 96 - skipped

SEQ ID NO: 97 - DNA, 25 bp, Homo sapiens
  source 1..25: mol_type = unassigned DNA
cgagcgaatgcaacgcgtacacacg

SEQ ID NO: 98 - DNA, 79 bp, Homo sapiens
  source 1..79: mol_type = unassigned DNA
cgcctctctctttttttaaaaaaaaaatttaaacaattcccaaataatatttaataggaaagaagaaggaaaaggagcg

SEQ ID NO: 99 - DNA, 33 bp, Homo sapiens
  source 1..33: mol_type = unassigned DNA
cgagggcaacggccgaggcgccacgcggggccg

SEQ ID NO: 100 - DNA, 132 bp, Homo sapiens
  source 1..132: mol_type = unassigned DNA
cgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccg

SEQ ID NO: 101 - DNA, 32 bp, Homo sapiens
  source 1..32: mol_type = unassigned DNA
cgccctcggggcagaggagggggtgccaggcg

SEQ ID NO: 102-103 - skipped (2 entries)

SEQ ID NO: 104 - DNA, 20 bp, Homo sapiens
  source 1..20: mol_type = unassigned DNA
cggcgccgctggcatactcg

SEQ ID NO: 105 - DNA, 85 bp, Homo sapiens
  source 1..85: mol_type = unassigned DNA
cggcgggcgcaggggcagggcatgactgacgcgccctctgcctgcgcttatgtgagagaaagcggccgagggagggagcgtgccg

SEQ ID NO: 106 - DNA, 230 bp, Homo sapiens
  source 1..230: mol_type = unassigned DNA
cgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccg

SEQ ID NO: 107 - DNA, 84 bp, Homo sapiens
  source 1..84: mol_type = unassigned DNA
cgcaagagctggtcaaaatgccctcaggtgcgtgggggcttcggggccttagttggagcccgacaccctgagactggcggcccg

SEQ ID NO: 108 - DNA, 42 bp, Homo sapiens
  source 1..42: mol_type = unassigned DNA
cgcgcgagcttttccgtttggctgagtcaaaaagggatcgcg

SEQ ID NO: 109 - DNA, 45 bp, Homo sapiens
  source 1..45: mol_type = unassigned DNA
cggacgactctttctaccctttcgaggacgaggaggagcacggcg

SEQ ID NO: 110 - DNA, 26 bp, Homo sapiens
  source 1..26: mol_type = unassigned DNA
cgcgggacaagggatgctggcgggcg

SEQ ID NO: 111 - DNA, 50 bp, Homo sapiens
  source 1..50: mol_type = unassigned DNA
cgaggctcctcccgcggcgcgcggcagcctcagcctccacctaaacctcg

SEQ ID NO: 112 - DNA, 56 bp, Homo sapiens
  source 1..56: mol_type = unassigned DNA
cgctggcccacccgcgtgcacgcccaccccccacgcgcgtccctggctcagaagcg

SEQ ID NO: 113 - DNA, 44 bp, Homo sapiens
  source 1..44: mol_type = unassigned DNA
cgagcgtgtgcgcgcgcgaggggagcgcgtgcgcggtgaggacg

SEQ ID NO: 114-115 - skipped (2 entries)

SEQ ID NO: 116 - DNA, 58 bp, Homo sapiens
  source 1..58: mol_type = unassigned DNA
cgcccgcctacccgccaggcaggcggtggtgtcgatccacttgagcagctgccccgcg

SEQ ID NO: 117 - DNA, 151 bp, Homo sapiens
  source 1..151: mol_type = unassigned DNA
cgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccg

SEQ ID NO: 118 - DNA, 17 bp, Homo sapiens
  source 1..17: mol_type = unassigned DNA
cggtcctggggagtccg

SEQ ID NO: 119 - DNA, 70 bp, Homo sapiens
  source 1..70: mol_type = unassigned DNA
cgcagaggggccagcaattccatgggtggtggggccctccatccctggacgcagcggggagcagcgggcg

SEQ ID NO: 120 - DNA, 59 bp, Homo sapiens
  source 1..59: mol_type = unassigned DNA
cggcgcccagcgcccaagcgctaacccgctgaaagtttctcagcgaaatctcagggacg

SEQ ID NO: 121 - DNA, 25 bp, Homo sapiens
  source 1..25: mol_type = unassigned DNA
cggctcggatagaggttacccagcg

SEQ ID NO: 122 - DNA, 57 bp, Homo sapiens
  source 1..57: mol_type = unassigned DNA
cgtcttccgctacctgacaccagccaggcagcccccagggccagagcgtcagcgccg

SEQ ID NO: 123 - DNA, 111 bp, Homo sapiens
  source 1..111: mol_type = unassigned DNA
cgttcagggttggggctcggtgggaacctccccgtgcccgaagggacgaccccgtcagagagtcccccgacccttgcacctaccgtccttggcaggacgtggagctgctcg

SEQ ID NO: 124 - DNA, 211 bp, Homo sapiens
  source 1..211: mol_type = unassigned DNA
cgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccg

SEQ ID NO: 125 - DNA, 75 bp, Homo sapiens
  source 1..75: mol_type = unassigned DNA
cgctcctactactctttcaaacactgcagcaagttgcagcaaggcgggcaaataccgacagcgcgcgtgggggcg

SEQ ID NO: 126 - skipped

SEQ ID NO: 127 - DNA, 66 bp, Homo sapiens
  source 1..66: mol_type = unassigned DNA
cggccacctgtcctccgccctcggggcgccgcccagcttcgcgccaggcgccttctccagcgcccg

SEQ ID NO: 128 - skipped

SEQ ID NO: 129 - DNA, 163 bp, Homo sapiens
  source 1..163: mol_type = unassigned DNA
cgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccg

SEQ ID NO: 130 - DNA, 99 bp, Homo sapiens
  source 1..99: mol_type = unassigned DNA
cgcttctgccctggagcgcggtcgggagtaaaatcgcaggagtgggagggtagcgagccagctggattccgagccgcggagcgcgctggctttgctccg

SEQ ID NO: 131 - DNA, 96 bp, Homo sapiens
  source 1..96: mol_type = unassigned DNA
cgcgcctccgcaggcggcactgcccgcggcgcggcgtgtgcaccgagcgagtgaaggtatgtgtggcgggcgcggctggagctgccgccgccgccg

SEQ ID NO: 132 - skipped

SEQ ID NO: 133 - DNA, 16 bp, Homo sapiens
  source 1..16: mol_type = unassigned DNA
cggcgagattggcacg

SEQ ID NO: 134 - skipped

SEQ ID NO: 135 - DNA, 141 bp, Homo sapiens
  source 1..141: mol_type = unassigned DNA
cgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcg

SEQ ID NO: 136 - skipped

SEQ ID NO: 137 - DNA, 37 bp, Homo sapiens
  source 1..37: mol_type = unassigned DNA
cgttcccaaccaaccgcacaaaacccgcaacacctcg

SEQ ID NO: 138 - DNA, 52 bp, Homo sapiens
  source 1..52: mol_type = unassigned DNA
cgggtcggggcacttggcgccctgtgtgggtggcgggagcggggacgcctcg

SEQ ID NO: 139-142 - skipped (4 entries)

SEQ ID NO: 143 - DNA, 17 bp, Homo sapiens
  source 1..17: mol_type = unassigned DNA
cgagttggggcgggacg

SEQ ID NO: 144 - DNA, 136 bp, Homo sapiens
  source 1..136: mol_type = unassigned DNA
cgcgagtcccctgacgcggggaccagttatgaatcgggggtgtgtgtttgcctccagagacctggcaaggtgcggagccctccagaagtgcggtcaagcggcagcggagacggcgagccaggaacctccccccgcg

SEQ ID NO: 145 - DNA, 31 bp, Homo sapiens
  source 1..31: mol_type = unassigned DNA
cgcgcccagcgccccgctcactccctggccg

SEQ ID NO: 146 - DNA, 25 bp, Homo sapiens
  source 1..25: mol_type = unassigned DNA
cgtgcaccctgaggtctggttggcg

SEQ ID NO: 147 - DNA, 12 bp, Homo sapiens
  source 1..12: mol_type = unassigned DNA
cgttgacgagcg

SEQ ID NO: 148 - skipped

SEQ ID NO: 149 - DNA, 199 bp, Homo sapiens
  source 1..199: mol_type = unassigned DNA
cgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcg

SEQ ID NO: 150 - DNA, 91 bp, Homo sapiens
  source 1..91: mol_type = unassigned DNA
cggccccgggtgcagggtggcgggcccggcggcgcgcgtccccctccccctcctggcggcccgcacgtgtcgcccgcgccgcgcccccacg

SEQ ID NO: 151 - DNA, 108 bp, Homo sapiens
  source 1..108: mol_type = unassigned DNA
cgcgtctccactgttccatctcctccgttcctggagttcctcggtgactctactatagcttctgttatcctgtgacctgcaggtactgggagatccatagggaggacg

SEQ ID NO: 152 - DNA, 13 bp, Homo sapiens
  source 1..13: mol_type = unassigned DNA
cgcaccgatttcg

SEQ ID NO: 153 - DNA, 176 bp, Homo sapiens
  source 1..176: mol_type = unassigned DNA
cggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccg

SEQ ID NO: 154 - skipped

SEQ ID NO: 155 - DNA, 157 bp, Homo sapiens
  source 1..157: mol_type = unassigned DNA
cgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccg

SEQ ID NO: 156 - DNA, 66 bp, Homo sapiens
  source 1..66: mol_type = unassigned DNA
cgcgaaccgctaggggccctcgcgctcccttcccacccaggccccctgtccctcccgccgcggccg

SEQ ID NO: 157 - DNA, 498 bp, Homo sapiens
  source 1..498: mol_type = unassigned DNA
cgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacg

SEQ ID NO: 158 - DNA, 27 bp, Homo sapiens
  source 1..27: mol_type = unassigned DNA
cgcgggtccgaacgcccttcgcgctcg

SEQ ID NO: 159-160 - skipped (2 entries)

SEQ ID NO: 161 - DNA, 16 bp, Homo sapiens
  source 1..16: mol_type = unassigned DNA
cgtcgcctgcctcgcg

SEQ ID NO: 162 - DNA, 53 bp, Homo sapiens
  source 1..53: mol_type = unassigned DNA
cgcggagggcgccgaatcagagcctgcggggcttgacagcttctcttgcggcg

SEQ ID NO: 163-166 - skipped (4 entries)

SEQ ID NO: 167 - DNA, 14 bp, Homo sapiens
  source 1..14: mol_type = unassigned DNA
cgtgtccacctacg

SEQ ID NO: 168 - DNA, 186 bp, Homo sapiens
  source 1..186: mol_type = unassigned DNA
cggcgggaaggcctgggtgttcacagatagagctggagttccccggtgggtggcacagacaattagctggggctgcctcacatgtaatctaattacaggggaaacaggctcaaacaccgggtgataagcagcgcaactgtttcgggtgactctgtaatttttcctccattaattttctccataacg

SEQ ID NO: 169 - DNA, 79 bp, Homo sapiens
  source 1..79: mol_type = unassigned DNA
cggggtacgctcgccctcggcggggcccctcgctccgctgtgggagtggcagtgggtgtcggggtggagaaagtacgcg

SEQ ID NO: 170 - DNA, 49 bp, Homo sapiens
  source 1..49: mol_type = unassigned DNA
cgccgcgtccgcgccgcgctccctgcaggcaacgggagacgcccccgcg

SEQ ID NO: 171 - DNA, 17 bp, Homo sapiens
  source 1..17: mol_type = unassigned DNA
cggatgaaccgttcgcg

SEQ ID NO: 172-174 - skipped (3 entries)

SEQ ID NO: 175 - DNA, 165 bp, Homo sapiens
  source 1..165: mol_type = unassigned DNA
cgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccg

SEQ ID NO: 176 - DNA, 14 bp, Homo sapiens
  source 1..14: mol_type = unassigned DNA
cgcgcgggtcagcg

SEQ ID NO: 177-178 - skipped (2 entries)

SEQ ID NO: 179 - DNA, 97 bp, Homo sapiens
  source 1..97: mol_type = unassigned DNA
cgtgtgcccagggccagcagcacgcacaagtgccagcgcacggccgccgcgcccatgctcaatgcgggccccgctgggcgtgcgggcgtgcggggcg

SEQ ID NO: 180 - skipped

SEQ ID NO: 181 - DNA, 98 bp, Homo sapiens
  source 1..98: mol_type = unassigned DNA
cgcggatcgcgcgctcccgccgctctgcccctaaacttctgccgtagctccctttcaagccagcgaatttattccttaaaaccagaaactgaacctcg

SEQ ID NO: 182 - DNA, 69 bp, Homo sapiens
  source 1..69: mol_type = unassigned DNA
cggaggggcggaggaggtgctggcggcggcactgagcggcggcggcgcagggcgcgcgggccttccgcg

SEQ ID NO: 183-186 - skipped (4 entries)

SEQ ID NO: 187 - DNA, 103 bp, Homo sapiens
  source 1..103: mol_type = unassigned DNA
cggccccaggacggcagggaccgcgatggagcggcttcgggggcggccgggggacggcgcggtggcggtcggccagcccgctcctccgggggcggcgggcgcg

SEQ ID NO: 188 - skipped

SEQ ID NO: 189 - DNA, 21 bp, Homo sapiens
  source 1..21: mol_type = unassigned DNA
cggctctcggcggcggcggcg

SEQ ID NO: 190 - DNA, 148 bp, Homo sapiens
  source 1..148: mol_type = unassigned DNA
cggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcg

SEQ ID NO: 191-192 - skipped (2 entries)

SEQ ID NO: 193 - DNA, 26 bp, Homo sapiens
  source 1..26: mol_type = unassigned DNA
cgccgagaggcagcgcgtgatggccg

SEQ ID NO: 194 - DNA, 119 bp, Homo sapiens
  source 1..119: mol_type = unassigned DNA
cgcacgcccaagtgcgcgcgctgccgcaaccatggcgtcctgtcctggctcaagggccacaagcgttactgccgcttcaaggactgcacctgcgagaagtgcatcctcatcatcgagcg

SEQ ID NO: 195 - DNA, 66 bp, Homo sapiens
  source 1..66: mol_type = unassigned DNA
cggcccgacctttcccgcccagcctgggtcagaggaagccgaaagcggcctcagcaaggtgaggcg

SEQ ID NO: 196 - DNA, 60 bp, Homo sapiens
  source 1..60: mol_type = unassigned DNA
cgagcgaagtcgtcgtgtctgggcagaaggcgctccaggaggcgcgaggccccagccgcg

SEQ ID NO: 197 - skipped

SEQ ID NO: 198 - DNA, 124 bp, Homo sapiens
  source 1..124: mol_type = unassigned DNA
cgctcggagcgggacctgcttgctccagtgcacgccgcggagcgaaccatcgggctggcgggggtggaggggtgcaggcgtgggggctgcgggccgctcgggccttgggcttctcctgccgccg

SEQ ID NO: 199 - skipped

SEQ ID NO: 200 - DNA, 156 bp, Homo sapiens
  source 1..156: mol_type = unassigned DNA
cggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcg

SEQ ID NO: 201 - skipped

SEQ ID NO: 202 - DNA, 91 bp, Homo sapiens
  source 1..91: mol_type = unassigned DNA
cgcgcgccgccgaaaccttgcctccgccgccgctcaccgacaggctgtggagaaggtcatcgaccgatgtcaccgagtcattcctgaagcg

SEQ ID NO: 203-204 - skipped (2 entries)

SEQ ID NO: 205 - DNA, 89 bp, Homo sapiens
  source 1..89: mol_type = unassigned DNA
cgttactcgcgtgccagcagttgggcgctccgacctctcagaccgcgtgagcccagcaaagcggttaggcgcgcgcctgcagctcggcg

SEQ ID NO: 206 - DNA, 13 bp, Homo sapiens
  source 1..13: mol_type = unassigned DNA
cgtctttaatccg

SEQ ID NO: 207 - skipped

SEQ ID NO: 208 - DNA, 47 bp, Homo sapiens
  source 1..47: mol_type = unassigned DNA
cgagcgccagaccccagcaacaaaaggccaggcgaggccacatcgcg

SEQ ID NO: 209-210 - skipped (2 entries)

SEQ ID NO: 211 - DNA, 159 bp, Homo sapiens
  source 1..159: mol_type = unassigned DNA
cgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcg

SEQ ID NO: 212-214 - skipped (3 entries)

SEQ ID NO: 215 - DNA, 78 bp, Homo sapiens
  source 1..78: mol_type = unassigned DNA
cgggcgccgaggcttgggctttagccgtggcgctcgcctcggcgcagtggggagccgcgggcgtcggagaagcggccg

SEQ ID NO: 216 - skipped

SEQ ID NO: 217 - DNA, 48 bp, Homo sapiens
  source 1..48: mol_type = unassigned DNA
cgcggaggagtttcgcacccgaccgtgcacagcgaccgagttggcgcg

SEQ ID NO: 218-220 - skipped (3 entries)

SEQ ID NO: 221 - DNA, 157 bp, Homo sapiens
  source 1..157: mol_type = unassigned DNA
cgcttctatagttttgctttgacagctaaggaaaaaatctgccaaaaaccagaggcgctgctgagtgttggcgtgggaatgctagtttagtcagagccttgctctgggccatttaaataaaaacagacatgttggtggcaaatgccagttgaacacg

SEQ ID NO: 222 - skipped

SEQ ID NO: 223 - DNA, 82 bp, Homo sapiens
  source 1..82: mol_type = unassigned DNA
cgcgcgccagtttcccgccccgtggaagcgcccctctcccgacttcggctgatccccgctcgccgccctccccgcgggtgcg

SEQ ID NO: 224 - DNA, 23 bp, Homo sapiens
  source 1..23: mol_type = unassigned DNA
cgcctggccgcctcacctggccg

SEQ ID NO: 225 - DNA, 38 bp, Homo sapiens
  source 1..38: mol_type = unassigned DNA
cgagttcccgcgcgtctacgagcagctttgcgagttcg

SEQ ID NO: 226 - skipped

SEQ ID NO: 227 - DNA, 165 bp, Homo sapiens
  source 1..165: mol_type = unassigned DNA
cgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcg

SEQ ID NO: 228-230 - skipped (3 entries)

SEQ ID NO: 231 - DNA, 23 bp, Homo sapiens
  source 1..23: mol_type = unassigned DNA
cggtgtccgggggccgcctgtcg

SEQ ID NO: 232 - skipped

SEQ ID NO: 233 - DNA, 66 bp, Homo sapiens
  source 1..66: mol_type = unassigned DNA
cggccgtggcgggctccctggggcggcagctctaggcgcgggcgcgcagcagccccgaaggcgccg

SEQ ID NO: 234 - DNA, 43 bp, Homo sapiens
  source 1..43: mol_type = unassigned DNA
cgaacaaaaagagtccaggccgcgcgggcgggctgcgcgcccg

SEQ ID NO: 235 - skipped

SEQ ID NO: 236 - DNA, 62 bp, Homo sapiens
  source 1..62: mol_type = unassigned DNA
cgcccagatgcggcggcggcgacggctccagctgcgcctcgtggccatcctcgtgcagcgcg

SEQ ID NO: 237 - skipped

SEQ ID NO: 238 - DNA, 138 bp, Homo sapiens
  source 1..138: mol_type = unassigned DNA
cgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcg

SEQ ID NO: 239-242 - skipped (4 entries)

SEQ ID NO: 243 - DNA, 187 bp, Homo sapiens
  source 1..187: mol_type = unassigned DNA
cggcagaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcg

SEQ ID NO: 244-245 - skipped (2 entries)

SEQ ID NO: 246 - DNA, 110 bp, Homo sapiens
  source 1..110: mol_type = unassigned DNA
cgcggcgtgcagctcggcggatgctgccaggtcaggcgactccgccgcccctggagcgcgagcgcgcttcagcttgtagcgatgattctggaaccagatcttgacctgcg

SEQ ID NO: 247 - skipped

SEQ ID NO: 248 - DNA, 189 bp, Homo sapiens
  source 1..189: mol_type = unassigned DNA
cgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacg

SEQ ID NO: 249 - DNA, 42 bp, Homo sapiens
  source 1..42: mol_type = unassigned DNA
cgctgaaggtgggtggaacgagggcgcttgagtgcactcgcg

SEQ ID NO: 250 - DNA, 33 bp, Homo sapiens
  source 1..33: mol_type = unassigned DNA
cgcgcgggggcttcaggcactttgcgctccacg

SEQ ID NO: 251 - DNA, 15 bp, Homo sapiens
  source 1..15: mol_type = unassigned DNA
cgcgccagccgaacg

SEQ ID NO: 252 - DNA, 51 bp, Homo sapiens
  source 1..51: mol_type = unassigned DNA
cgctgggacagagctgcctgctggagctgccgcagatcgccgtggtgggcg

SEQ ID NO: 253 - skipped

SEQ ID NO: 254 - DNA, 268 bp, Homo sapiens
  source 1..268: mol_type = unassigned DNA
cggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggccgtttcccatcttcg

SEQ ID NO: 255 - skipped

SEQ ID NO: 256 - DNA, 33 bp, Homo sapiens
  source 1..33: mol_type = unassigned DNA
cggagcccccaggagcagtcagaccgatcaccg

SEQ ID NO: 257 - DNA, 23 bp, Homo sapiens
  source 1..23: mol_type = unassigned DNA
cgcccactagcccgagactttcg

SEQ ID NO: 258 - DNA, 40 bp, Homo sapiens
  source 1..40: mol_type = unassigned DNA
cgccccgacccgacgcctccccgcccgaccaggtgcctcg

SEQ ID NO: 259 - DNA, 10 bp, Homo sapiens
  source 1..10: mol_type = unassigned DNA
cgcggctccg

SEQ ID NO: 260 - DNA, 181 bp, Homo sapiens
  source 1..181: mol_type = unassigned DNA
cggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcg

SEQ ID NO: 261 - DNA, 195 bp, Homo sapiens
  source 1..195: mol_type = unassigned DNA
cgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacg

SEQ ID NO: 262 - skipped

SEQ ID NO: 263 - DNA, 358 bp, Homo sapiens
  source 1..358: mol_type = unassigned DNA
cggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcg

SEQ ID NO: 264 - DNA, 13 bp, Homo sapiens
  source 1..13: mol_type = unassigned DNA
cgcagttgtggcg

SEQ ID NO: 265-266 - skipped (2 entries)

SEQ ID NO: 267 - DNA, 95 bp, Homo sapiens
  source 1..95: mol_type = unassigned DNA
cgcgcggggtcacctgaaggttggggcgcggaagctcaactccgtgctgattgggctccaagttttctgcgccctcgcctcgtcccgagtgcccg

SEQ ID NO: 268 - DNA, 45 bp, Homo sapiens
  source 1..45: mol_type = unassigned DNA
cggcagcaggttggagcgcaccgtgcgcgtcctgccctctcggcg

SEQ ID NO: 269 - DNA, 104 bp, Homo sapiens
  source 1..104: mol_type = unassigned DNA
cggctgagtcggagcccacgcggcgcgcgcctcccgcgaggaacttttcggcttgtaggctgcttgtcactctcgctttccgacgcgcctccccctggctcgcg

SEQ ID NO: 270 - DNA, 87 bp, Homo sapiens
  source 1..87: mol_type = unassigned DNA
cgctttcgcccccgctgacactttgcaaagccgcggcggcagcggcggggaccacgctgcggtgcaccaccttccgccaccctcccg

SEQ ID NO: 271 - DNA, 62 bp, Homo sapiens
  source 1..62: mol_type = unassigned DNA
cgacagtttgcgagcctcggctgcaagtggcctctcctccccgcggttgttgttcagtgtcg

SEQ ID NO: 272-279 - skipped (8 entries)

SEQ ID NO: 280 - DNA, 145 bp, Homo sapiens
  source 1..145: mol_type = unassigned DNA
cgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccg

SEQ ID NO: 281 - skipped

SEQ ID NO: 282 - DNA, 19 bp, Homo sapiens
  source 1..19: mol_type = unassigned DNA
cgcccaccgccaggagccg

SEQ ID NO: 283 - DNA, 35 bp, Homo sapiens
  source 1..35: mol_type = unassigned DNA
cggcggcggcggcggccccattagcggagcctccg

SEQ ID NO: 284-285 - skipped (2 entries)

SEQ ID NO: 286 - DNA, 36 bp, Homo sapiens
  source 1..36: mol_type = unassigned DNA
cgagctggcgctggtccgctggctgcaggagagccg

SEQ ID NO: 287 - skipped

SEQ ID NO: 288 - DNA, 42 bp, Homo sapiens
  source 1..42: mol_type = unassigned DNA
cggctgagccttcgcctgcctaatcccatttgccattgtacg

SEQ ID NO: 289-290 - skipped (2 entries)

SEQ ID NO: 291 - DNA, 18 bp, Homo sapiens
  source 1..18: mol_type = unassigned DNA
cgcgcagcgcccgcgccg

SEQ ID NO: 292-294 - skipped (3 entries)

SEQ ID NO: 295 - DNA, 118 bp, Homo sapiens
  source 1..118: mol_type = unassigned DNA
cgtgccagaccccggctccgcgacccaggtgagtgccgccaccgccgcctggagggacctaagggccctgggctgggacttggggccgcaccggggcctgaggcagaacagcgacgcg

SEQ ID NO: 296 - DNA, 22 bp, Homo sapiens
  source 1..22: mol_type = unassigned DNA
cgaaccgcgggcggcgcggacg

SEQ ID NO: 297-300 - skipped (4 entries)

SEQ ID NO: 301 - DNA, 31 bp, Homo sapiens
  source 1..31: mol_type = unassigned DNA
cgacaagagctcggtgctgagatgtgttacg

SEQ ID NO: 302-310 - skipped (9 entries)

SEQ ID NO: 311 - DNA, 69 bp, Homo sapiens
  source 1..69: mol_type = unassigned DNA
cgctaggggcggccagcggccgtttggctggcgtgtcggcggcgctcggggagggcgggccggggggcg

SEQ ID NO: 312 - DNA, 415 bp, Homo sapiens
  source 1..415: mol_type = unassigned DNA
cgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcg

SEQ ID NO: 313-317 - skipped (5 entries)

SEQ ID NO: 318 - DNA, 62 bp, Homo sapiens
  source 1..62: mol_type = unassigned DNA
cgcgcccgccgctagctcgcacagcgcctcgcacactcccgcacgcgcttgaaatgcgcacg

SEQ ID NO: 319-322 - skipped (4 entries)

SEQ ID NO: 323 - DNA, 20 bp, Homo sapiens
  source 1..20: mol_type = unassigned DNA
cgcaaacgcaaaagcctccg

SEQ ID NO: 324 - DNA, 69 bp, Homo sapiens
  source 1..69: mol_type = unassigned DNA
cgccccctggggcccctggctgccgagtcccgctaaggcaaagacgccagcaagcgaggaagcgcagcg

SEQ ID NO: 325 - skipped

SEQ ID NO: 326 - DNA, 318 bp, Homo sapiens
  source 1..318: mol_type = unassigned DNA
cgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcg

SEQ ID NO: 327 - DNA, 27 bp, Homo sapiens
  source 1..27: mol_type = unassigned DNA
cgtggtggctccccgagcggaggcgcg

SEQ ID NO: 328 - skipped

SEQ ID NO: 329 - DNA, 13 bp, Homo sapiens
  source 1..13: mol_type = unassigned DNA
cgagctccccgcg

SEQ ID NO: 330 - DNA, 189 bp, Homo sapiens
  source 1..189: mol_type = unassigned DNA
cggtgacgatgtgcagagccttctggcacagactgttcactccgtcctccttgtggaaactcatcgtttggcttttctttcgttttctctttttttcccagttagccgtcttttcctcttcccgtacctctaacccctctggcgccctaagccatagtccgcccgcggtgactttggctggagattgcg

SEQ ID NO: 331-332 - skipped (2 entries)

SEQ ID NO: 333 - DNA, 13 bp, Homo sapiens
  source 1..13: mol_type = unassigned DNA
cgggggctgagcg

SEQ ID NO: 334 - DNA, 51 bp, Homo sapiens
  source 1..51: mol_type = unassigned DNA
cggcgtgtgccgtgcgtggggtggggtgcgggctgggcggcctcgccttcg

SEQ ID NO: 335 - DNA, 289 bp, Homo sapiens
  source 1..289: mol_type = unassigned DNA
cgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccg

SEQ ID NO: 336 - skipped

SEQ ID NO: 337 - DNA, 165 bp, Homo sapiens
  source 1..165: mol_type = unassigned DNA
cggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcg

SEQ ID NO: 338 - DNA, 21 bp, Homo sapiens
  source 1..21: mol_type = unassigned DNA
cgccgcccctgcaccacttcg

SEQ ID NO: 339-341 - skipped (3 entries)

SEQ ID NO: 342 - DNA, 159 bp, Homo sapiens
  source 1..159: mol_type = unassigned DNA
cggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacg

SEQ ID NO: 343 - skipped

SEQ ID NO: 344 - DNA, 129 bp, Homo sapiens
  source 1..129: mol_type = unassigned DNA
cggggggcggaattcagagaggtaaagtgacccgcccccaaatcgcaataccaggaggacagcagggctagatggaatctttcggttcacagtccccgacctcgggcaagtgccccactcgggcgcacg

SEQ ID NO: 345 - skipped

SEQ ID NO: 346 - DNA, 120 bp, Homo sapiens
  source 1..120: mol_type = unassigned DNA
cgctggagatggcgagctccgagactccctctatcttctgttttcagagcaactctatggtaccaaaaaaaaaaaaaaaaaaaaaaaaaaaaaaaaaaaaaaaaaaagaaggagaaggcg

SEQ ID NO: 347 - skipped

SEQ ID NO: 348 - DNA, 171 bp, Homo sapiens
  source 1..171: mol_type = unassigned DNA
cgcggacgctgacgatctcctccacgtccgacaagtcctcgttctcgtcgtatcgctggcggtcaatcgggcgctgcgaggacccaaaccagagagcccgggacattattgtgggggctggaggtcgcctctcaacctgggcccagcactaacaggtgcagcagccgagcg

SEQ ID NO: 349-351 - skipped (3 entries)

SEQ ID NO: 352 - DNA, 64 bp, Homo sapiens
  source 1..64: mol_type = unassigned DNA
cggcaggtgagcggcgcggctgcaggtgagcagcagcctcggctcgcgcgcccagctttccccg

SEQ ID NO: 353-356 - skipped (4 entries)

SEQ ID NO: 357 - DNA, 16 bp, Homo sapiens
  source 1..16: mol_type = unassigned DNA
cgctccgcagggctcg

SEQ ID NO: 358-360 - skipped (3 entries)

SEQ ID NO: 361 - DNA, 18 bp, Homo sapiens
  source 1..18: mol_type = unassigned DNA
cgcattccctcggccgcg

SEQ ID NO: 362 - DNA, 118 bp, Homo sapiens
  source 1..118: mol_type = unassigned DNA
cgggcggatgggggtcaccgaggcggctcgtctccaggcgcacacttcgcacatctctttgctaagtgaaggggccaaaatgcacagatgggggagtctacccaggaacagaggcgcg

SEQ ID NO: 363-367 - skipped (5 entries)

SEQ ID NO: 368 - DNA, 22 bp, Homo sapiens
  source 1..22: mol_type = unassigned DNA
cgcgccgccccagaggagtccg

SEQ ID NO: 369 - DNA, 112 bp, Homo sapiens
  source 1..112: mol_type = unassigned DNA
cgggagcgcacgagtgtgtgtgtgtgtgtgtgtgttcgcggtgtgcccgcggctcggtgcacacgcgcgcgggttgtaaagtcaggagctgcgggagcgcctccctgcctcg

SEQ ID NO: 370 - DNA, 109 bp, Homo sapiens
  source 1..109: mol_type = unassigned DNA
cgctctgcctgggctgggcccacttacgttctgggtggggctcaggaactgcgtgcgggcgtagcgggtgagcatgctgatgatgaccacctggccccactcctccacg

SEQ ID NO: 371-373 - skipped (3 entries)

SEQ ID NO: 374 - DNA, 431 bp, Homo sapiens
  source 1..431: mol_type = unassigned DNA
cgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacg

SEQ ID NO: 375 - skipped

SEQ ID NO: 376 - DNA, 40 bp, Homo sapiens
  source 1..40: mol_type = unassigned DNA
cgccgcgccccgctgtagctccgctggagagatggggacg

SEQ ID NO: 377 - skipped

SEQ ID NO: 378 - DNA, 22 bp, Homo sapiens
  source 1..22: mol_type = unassigned DNA
cgccagcaggttcagggccacg

SEQ ID NO: 379 - skipped

SEQ ID NO: 380 - DNA, 47 bp, Homo sapiens
  source 1..47: mol_type = unassigned DNA
cgggcatcttgcattgcacgcagtacatgctgtggttctccagctcg

SEQ ID NO: 381 - DNA, 24 bp, Homo sapiens
  source 1..24: mol_type = unassigned DNA
cgccgttgggggacttctggcacg

SEQ ID NO: 382 - skipped

SEQ ID NO: 383 - DNA, 45 bp, Homo sapiens
  source 1..45: mol_type = unassigned DNA
cgggactccaggcccacccagcaagctaattggctgaggccctcg

SEQ ID NO: 384 - skipped

SEQ ID NO: 385 - DNA, 258 bp, Homo sapiens
  source 1..258: mol_type = unassigned DNA
cgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcg

SEQ ID NO: 386 - DNA, 45 bp, Homo sapiens
  source 1..45: mol_type = unassigned DNA
cgccctggcggctccgagggacctgggctcgggcttgcggtcgcg

SEQ ID NO: 387-388 - skipped (2 entries)

SEQ ID NO: 389 - DNA, 67 bp, Homo sapiens
  source 1..67: mol_type = unassigned DNA
cggggcgccaacagctcaggacttgggttgcaggctggttcttgcaccaaccagcggggcggcctcg

SEQ ID NO: 390 - DNA, 43 bp, Homo sapiens
  source 1..43: mol_type = unassigned DNA
cggctgacccgcagcggcagcggcagcagcgaggactcgagcg

SEQ ID NO: 391-392 - skipped (2 entries)

SEQ ID NO: 393 - DNA, 113 bp, Homo sapiens
  source 1..113: mol_type = unassigned DNA
cgtgtgtttagctgaattcagtatatttttctcgcacttctcgcttttttttttttctttctgaatctgctcttctgctttgcgggcccctaatctctcccgaatctcgggcg

SEQ ID NO: 394-395 - skipped (2 entries)

SEQ ID NO: 396 - DNA, 84 bp, Homo sapiens
  source 1..84: mol_type = unassigned DNA
cgctgcgcgccgcctccgcggagccgagcggcggtggctgcggaagcgactggggctgcgcggacaccagcgccccagagcccg

SEQ ID NO: 397 - skipped

SEQ ID NO: 398 - DNA, 48 bp, Homo sapiens
  source 1..48: mol_type = unassigned DNA
cgcgcttcatcttgtagcggtggttctggaaccagatcttgacctgcg

SEQ ID NO: 399 - DNA, 228 bp, Homo sapiens
  source 1..228: mol_type = unassigned DNA
cgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcg

SEQ ID NO: 400 - DNA, 47 bp, Homo sapiens
  source 1..47: mol_type = unassigned DNA
cgcaccttggccgtaacaagcgcgctccacgccgccacgcaccagcg

SEQ ID NO: 401 - DNA, 185 bp, Homo sapiens
  source 1..185: mol_type = unassigned DNA
cgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcg

SEQ ID NO: 402 - DNA, 216 bp, Homo sapiens
  source 1..216: mol_type = unassigned DNA
cgggggcgctaatcccgggagcaggaggccgggctccagccgccgggccttgcgcgcctgcttcttgcggcgcggccggtacttgtagttggggtggtcgcgcaagtgctgcacgcgcagccgttcggcttcctccacgaagggccgcttctccgccgcgttcagctccttccacgctttgcctgcgggccgtgggcgccagtgagtggaacgccg

SEQ ID NO: 403 - DNA, 344 bp, Homo sapiens
  source 1..344: mol_type = unassigned DNA
cgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcg

SEQ ID NO: 404 - DNA, 28 bp, Homo sapiens
  source 1..28: mol_type = unassigned DNA
cgttctgtttggcagccaggccgagacg

SEQ ID NO: 405 - DNA, 124 bp, Homo sapiens
  source 1..124: mol_type = unassigned DNA
cgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccg

SEQ ID NO: 406 - DNA, 80 bp, Homo sapiens
  source 1..80: mol_type = unassigned DNA
cgcccgccagggtcacgaagagcgcaacgaacgccagcagcacggcgctcacggtgagcgcccgcgccgcctgcacctcg

SEQ ID NO: 407 - DNA, 62 bp, Homo sapiens
  source 1..62: mol_type = unassigned DNA
cggacaggccccgcagtgagcaggtaagggtcgccccgccgcggctgcccctccacgcctcg

SEQ ID NO: 408 - DNA, 165 bp, Homo sapiens
  source 1..165: mol_type = unassigned DNA
cgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcg

SEQ ID NO: 409 - DNA, 43 bp, Homo sapiens
  source 1..43: mol_type = unassigned DNA
cgtccctgtgcttctggtggttccggcgcttcctcggagcgcg

SEQ ID NO: 410 - DNA, 86 bp, Homo sapiens
  source 1..86: mol_type = unassigned DNA
cgccgccgccttcgccgggagccaagcccgccgggccggcccggtcccaggtgggcagctcggcttgcagctggttggaggtggcg

SEQ ID NO: 411 - DNA, 23 bp, Homo sapiens
  source 1..23: mol_type = unassigned DNA
cgagcccgtgggataagggggcg

SEQ ID NO: 412 - skipped

SEQ ID NO: 413 - DNA, 99 bp, Homo sapiens
  source 1..99: mol_type = unassigned DNA
cgcggccatgcaattggtggatttttttaaaccgttttggaggggggagcgcggcgttgggggcgggagagcgctcctggctgtgagctgctcctgccg

SEQ ID NO: 414 - DNA, 73 bp, Homo sapiens
  source 1..73: mol_type = unassigned DNA
cgtggaactcgtgagccccacgcaacgcctccctgccgcccagggtgggctcctagaagcacagaaatggtcg

SEQ ID NO: 415 - skipped

SEQ ID NO: 416 - DNA, 52 bp, Homo sapiens
  source 1..52: mol_type = unassigned DNA
cggggcgggcagggaccgagtcaggagagagcgggcgggggtcctgggagcg

SEQ ID NO: 417 - DNA, 50 bp, Homo sapiens
  source 1..50: mol_type = unassigned DNA
cgcgagcaggagggcgcactccatggtcaggtgcggacgcggcggctgcg

SEQ ID NO: 418 - DNA, 50 bp, Homo sapiens
  source 1..50: mol_type = unassigned DNA
cgggtcggggcatcacaggcgcgggaatccacgtgtggactctgcgttcg

SEQ ID NO: 419-420 - skipped (2 entries)

SEQ ID NO: 421 - DNA, 52 bp, Homo sapiens
  source 1..52: mol_type = unassigned DNA
cggggtagcgcaggagcaggcaggggctcgcggctcgcgtgggccccaggcg

SEQ ID NO: 422-424 - skipped (3 entries)

SEQ ID NO: 425 - DNA, 138 bp, Homo sapiens
  source 1..138: mol_type = unassigned DNA
cgagtggcagcagcaggagcggggtgacgaacaagatcacgaaggacttgaacttggagacatagctcagcgccgaggccatcgcgcgggagggagactggcgggcgagacgagtgaggggcagctagaggcgccgcg

SEQ ID NO: 426-428 - skipped (3 entries)

SEQ ID NO: 429 - DNA, 1017 bp, Homo sapiens
  source 1..1017: mol_type = unassigned DNA
cgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccg

SEQ ID NO: 430 - DNA, 166 bp, Homo sapiens
  source 1..166: mol_type = unassigned DNA
cgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcg

SEQ ID NO: 431-436 - skipped (6 entries)

SEQ ID NO: 437 - DNA, 14 bp, Homo sapiens
  source 1..14: mol_type = unassigned DNA
cgcgctgagacgcg

SEQ ID NO: 438-440 - skipped (3 entries)

SEQ ID NO: 441 - DNA, 125 bp, Homo sapiens
  source 1..125: mol_type = unassigned DNA
cgtcccgcgccctcgccccgccatgctcctgctgctggggctgtgcctggggctgtccctgtgtgtggggtcgcaggaagaggcgcagagctggggccactcttcggagcaggtaagtggagccg

SEQ ID NO: 442 - skipped

SEQ ID NO: 443 - DNA, 131 bp, Homo sapiens
  source 1..131: mol_type = unassigned DNA
cgtgcgcagcccagcccctcccggacgtcctcgcccccgcccgggcacatcgtgctccgcaccgaggcagagaggggcacgcggatcccagcccctgcgagcccctctgcccgccgccacttcacaccccg

SEQ ID NO: 444 - DNA, 94 bp, Homo sapiens
  source 1..94: mol_type = unassigned DNA
cgggccgcgtgggtttgggcgcgccgtggtgggcaagcggggccagcggagcgggaacccgcacaccctccgagcggagccgaggacaggcccg

SEQ ID NO: 445-446 - skipped (2 entries)

SEQ ID NO: 447 - DNA, 27 bp, Homo sapiens
  source 1..27: mol_type = unassigned DNA
cgcgcaagtattcccctccccatcgcg

SEQ ID NO: 448 - DNA, 164 bp, Homo sapiens
  source 1..164: mol_type = unassigned DNA
cgcgattctcctcgggaggtgtctgcgaaggcggctctgccgcggtgggggtggggaggctagggcttcggaccgctggagttggggtcgcagccagttcctggcgagtgtttcctggctgctgccgcaggggcttgctttttcggatttcccctctaatctcg

SEQ ID NO: 449-450 - skipped (2 entries)

SEQ ID NO: 451 - DNA, 68 bp, Homo sapiens
  source 1..68: mol_type = unassigned DNA
cgcatctgaaaattccgccgcagccacctccctcccatgggaaagccccgacctcggcgggcccagcg

SEQ ID NO: 452 - DNA, 508 bp, Homo sapiens
  source 1..508: mol_type = unassigned DNA
cgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccg

SEQ ID NO: 453-462 - skipped (10 entries)

SEQ ID NO: 463 - DNA, 396 bp, Homo sapiens
  source 1..396: mol_type = unassigned DNA
cgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcg

SEQ ID NO: 464 - skipped

SEQ ID NO: 465 - DNA, 70 bp, Homo sapiens
  source 1..70: mol_type = unassigned DNA
cgtgatttttccacttagagattatttagggagatgtcctggatgggacaagtagacaaatggcggcccg

SEQ ID NO: 466 - skipped

SEQ ID NO: 467 - DNA, 68 bp, Homo sapiens
  source 1..68: mol_type = unassigned DNA
cgggagcccggccgcgccctccagcctcggcacccgcgctcagcgcgccgcgccccgcgtcccccgcg

SEQ ID NO: 468 - DNA, 88 bp, Homo sapiens
  source 1..88: mol_type = unassigned DNA
cgccccgcgcaccgcccccgtcccagccttcagtggcgcggcgccccctcgcgacatccgcgggtccccaggagcgagccgaccctcg

SEQ ID NO: 469-470 - skipped (2 entries)

SEQ ID NO: 471 - DNA, 87 bp, Homo sapiens
  source 1..87: mol_type = unassigned DNA
cgggggcctcccaggccgcggcgcctcccgctttcccccactccccgacccttcttcgcccccaaaatgaggaaacggagcaactcg

SEQ ID NO: 472 - DNA, 45 bp, Homo sapiens
  source 1..45: mol_type = unassigned DNA
cgtggcaaacccgggctccgacgacagaggcagcgcagaagctcg

SEQ ID NO: 473 - skipped

SEQ ID NO: 474 - DNA, 173 bp, Homo sapiens
  source 1..173: mol_type = unassigned DNA
cgggccgtggctgacatcgcggagaagttaggactttcacagtctctgccagacttgaaagcaagctggaaatcgatagctgtttcagctgtttcagattctaatctggtttgggtttttccccctttcatttgaaaatagactcagggcaatgcttaagagaattccaaccg

SEQ ID NO: 475 - skipped

SEQ ID NO: 476 - DNA, 48 bp, Homo sapiens
  source 1..48: mol_type = unassigned DNA
cggggcctttgtctctggctgcagttggagctctgcgtctcgtcttcg

SEQ ID NO: 477-478 - skipped (2 entries)

SEQ ID NO: 479 - DNA, 36 bp, Homo sapiens
  source 1..36: mol_type = unassigned DNA
cggggcagagggggcgggaagctggcgccacggtcg

SEQ ID NO: 480-484 - skipped (5 entries)

SEQ ID NO: 485 - DNA, 97 bp, Homo sapiens
  source 1..97: mol_type = unassigned DNA
cgacccgggagggaaaacccctgcctcttcccggggcttgctctgcccgtcctttaaactcgccctacaccctccccgactcccgtccttgcaagcg

SEQ ID NO: 486-487 - skipped (2 entries)

SEQ ID NO: 488 - DNA, 67 bp, Homo sapiens
  source 1..67: mol_type = unassigned DNA
cgatgcctgtgcttgtggttccctgaggcagtgggagtggcgtgtgaaggactgtgagagtctggcg

SEQ ID NO: 489 - skipped

SEQ ID NO: 490 - DNA, 29 bp, Homo sapiens
  source 1..29: mol_type = unassigned DNA
cgggtgactgctgaccctctgccctgtcg

SEQ ID NO: 491 - DNA, 49 bp, Homo sapiens
  source 1..49: mol_type = unassigned DNA
cgaggccccgcgcatcctcgtccgcgcttcagccacttaggctcggccg

SEQ ID NO: 492 - DNA, 188 bp, Homo sapiens
  source 1..188: mol_type = unassigned DNA
cgtccactgaaaacctccagttggtgctggagcggcggcgtgtggccaacgccaaggagcgtgagcgggtgagggatccctagggtcgacgtccgttccccccttccctgctctaccaccaaacacctggtcaacacccgggggtccgctcaccgcccacccccgctcgaggcgacttcgagctcccg

SEQ ID NO: 493-494 - skipped (2 entries)

SEQ ID NO: 495 - DNA, 113 bp, Homo sapiens
  source 1..113: mol_type = unassigned DNA
cgcgggtgaaggcggagccgcagggttggcccccaaagggatgctctcgcccgagcggcgagaccagccccgctcgcccctcgccgcggccgcgccgcagccgcccacggccg

SEQ ID NO: 496 - DNA, 208 bp, Homo sapiens
  source 1..208: mol_type = unassigned DNA
cgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccg

SEQ ID NO: 497 - DNA, 96 bp, Homo sapiens
  source 1..96: mol_type = unassigned DNA
cgcatccccccgcactcggcgccgccgcctcgccgctctctcccgcttgcagggccgccccgggcaccccagggctgctgaggggcgggcgggccg

SEQ ID NO: 498 - DNA, 236 bp, Homo sapiens
  source 1..236: mol_type = unassigned DNA
cgcgtggaggctgcgcgtaggggtccgggacgcgggacagggactccgcgcagcccaggcgccggggaaccggggctggagtcggggatctgagcccagcggacgcctcctccgcctggaggcccggcacggaccgggacaccagggcgtccgtggccgtggctcggcccctggctgctgcgggccgcggcctccagtgggtccccaggacccttccccacggcgggtactcaccg

SEQ ID NO: 499 - DNA, 211 bp, Homo sapiens
  source 1..211: mol_type = unassigned DNA
cgccgcccgcgttccctgcccttcacttcccaacccctgcgtggccccagggtccacattcctggagttttcctccccagtaaatagtgctgtcccccacttaacagcagaggcgcccaggagttcaggcgatgtgtccaaggccgaacagagggacagcagtgagctgctcaacctttccagctgcgcagccaggacacggctgggggcg

SEQ ID NO: 500 - DNA, 193 bp, Homo sapiens
  source 1..193: mol_type = unassigned DNA
cgcgggggaccccaggtcgggacggagcctcctctggctcgctgtgcgcgcacgcctggaaaggcgggatttaaggcagcgatgctgcgggaggctctgcagtgtcaacgagcccccgaacggttccgcctcattccctctctgtgtgcctcgcaagtctctgcttagtaaaccgtcacagcttcggcgcgcg

SEQ ID NO: 501 - skipped

SEQ ID NO: 502 - DNA, 199 bp, Homo sapiens
  source 1..199: mol_type = unassigned DNA
cgcaataaatctccgtagacaccgcatctccaatgcggtgtccctctgtgtcagtgccccggcggctcttgcagggtgccaatgttacggctgtacaccgcttttccctcccatcatcctcacctgaacagacctggaggaggcggaaatggaaattagggcatgtccacaagctggattcgttagatcctcctgctcg

SEQ ID NO: 503 - DNA, 87 bp, Homo sapiens
  source 1..87: mol_type = unassigned DNA
cgcggccgctacgcctcgctccctgcattcagtctccttggcgtctccgctgcagcatccaagaccaggcgccgcctctgctagccg

SEQ ID NO: 504 - DNA, 68 bp, Homo sapiens
  source 1..68: mol_type = unassigned DNA
cgtaaactgattatgaaacatacgatgttaattcggagctgcatttcccagctgggcactctcgcgcg

SEQ ID NO: 505 - DNA, 61 bp, Homo sapiens
  source 1..61: mol_type = unassigned DNA
cggtgaaaactagtctgtggtgcattgagatttgcaaaccattccctgaatgccaggggcg

SEQ ID NO: 506 - DNA, 40 bp, Homo sapiens
  source 1..40: mol_type = unassigned DNA
cggatcggcggcagcagaagcggcagcggcaaagcacccg

SEQ ID NO: 507 - DNA, 647 bp, Homo sapiens
  source 1..647: mol_type = unassigned DNA
cggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcg

SEQ ID NO: 508 - DNA, 327 bp, Homo sapiens
  source 1..327: mol_type = unassigned DNA
cgaggcgcgggctgagccctcagcacctggcctgagcggcgtgggcagcagcctgcaccgcggacacctccaactctgccgcgtctgcgccgcactctggccgtggcagcgattttccgggcatctctgaggccgcccttagtcccacaagcacttagccgcccatttcagagcagcggcgccgaccgttttaagaggagtcagttcccgacaccgcctcccacttacttctccacatttccaccgctggagggggtgagtgccgtggacaggcgctcccgtccggggacagctcagcggcggcagtcagcccgaccctcctccgcg

SEQ ID NO: 509 - skipped

SEQ ID NO: 510 - DNA, 324 bp, Homo sapiens
  source 1..324: mol_type = unassigned DNA
cgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcg

SEQ ID NO: 511 - DNA, 77 bp, Homo sapiens
  source 1..77: mol_type = unassigned DNA
cgcctcgccgtgcccgatgggtgcgcttctagcgctgccgccgcggcgctcggcctcgggttcccgccgctgcgccg

SEQ ID NO: 512 - DNA, 158 bp, Homo sapiens
  source 1..158: mol_type = unassigned DNA
cgctcccaccccggcacagacagccctcaaagttgtccgtactccccagacctcgccttctgctcagcccccggaccccgcccaggggttgagttgacgtccgcgggtggacctctctggtccgctgcgcagggaactgacttcgggaatccagggcg

SEQ ID NO: 513 - DNA, 79 bp, Homo sapiens
  source 1..79: mol_type = unassigned DNA
cgcgcgctccgcgctcctggcggtcgcagcgctgcctattaattgattctcttattgatttatttaatttttaggagcg

SEQ ID NO: 514 - DNA, 137 bp, Homo sapiens
  source 1..137: mol_type = unassigned DNA
cgccctggagcggtgggaggacgcggagcgccgttctctggcttccgacaccctgcccgccctctctagtgggtctgtggctgcgccctctcgaaggaagtaataaatctttctgaccttgggggtcagaggagacg

SEQ ID NO: 515 - DNA, 112 bp, Homo sapiens
  source 1..112: mol_type = unassigned DNA
cgctgcggcacccagcggcccatcggggttgcactgctgcagcggctccttgtgccacttgtagtccaggaggttgagcatagtgagcaccagcagcagtgcatagcccgcg

SEQ ID NO: 516-517 - skipped (2 entries)

SEQ ID NO: 518 - DNA, 282 bp, Homo sapiens
  source 1..282: mol_type = unassigned DNA
cggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacg

SEQ ID NO: 519 - DNA, 81 bp, Homo sapiens
  source 1..81: mol_type = unassigned DNA
cggcgcggcggcggggggcgccccgcaagcccgcggctctgagcggccacccgcgcagcaagttgggcgagttggcagccg

SEQ ID NO: 520 - DNA, 53 bp, Homo sapiens
  source 1..53: mol_type = unassigned DNA
cgcggcttttgccttttgcgccagcgtgagctcggttagggtctccacggccg

SEQ ID NO: 521 - DNA, 40 bp, Homo sapiens
  source 1..40: mol_type = unassigned DNA
cggcgccagctcacgtccccgctggcgccccctcggcgcg

SEQ ID NO: 522 - DNA, 206 bp, Homo sapiens
  source 1..206: mol_type = unassigned DNA
cggccgacccacctggtgtcgcgtgcgctggcggcccgcgcggcagccaagccaaaggccgaggccgaggccgagcgcggcgcccagcagcacggcgggggccagcagggcgggcgccggccgcagcgcgtcccgccccagcagcagccgcgcgtcgctcttgcaggccgccccgccgcgggccatccggggcgctcaggctgccg

SEQ ID NO: 523 - DNA, 38 bp, Homo sapiens
  source 1..38: mol_type = unassigned DNA
cgctgctgctgcgcggggcggcggccgccgtgccctcg

SEQ ID NO: 524 - skipped

SEQ ID NO: 525 - DNA, 25 bp, Homo sapiens
  source 1..25: mol_type = unassigned DNA
cgtgtgtacgcgttgcattcgctcg

SEQ ID NO: 526 - DNA, 79 bp, Homo sapiens
  source 1..79: mol_type = unassigned DNA
cgctccttttccttcttctttcctattaaatattatttgggaattgtttaaattttttttttaaaaaaagagagaggcg

SEQ ID NO: 527 - DNA, 33 bp, Homo sapiens
  source 1..33: mol_type = unassigned DNA
cggccccgcgtggcgcctcggccgttgccctcg

SEQ ID NO: 528 - DNA, 132 bp, Homo sapiens
  source 1..132: mol_type = unassigned DNA
cggcgggcggcggcggcgcggagctgcacacggagaagacggagtgcgggcgctacggagagcactcgcccaagcaggacgcccgcggggaggtggtcatggccagctcggcccacgaccgcctggcctgcg

SEQ ID NO: 529 - DNA, 32 bp, Homo sapiens
  source 1..32: mol_type = unassigned DNA
cgcctggcaccccctcctctgccccgagggcg

SEQ ID NO: 530-531 - skipped (2 entries)

SEQ ID NO: 532 - DNA, 20 bp, Homo sapiens
  source 1..20: mol_type = unassigned DNA
cgagtatgccagcggcgccg

SEQ ID NO: 533 - DNA, 85 bp, Homo sapiens
  source 1..85: mol_type = unassigned DNA
cggcacgctccctccctcggccgctttctctcacataagcgcaggcagagggcgcgtcagtcatgccctgcccctgcgcccgccg

SEQ ID NO: 534 - DNA, 230 bp, Homo sapiens
  source 1..230: mol_type = unassigned DNA
cggccccgcgaaactcggccctccagctcgcgggacgcgctgcctgccaggcgggcccggcggtacctcgggggcgggaggggtcggtcgcagggcccccagcctggcgcccgcggggcgtccgcagcgaaggggtgggtgtcgctcgtgaacgcagcagggaccagctcagcccgcgctcgcccctgggcctcggccaccgcctctccgccactttctcggcccctgcg

SEQ ID NO: 535 - DNA, 84 bp, Homo sapiens
  source 1..84: mol_type = unassigned DNA
cgggccgccagtctcagggtgtcgggctccaactaaggccccgaagcccccacgcacctgagggcattttgaccagctcttgcg

SEQ ID NO: 536 - DNA, 42 bp, Homo sapiens
  source 1..42: mol_type = unassigned DNA
cgcgatccctttttgactcagccaaacggaaaagctcgcgcg

SEQ ID NO: 537 - DNA, 45 bp, Homo sapiens
  source 1..45: mol_type = unassigned DNA
cgccgtgctcctcctcgtcctcgaaagggtagaaagagtcgtccg

SEQ ID NO: 538 - DNA, 26 bp, Homo sapiens
  source 1..26: mol_type = unassigned DNA
cgcccgccagcatcccttgtcccgcg

SEQ ID NO: 539 - DNA, 50 bp, Homo sapiens
  source 1..50: mol_type = unassigned DNA
cgaggtttaggtggaggctgaggctgccgcgcgccgcgggaggagcctcg

SEQ ID NO: 540 - DNA, 56 bp, Homo sapiens
  source 1..56: mol_type = unassigned DNA
cgcttctgagccagggacgcgcgtggggggtgggcgtgcacgcgggtgggccagcg

SEQ ID NO: 541 - DNA, 44 bp, Homo sapiens
  source 1..44: mol_type = unassigned DNA
cgtcctcaccgcgcacgcgctcccctcgcgcgcgcacacgctcg

SEQ ID NO: 542-543 - skipped (2 entries)

SEQ ID NO: 544 - DNA, 58 bp, Homo sapiens
  source 1..58: mol_type = unassigned DNA
cgcggggcagctgctcaagtggatcgacaccaccgcctgcctggcgggtaggcgggcg

SEQ ID NO: 545 - DNA, 151 bp, Homo sapiens
  source 1..151: mol_type = unassigned DNA
cggtagaagacagcgtccccaggaccagcgactctgtggctcactcggccactgggtctcggcgcaaaccctccctaggcagtgcgggcgatgctgactgcagacgtcgggcagggctttcgtgcgggcgggagcgggggaagccagtgcg

SEQ ID NO: 546 - DNA, 17 bp, Homo sapiens
  source 1..17: mol_type = unassigned DNA
cggactccccaggaccg

SEQ ID NO: 547 - DNA, 70 bp, Homo sapiens
  source 1..70: mol_type = unassigned DNA
cgcccgctgctccccgctgcgtccagggatggagggccccaccacccatggaattgctggcccctctgcg

SEQ ID NO: 548 - DNA, 59 bp, Homo sapiens
  source 1..59: mol_type = unassigned DNA
cgtccctgagatttcgctgagaaactttcagcgggttagcgcttgggcgctgggcgccg

SEQ ID NO: 549 - DNA, 25 bp, Homo sapiens
  source 1..25: mol_type = unassigned DNA
cgctgggtaacctctatccgagccg

SEQ ID NO: 550 - DNA, 57 bp, Homo sapiens
  source 1..57: mol_type = unassigned DNA
cggcgctgacgctctggccctgggggctgcctggctggtgtcaggtagcggaagacg

SEQ ID NO: 551 - DNA, 111 bp, Homo sapiens
  source 1..111: mol_type = unassigned DNA
cgagcagctccacgtcctgccaaggacggtaggtgcaagggtcgggggactctctgacggggtcgtcccttcgggcacggggaggttcccaccgagccccaaccctgaacg

SEQ ID NO: 552 - DNA, 211 bp, Homo sapiens
  source 1..211: mol_type = unassigned DNA
cgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcg

SEQ ID NO: 553 - DNA, 75 bp, Homo sapiens
  source 1..75: mol_type = unassigned DNA
cgcccccacgcgcgctgtcggtatttgcccgccttgctgcaacttgctgcagtgtttgaaagagtagtaggagcg

SEQ ID NO: 554 - skipped

SEQ ID NO: 555 - DNA, 66 bp, Homo sapiens
  source 1..66: mol_type = unassigned DNA
cgggcgctggagaaggcgcctggcgcgaagctgggcggcgccccgagggcggaggacaggtggccg

SEQ ID NO: 556 - skipped

SEQ ID NO: 557 - DNA, 163 bp, Homo sapiens
  source 1..163: mol_type = unassigned DNA
cggggcggcgggcgcatgcgcgtgcgcggtgcggccccagccctggctgccgccgcctgccgccgccgtcgcgatgcctattttagtcaaagcggctgcgggcttggggacccggcccgggcagcggagcttccggacccgccgacccgccgaggagcgcgcg

SEQ ID NO: 558 - DNA, 99 bp, Homo sapiens
  source 1..99: mol_type = unassigned DNA
cggagcaaagccagcgcgctccgcggctcggaatccagctggctcgctaccctcccactcctgcgattttactcccgaccgcgctccagggcagaagcg

SEQ ID NO: 559 - DNA, 96 bp, Homo sapiens
  source 1..96: mol_type = unassigned DNA
cggcggcggcggcagctccagccgcgcccgccacacataccttcactcgctcggtgcacacgccgcgccgcgggcagtgccgcctgcggaggcgcg

SEQ ID NO: 560 - skipped

SEQ ID NO: 561 - DNA, 16 bp, Homo sapiens
  source 1..16: mol_type = unassigned DNA
cgtgccaatctcgccg

SEQ ID NO: 562 - skipped

SEQ ID NO: 563 - DNA, 141 bp, Homo sapiens
  source 1..141: mol_type = unassigned DNA
cgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcg

SEQ ID NO: 564 - skipped

SEQ ID NO: 565 - DNA, 37 bp, Homo sapiens
  source 1..37: mol_type = unassigned DNA
cgaggtgttgcgggttttgtgcggttggttgggaacg

SEQ ID NO: 566 - DNA, 52 bp, Homo sapiens
  source 1..52: mol_type = unassigned DNA
cgaggcgtccccgctcccgccacccacacagggcgccaagtgccccgacccg

SEQ ID NO: 567-570 - skipped (4 entries)

SEQ ID NO: 571 - DNA, 17 bp, Homo sapiens
  source 1..17: mol_type = unassigned DNA
cgtcccgccccaactcg

SEQ ID NO: 572 - DNA, 136 bp, Homo sapiens
  source 1..136: mol_type = unassigned DNA
cgcggggggaggttcctggctcgccgtctccgctgccgcttgaccgcacttctggagggctccgcaccttgccaggtctctggaggcaaacacacacccccgattcataactggtccccgcgtcaggggactcgcg

SEQ ID NO: 573 - DNA, 31 bp, Homo sapiens
  source 1..31: mol_type = unassigned DNA
cggccagggagtgagcggggcgctgggcgcg

SEQ ID NO: 574 - DNA, 25 bp, Homo sapiens
  source 1..25: mol_type = unassigned DNA
cgccaaccagacctcagggtgcacg

SEQ ID NO: 575 - DNA, 12 bp, Homo sapiens
  source 1..12: mol_type = unassigned DNA
cgctcgtcaacg

SEQ ID NO: 576 - skipped

SEQ ID NO: 577 - DNA, 199 bp, Homo sapiens
  source 1..199: mol_type = unassigned DNA
cgcagcgtgtagccgcggaacagcgcctccagctctgggcaagcgaactcctcgtcgcacgcccggagcccgcgccggcggcttgtcccggccgcccgctcggcgcccccgggctcgcccgcgccgcctccgccgccgcctccgccgcgcggcgcccccgccatctcagcgccatgcagcggccgcggccgcgggcgcg

SEQ ID NO: 578 - DNA, 91 bp, Homo sapiens
  source 1..91: mol_type = unassigned DNA
cgtgggggcgcggcgcgggcgacacgtgcgggccgccaggagggggagggggacgcgcgccgccgggcccgccaccctgcacccggggccg

SEQ ID NO: 579 - DNA, 108 bp, Homo sapiens
  source 1..108: mol_type = unassigned DNA
cgtcctccctatggatctcccagtacctgcaggtcacaggataacagaagctatagtagagtcaccgaggaactccaggaacggaggagatggaacagtggagacgcg

SEQ ID NO: 580 - DNA, 13 bp, Homo sapiens
  source 1..13: mol_type = unassigned DNA
cgaaatcggtgcg

SEQ ID NO: 581 - DNA, 176 bp, Homo sapiens
  source 1..176: mol_type = unassigned DNA
cgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccg

SEQ ID NO: 582 - skipped

SEQ ID NO: 583 - DNA, 157 bp, Homo sapiens
  source 1..157: mol_type = unassigned DNA
cgggcgctttcccaggcctggccgaggggcgtcgcgcagaggcggcggcggcgcacggaggcggcagacgacgcgctctcggcgcccgcagccccggtcccgcgctcccgcggcccaaagtaactttgggagccgccgtctcccgcggaacttctcg

SEQ ID NO: 584 - DNA, 66 bp, Homo sapiens
  source 1..66: mol_type = unassigned DNA
cggccgcggcgggagggacagggggcctgggtgggaagggagcgcgagggcccctagcggttcgcg

SEQ ID NO: 585 - DNA, 498 bp, Homo sapiens
  source 1..498: mol_type = unassigned DNA
cgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcg

SEQ ID NO: 586 - DNA, 27 bp, Homo sapiens
  source 1..27: mol_type = unassigned DNA
cgagcgcgaagggcgttcggacccgcg

SEQ ID NO: 587-588 - skipped (2 entries)

SEQ ID NO: 589 - DNA, 16 bp, Homo sapiens
  source 1..16: mol_type = unassigned DNA
cgcgaggcaggcgacg

SEQ ID NO: 590 - DNA, 53 bp, Homo sapiens
  source 1..53: mol_type = unassigned DNA
cgccgcaagagaagctgtcaagccccgcaggctctgattcggcgccctccgcg

SEQ ID NO: 591-594 - skipped (4 entries)

SEQ ID NO: 595 - DNA, 14 bp, Homo sapiens
  source 1..14: mol_type = unassigned DNA
cgtaggtggacacg

SEQ ID NO: 596 - DNA, 186 bp, Homo sapiens
  source 1..186: mol_type = unassigned DNA
cgttatggagaaaattaatggaggaaaaattacagagtcacccgaaacagttgcgctgcttatcacccggtgtttgagcctgtttcccctgtaattagattacatgtgaggcagccccagctaattgtctgtgccacccaccggggaactccagctctatctgtgaacacccaggccttcccgccg

SEQ ID NO: 597 - DNA, 79 bp, Homo sapiens
  source 1..79: mol_type = unassigned DNA
cgcgtactttctccaccccgacacccactgccactcccacagcggagcgaggggccccgccgagggcgagcgtaccccg

SEQ ID NO: 598 - DNA, 49 bp, Homo sapiens
  source 1..49: mol_type = unassigned DNA
cgcgggggcgtctcccgttgcctgcagggagcgcggcgcggacgcggcg

SEQ ID NO: 599 - DNA, 17 bp, Homo sapiens
  source 1..17: mol_type = unassigned DNA
cgcgaacggttcatccg

SEQ ID NO: 600-602 - skipped (3 entries)

SEQ ID NO: 603 - DNA, 165 bp, Homo sapiens
  source 1..165: mol_type = unassigned DNA
cggggtctggtaggaagtgcagtgtatctcccagctttagggtaactaggacagcatgaatcttttaccttgtggtagaataaacggctagcgcctcgatgtggcgcgctcgacttttcctcacagagcctaaaagtcacgctcaaccaaactgcagcgttcccg

SEQ ID NO: 604 - DNA, 14 bp, Homo sapiens
  source 1..14: mol_type = unassigned DNA
cgctgacccgcgcg

SEQ ID NO: 605-606 - skipped (2 entries)

SEQ ID NO: 607 - DNA, 97 bp, Homo sapiens
  source 1..97: mol_type = unassigned DNA
cgccccgcacgcccgcacgcccagcggggcccgcattgagcatgggcgcggcggccgtgcgctggcacttgtgcgtgctgctggccctgggcacacg

SEQ ID NO: 608 - skipped

SEQ ID NO: 609 - DNA, 98 bp, Homo sapiens
  source 1..98: mol_type = unassigned DNA
cgaggttcagtttctggttttaaggaataaattcgctggcttgaaagggagctacggcagaagtttaggggcagagcggcgggagcgcgcgatccgcg

SEQ ID NO: 610 - DNA, 69 bp, Homo sapiens
  source 1..69: mol_type = unassigned DNA
cgcggaaggcccgcgcgccctgcgccgccgccgctcagtgccgccgccagcacctcctccgcccctccg

SEQ ID NO: 611-614 - skipped (4 entries)

SEQ ID NO: 615 - DNA, 103 bp, Homo sapiens
  source 1..103: mol_type = unassigned DNA
cgcgcccgccgcccccggaggagcgggctggccgaccgccaccgcgccgtcccccggccgcccccgaagccgctccatcgcggtccctgccgtcctggggccg

SEQ ID NO: 616 - skipped

SEQ ID NO: 617 - DNA, 21 bp, Homo sapiens
  source 1..21: mol_type = unassigned DNA
cgccgccgccgccgagagccg

SEQ ID NO: 618 - DNA, 148 bp, Homo sapiens
  source 1..148: mol_type = unassigned DNA
cgcgcgggcgcgaggggttgggacgcgggagcctcttgagtgcggagcgcggagccctggtgtcccggcgcactgcagccacactcccgggccgcgcgctcccgccgcctcttacccgcgccgcagggtcctcccctttgaggcgccg

SEQ ID NO: 619-620 - skipped (2 entries)

SEQ ID NO: 621 - DNA, 26 bp, Homo sapiens
  source 1..26: mol_type = unassigned DNA
cggccatcacgcgctgcctctcggcg

SEQ ID NO: 622 - DNA, 119 bp, Homo sapiens
  source 1..119: mol_type = unassigned DNA
cgctcgatgatgaggatgcacttctcgcaggtgcagtccttgaagcggcagtaacgcttgtggcccttgagccaggacaggacgccatggttgcggcagcgcgcgcacttgggcgtgcg

SEQ ID NO: 623 - DNA, 66 bp, Homo sapiens
  source 1..66: mol_type = unassigned DNA
cgcctcaccttgctgaggccgctttcggcttcctctgacccaggctgggcgggaaaggtcgggccg

SEQ ID NO: 624 - DNA, 60 bp, Homo sapiens
  source 1..60: mol_type = unassigned DNA
cgcggctggggcctcgcgcctcctggagcgccttctgcccagacacgacgacttcgctcg

SEQ ID NO: 625 - skipped

SEQ ID NO: 626 - DNA, 124 bp, Homo sapiens
  source 1..124: mol_type = unassigned DNA
cggcggcaggagaagcccaaggcccgagcggcccgcagcccccacgcctgcacccctccacccccgccagcccgatggttcgctccgcggcgtgcactggagcaagcaggtcccgctccgagcg

SEQ ID NO: 627 - skipped

SEQ ID NO: 628 - DNA, 156 bp, Homo sapiens
  source 1..156: mol_type = unassigned DNA
cgcctcggcctccaccgtcgcgcccttacaggtcaccaggtgccgctcgcccagaatgtcaaccatggcgcagacacgcagccacctgagacccgaggacacctgcaggaggatgatcacctgcggggaggcggcggcgagcgccgcggtgccccg

SEQ ID NO: 629 - skipped

SEQ ID NO: 630 - DNA, 91 bp, Homo sapiens
  source 1..91: mol_type = unassigned DNA
cgcttcaggaatgactcggtgacatcggtcgatgaccttctccacagcctgtcggtgagcggcggcggaggcaaggtttcggcggcgcgcg

SEQ ID NO: 631-632 - skipped (2 entries)

SEQ ID NO: 633 - DNA, 89 bp, Homo sapiens
  source 1..89: mol_type = unassigned DNA
cgccgagctgcaggcgcgcgcctaaccgctttgctgggctcacgcggtctgagaggtcggagcgcccaactgctggcacgcgagtaacg

SEQ ID NO: 634 - DNA, 13 bp, Homo sapiens
  source 1..13: mol_type = unassigned DNA
cggattaaagacg

SEQ ID NO: 635 - skipped

SEQ ID NO: 636 - DNA, 47 bp, Homo sapiens
  source 1..47: mol_type = unassigned DNA
cgcgatgtggcctcgcctggccttttgttgctggggtctggcgctcg

SEQ ID NO: 637-638 - skipped (2 entries)

SEQ ID NO: 639 - DNA, 159 bp, Homo sapiens
  source 1..159: mol_type = unassigned DNA
cgcctcccgccgaggcgcaggggcagctacattgcggggcgcctgggcgacggcgccaaagccagggtcacaagggcacgggacaagcggggcggggggagcaggagactaggacagaggtcggcgcccgccgcgggcgctttcacgccgcgggcatcg

SEQ ID NO: 640-642 - skipped (3 entries)

SEQ ID NO: 643 - DNA, 78 bp, Homo sapiens
  source 1..78: mol_type = unassigned DNA
cggccgcttctccgacgcccgcggctccccactgcgccgaggcgagcgccacggctaaagcccaagcctcggcgcccg

SEQ ID NO: 644 - skipped

SEQ ID NO: 645 - DNA, 48 bp, Homo sapiens
  source 1..48: mol_type = unassigned DNA
cgcgccaactcggtcgctgtgcacggtcgggtgcgaaactcctccgcg

SEQ ID NO: 646-648 - skipped (3 entries)

SEQ ID NO: 649 - DNA, 157 bp, Homo sapiens
  source 1..157: mol_type = unassigned DNA
cgtgttcaactggcatttgccaccaacatgtctgtttttatttaaatggcccagagcaaggctctgactaaactagcattcccacgccaacactcagcagcgcctctggtttttggcagattttttccttagctgtcaaagcaaaactatagaagcg

SEQ ID NO: 650 - skipped

SEQ ID NO: 651 - DNA, 82 bp, Homo sapiens
  source 1..82: mol_type = unassigned DNA
cgcacccgcggggagggcggcgagcggggatcagccgaagtcgggagaggggcgcttccacggggcgggaaactggcgcgcg

SEQ ID NO: 652 - DNA, 23 bp, Homo sapiens
  source 1..23: mol_type = unassigned DNA
cggccaggtgaggcggccaggcg

SEQ ID NO: 653 - DNA, 38 bp, Homo sapiens
  source 1..38: mol_type = unassigned DNA
cgaactcgcaaagctgctcgtagacgcgcgggaactcg

SEQ ID NO: 654 - skipped

SEQ ID NO: 655 - DNA, 165 bp, Homo sapiens
  source 1..165: mol_type = unassigned DNA
cgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacg

SEQ ID NO: 656-658 - skipped (3 entries)

SEQ ID NO: 659 - DNA, 23 bp, Homo sapiens
  source 1..23: mol_type = unassigned DNA
cgacaggcggcccccggacaccg

SEQ ID NO: 660 - skipped

SEQ ID NO: 661 - DNA, 66 bp, Homo sapiens
  source 1..66: mol_type = unassigned DNA
cggcgccttcggggctgctgcgcgcccgcgcctagagctgccgccccagggagcccgccacggccg

SEQ ID NO: 662 - DNA, 43 bp, Homo sapiens
  source 1..43: mol_type = unassigned DNA
cgggcgcgcagcccgcccgcgcggcctggactctttttgttcg

SEQ ID NO: 663 - skipped

SEQ ID NO: 664 - DNA, 62 bp, Homo sapiens
  source 1..62: mol_type = unassigned DNA
cgcgctgcacgaggatggccacgaggcgcagctggagccgtcgccgccgccgcatctgggcg

SEQ ID NO: 665 - skipped

SEQ ID NO: 666 - DNA, 138 bp, Homo sapiens
  source 1..138: mol_type = unassigned DNA
cgctctcgggcgcacggaaactacttgtcaggaaattttcaacgctcctcctcgcccacttttttccactcctttcctggcgcgccccctcccctcccagaggcacgcagtggagcttttggagtttcgaatctttcg

SEQ ID NO: 667-670 - skipped (4 entries)

SEQ ID NO: 671 - DNA, 187 bp, Homo sapiens
  source 1..187: mol_type = unassigned DNA
cgagcggtcctaactccgtcccgctcgctgttgctgttgctggtgctgctccggctgcagctgctgccgctccacgacctcggggcgctgaggcaacagggccccctccctctactccccatcccccccggctcctccacagaagcgccgtttccagtaactcctcgtgtacctcccacttctgccg

SEQ ID NO: 672-673 - skipped (2 entries)

SEQ ID NO: 674 - DNA, 110 bp, Homo sapiens
  source 1..110: mol_type = unassigned DNA
cgcaggtcaagatctggttccagaatcatcgctacaagctgaagcgcgctcgcgctccaggggcggcggagtcgcctgacctggcagcatccgccgagctgcacgccgcg

SEQ ID NO: 675 - skipped

SEQ ID NO: 676 - DNA, 189 bp, Homo sapiens
  source 1..189: mol_type = unassigned DNA
cgtgcccccgctcgcgcctgggccccgccgcactccagcagaagccattacagagaacaaactaccttcttgtctccgagatgggtccccggggaggaaggcaaattgcctgcctcgtgcataataagccaggcgtggagagcagcgcggaggaggccgcggcagccaccgagcgggcagagcctcccg

SEQ ID NO: 677 - DNA, 42 bp, Homo sapiens
  source 1..42: mol_type = unassigned DNA
cgcgagtgcactcaagcgccctcgttccacccaccttcagcg

SEQ ID NO: 678 - DNA, 33 bp, Homo sapiens
  source 1..33: mol_type = unassigned DNA
cgtggagcgcaaagtgcctgaagcccccgcgcg

SEQ ID NO: 679 - DNA, 15 bp, Homo sapiens
  source 1..15: mol_type = unassigned DNA
cgttcggctggcgcg

SEQ ID NO: 680 - DNA, 51 bp, Homo sapiens
  source 1..51: mol_type = unassigned DNA
cgcccaccacggcgatctgcggcagctccagcaggcagctctgtcccagcg

SEQ ID NO: 681 - skipped

SEQ ID NO: 682 - DNA, 268 bp, Homo sapiens
  source 1..268: mol_type = unassigned DNA
cgaagatgggaaacggccgcttgctgagagggggcatttgcagtcctcccagaaaaggctggggcaggagagcgtgcggccagaggggtgggggtaccggagggggggtctcacctcctgctctatagccgggtctctcccgcgaggcgctgggaagcatgaggcatgcagcattcaaaatgttttttgaaaaagacggacttgaagcttttttttacaaacacgccattgtactcacttcttattcagagacgggctgcgcgctccg

SEQ ID NO: 683 - skipped

SEQ ID NO: 684 - DNA, 33 bp, Homo sapiens
  source 1..33: mol_type = unassigned DNA
cggtgatcggtctgactgctcctgggggctccg

SEQ ID NO: 685 - DNA, 23 bp, Homo sapiens
  source 1..23: mol_type = unassigned DNA
cgaaagtctcgggctagtgggcg

SEQ ID NO: 686 - DNA, 40 bp, Homo sapiens
  source 1..40: mol_type = unassigned DNA
cgaggcacctggtcgggcggggaggcgtcgggtcggggcg

SEQ ID NO: 687 - DNA, 10 bp, Homo sapiens
  source 1..10: mol_type = unassigned DNA
cggagccgcg

SEQ ID NO: 688 - DNA, 181 bp, Homo sapiens
  source 1..181: mol_type = unassigned DNA
cgaaaacgaaatccacccccttgcgcccatttctgccagaggtttgcaggacgtgtctcaacctggcatcccgagtccagaacaaaagccacgggggctgcggcatgggcagggggaaggcgcgcggtggctgacgcggggcaggggccctggcgagcgcgggaggggcggtcagcagccg

SEQ ID NO: 689 - DNA, 195 bp, Homo sapiens
  source 1..195: mol_type = unassigned DNA
cgtcaagcagcaggactacagcgccagcgtctggcttcggaggaaagacaagctggagcacgtaagggcgactcgctcccgggggcctcggccaggcacctgccgcatgcaccctccccgtggtggtggcatgagcgcgcgcggggcgcggggggcaggcgaggggatcctggcaggcgccgacgtcctaggtcg

SEQ ID NO: 690 - skipped

SEQ ID NO: 691 - DNA, 358 bp, Homo sapiens
  source 1..358: mol_type = unassigned DNA
cgcgagctcgggtgagagccaccggaatgcgggaacgcagcttagccgggaacagggttcccgacaggggtcgcccgtggccaggacgcggccgctgaacagaggtcgcgcggcggttcctgcccgagggacctcgtgggcgggggccacacggaggccgcgcacggtccccggggctggcgggggcaggtgggaggacctcctccgggcccgcgaacctgatctggcagcggccaggtgcctggaagcgtttttaaatgatagggttacaaagacatgttggccaggtttgtagttagcgcagcaacgtggtttgcaggagcgcagaacgaggctagacagggtcactcggacgccg

SEQ ID NO: 692 - DNA, 13 bp, Homo sapiens
  source 1..13: mol_type = unassigned DNA
cgccacaactgcg

SEQ ID NO: 693-694 - skipped (2 entries)

SEQ ID NO: 695 - DNA, 95 bp, Homo sapiens
  source 1..95: mol_type = unassigned DNA
cgggcactcgggacgaggcgagggcgcagaaaacttggagcccaatcagcacggagttgagcttccgcgccccaaccttcaggtgaccccgcgcg

SEQ ID NO: 696 - DNA, 45 bp, Homo sapiens
  source 1..45: mol_type = unassigned DNA
cgccgagagggcaggacgcgcacggtgcgctccaacctgctgccg

SEQ ID NO: 697 - DNA, 104 bp, Homo sapiens
  source 1..104: mol_type = unassigned DNA
cgcgagccagggggaggcgcgtcggaaagcgagagtgacaagcagcctacaagccgaaaagttcctcgcgggaggcgcgcgccgcgtgggctccgactcagccg

SEQ ID NO: 698 - DNA, 87 bp, Homo sapiens
  source 1..87: mol_type = unassigned DNA
cgggagggtggcggaaggtggtgcaccgcagcgtggtccccgccgctgccgccgcggctttgcaaagtgtcagcgggggcgaaagcg

SEQ ID NO: 699 - DNA, 62 bp, Homo sapiens
  source 1..62: mol_type = unassigned DNA
cgacactgaacaacaaccgcggggaggagaggccacttgcagccgaggctcgcaaactgtcg

SEQ ID NO: 700-707 - skipped (8 entries)

SEQ ID NO: 708 - DNA, 145 bp, Homo sapiens
  source 1..145: mol_type = unassigned DNA
cgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaaccggcg

SEQ ID NO: 709 - skipped

SEQ ID NO: 710 - DNA, 19 bp, Homo sapiens
  source 1..19: mol_type = unassigned DNA
cggctcctggcggtgggcg

SEQ ID NO: 711 - DNA, 35 bp, Homo sapiens
  source 1..35: mol_type = unassigned DNA
cggaggctccgctaatggggccgccgccgccgccg

SEQ ID NO: 712-713 - skipped (2 entries)

SEQ ID NO: 714 - DNA, 36 bp, Homo sapiens
  source 1..36: mol_type = unassigned DNA
cggctctcctgcagccagcggaccagcgccagctcg

SEQ ID NO: 715 - skipped

SEQ ID NO: 716 - DNA, 42 bp, Homo sapiens
  source 1..42: mol_type = unassigned DNA
cgtacaatggcaaatgggattaggcaggcgaaggctcagccg

SEQ ID NO: 717-718 - skipped (2 entries)

SEQ ID NO: 719 - DNA, 18 bp, Homo sapiens
  source 1..18: mol_type = unassigned DNA
cggcgcgggcgctgcgcg

SEQ ID NO: 720-722 - skipped (3 entries)

SEQ ID NO: 723 - DNA, 118 bp, Homo sapiens
  source 1..118: mol_type = unassigned DNA
cgcgtcgctgttctgcctcaggccccggtgcggccccaagtcccagcccagggcccttaggtccctccaggcggcggtggcggcactcacctgggtcgcggagccggggtctggcacg

SEQ ID NO: 724 - DNA, 22 bp, Homo sapiens
  source 1..22: mol_type = unassigned DNA
cgtccgcgccgcccgcggttcg

SEQ ID NO: 725-728 - skipped (4 entries)

SEQ ID NO: 729 - DNA, 31 bp, Homo sapiens
  source 1..31: mol_type = unassigned DNA
cgtaacacatctcagcaccgagctcttgtcg

SEQ ID NO: 730-738 - skipped (9 entries)

SEQ ID NO: 739 - DNA, 69 bp, Homo sapiens
  source 1..69: mol_type = unassigned DNA
cgccccccggcccgccctccccgagcgccgccgacacgccagccaaacggccgctggccgcccctagcg

SEQ ID NO: 740 - DNA, 415 bp, Homo sapiens
  source 1..415: mol_type = unassigned DNA
cgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcg

SEQ ID NO: 741-745 - skipped (5 entries)

SEQ ID NO: 746 - DNA, 62 bp, Homo sapiens
  source 1..62: mol_type = unassigned DNA
cgtgcgcatttcaagcgcgtgcgggagtgtgcgaggcgctgtgcgagctagcggcgggcgcg

SEQ ID NO: 747-750 - skipped (4 entries)

SEQ ID NO: 751 - DNA, 20 bp, Homo sapiens
  source 1..20: mol_type = unassigned DNA
cggaggcttttgcgtttgcg

SEQ ID NO: 752 - DNA, 69 bp, Homo sapiens
  source 1..69: mol_type = unassigned DNA
cgctgcgcttcctcgcttgctggcgtctttgccttagcgggactcggcagccaggggccccagggggcg

SEQ ID NO: 753 - skipped

SEQ ID NO: 754 - DNA, 318 bp, Homo sapiens
  source 1..318: mol_type = unassigned DNA
cgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacg

SEQ ID NO: 755 - DNA, 27 bp, Homo sapiens
  source 1..27: mol_type = unassigned DNA
cgcgcctccgctcggggagccaccacg

SEQ ID NO: 756 - skipped

SEQ ID NO: 757 - DNA, 13 bp, Homo sapiens
  source 1..13: mol_type = unassigned DNA
cgcggggagctcg

SEQ ID NO: 758 - DNA, 189 bp, Homo sapiens
  source 1..189: mol_type = unassigned DNA
cgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccg

SEQ ID NO: 759-760 - skipped (2 entries)

SEQ ID NO: 761 - DNA, 13 bp, Homo sapiens
  source 1..13: mol_type = unassigned DNA
cgctcagcccccg

SEQ ID NO: 762 - DNA, 51 bp, Homo sapiens
  source 1..51: mol_type = unassigned DNA
cgaaggcgaggccgcccagcccgcaccccaccccacgcacggcacacgccg

SEQ ID NO: 763 - DNA, 289 bp, Homo sapiens
  source 1..289: mol_type = unassigned DNA
cggcagtgtccttttaagaaggggcaaaaaaatctgtttatggccaccctccttccgctttaccttttctcctcttgacagtttcggccctggctgcccgagtcgggggtgtgttttcggtccctctcagatctgggcggggggcgggaggagtgagcgacctgggaagtcccgggggtggagagggggcgctccggggtctgggggcgacgtggacaccttctttggagcacggcggtgcgtttgggatttgaaggaagggccgaaggaagcggggtgcgggcgggcg

SEQ ID NO: 764 - skipped

SEQ ID NO: 765 - DNA, 165 bp, Homo sapiens
  source 1..165: mol_type = unassigned DNA
cgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccg

SEQ ID NO: 766 - DNA, 21 bp, Homo sapiens
  source 1..21: mol_type = unassigned DNA
cgaagtggtgcaggggcggcg

SEQ ID NO: 767-769 - skipped (3 entries)

SEQ ID NO: 770 - DNA, 159 bp, Homo sapiens
  source 1..159: mol_type = unassigned DNA
cgtgctcgtggatgcgcagcgccacgcggctgtccaccatccagcgatacacgcggcccacggagaaggtgaggccgcagcgggccgacttgccgcggcccaggcggtcgccgccggcgctgctcatgttgtagagggacagtgcggccagcgcagccg

SEQ ID NO: 771 - skipped

SEQ ID NO: 772 - DNA, 129 bp, Homo sapiens
  source 1..129: mol_type = unassigned DNA
cgtgcgcccgagtggggcacttgcccgaggtcggggactgtgaaccgaaagattccatctagccctgctgtcctcctggtattgcgatttgggggcgggtcactttacctctctgaattccgccccccg

SEQ ID NO: 773 - skipped

SEQ ID NO: 774 - DNA, 120 bp, Homo sapiens
  source 1..120: mol_type = unassigned DNA
cgccttctccttctttttttttttttttttttttttttttttttttttttttttttggtaccatagagttgctctgaaaacagaagatagagggagtctcggagctcgccatctccagcg

SEQ ID NO: 775 - skipped

SEQ ID NO: 776 - DNA, 171 bp, Homo sapiens
  source 1..171: mol_type = unassigned DNA
cgctcggctgctgcacctgttagtgctgggcccaggttgagaggcgacctccagcccccacaataatgtcccgggctctctggtttgggtcctcgcagcgcccgattgaccgccagcgatacgacgagaacgaggacttgtcggacgtggaggagatcgtcagcgtccgcg

SEQ ID NO: 777-779 - skipped (3 entries)

SEQ ID NO: 780 - DNA, 64 bp, Homo sapiens
  source 1..64: mol_type = unassigned DNA
cggggaaagctgggcgcgcgagccgaggctgctgctcacctgcagccgcgccgctcacctgccg

SEQ ID NO: 781-784 - skipped (4 entries)

SEQ ID NO: 785 - DNA, 16 bp, Homo sapiens
  source 1..16: mol_type = unassigned DNA
cgagccctgcggagcg

SEQ ID NO: 786-788 - skipped (3 entries)

SEQ ID NO: 789 - DNA, 18 bp, Homo sapiens
  source 1..18: mol_type = unassigned DNA
cgcggccgagggaatgcg

SEQ ID NO: 790 - DNA, 118 bp, Homo sapiens
  source 1..118: mol_type = unassigned DNA
cgcgcctctgttcctgggtagactcccccatctgtgcattttggccccttcacttagcaaagagatgtgcgaagtgtgcgcctggagacgagccgcctcggtgacccccatccgcccg

SEQ ID NO: 791-795 - skipped (5 entries)

SEQ ID NO: 796 - DNA, 22 bp, Homo sapiens
  source 1..22: mol_type = unassigned DNA
cggactcctctggggcggcgcg

SEQ ID NO: 797 - DNA, 112 bp, Homo sapiens
  source 1..112: mol_type = unassigned DNA
cgaggcagggaggcgctcccgcagctcctgactttacaacccgcgcgcgtgtgcaccgagccgcgggcacaccgcgaacacacacacacacacacacactcgtgcgctcccg

SEQ ID NO: 798 - DNA, 109 bp, Homo sapiens
  source 1..109: mol_type = unassigned DNA
cgtggaggagtggggccaggtggtcatcatcagcatgctcacccgctacgcccgcacgcagttcctgagccccacccagaacgtaagtgggcccagcccaggcagagcg

SEQ ID NO: 799-801 - skipped (3 entries)

SEQ ID NO: 802 - DNA, 431 bp, Homo sapiens
  source 1..431: mol_type = unassigned DNA
cgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcg

SEQ ID NO: 803 - skipped

SEQ ID NO: 804 - DNA, 40 bp, Homo sapiens
  source 1..40: mol_type = unassigned DNA
cgtccccatctctccagcggagctacagcggggcgcggcg

SEQ ID NO: 805 - skipped

SEQ ID NO: 806 - DNA, 22 bp, Homo sapiens
  source 1..22: mol_type = unassigned DNA
cgtggccctgaacctgctggcg

SEQ ID NO: 807 - skipped

SEQ ID NO: 808 - DNA, 47 bp, Homo sapiens
  source 1..47: mol_type = unassigned DNA
cgagctggagaaccacagcatgtactgcgtgcaatgcaagatgcccg

SEQ ID NO: 809 - DNA, 24 bp, Homo sapiens
  source 1..24: mol_type = unassigned DNA
cgtgccagaagtcccccaacggcg

SEQ ID NO: 810 - skipped

SEQ ID NO: 811 - DNA, 45 bp, Homo sapiens
  source 1..45: mol_type = unassigned DNA
cgagggcctcagccaattagcttgctgggtgggcctggagtcccg

SEQ ID NO: 812 - skipped

SEQ ID NO: 813 - DNA, 258 bp, Homo sapiens
  source 1..258: mol_type = unassigned DNA
cgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcg

SEQ ID NO: 814 - DNA, 45 bp, Homo sapiens
  source 1..45: mol_type = unassigned DNA
cgcgaccgcaagcccgagcccaggtccctcggagccgccagggcg

SEQ ID NO: 815-816 - skipped (2 entries)

SEQ ID NO: 817 - DNA, 67 bp, Homo sapiens
  source 1..67: mol_type = unassigned DNA
cgaggccgccccgctggttggtgcaagaaccagcctgcaacccaagtcctgagctgttggcgccccg

SEQ ID NO: 818 - DNA, 43 bp, Homo sapiens
  source 1..43: mol_type = unassigned DNA
cgctcgagtcctcgctgctgccgctgccgctgcgggtcagccg

SEQ ID NO: 819-820 - skipped (2 entries)

SEQ ID NO: 821 - DNA, 113 bp, Homo sapiens
  source 1..113: mol_type = unassigned DNA
cgcccgagattcgggagagattaggggcccgcaaagcagaagagcagattcagaaagaaaaaaaaaaaagcgagaagtgcgagaaaaatatactgaattcagctaaacacacg

SEQ ID NO: 822-823 - skipped (2 entries)

SEQ ID NO: 824 - DNA, 84 bp, Homo sapiens
  source 1..84: mol_type = unassigned DNA
cgggctctggggcgctggtgtccgcgcagccccagtcgcttccgcagccaccgccgctcggctccgcggaggcggcgcgcagcg

SEQ ID NO: 825 - skipped

SEQ ID NO: 826 - DNA, 48 bp, Homo sapiens
  source 1..48: mol_type = unassigned DNA
cgcaggtcaagatctggttccagaaccaccgctacaagatgaagcgcg

SEQ ID NO: 827 - DNA, 228 bp, Homo sapiens
  source 1..228: mol_type = unassigned DNA
cgccgccaccacgccgcgcgccgtactccgcgtcaagaatggggcggccaagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggtaagcgcgcggcccg

SEQ ID NO: 828 - DNA, 47 bp, Homo sapiens
  source 1..47: mol_type = unassigned DNA
cgctggtgcgtggcggcgtggagcgcgcttgttacggccaaggtgcg

SEQ ID NO: 829 - DNA, 185 bp, Homo sapiens
  source 1..185: mol_type = unassigned DNA
cgccgcccctcggtccagagcccccacccccggcctgtgagcctgcggcgctggtggagcccggctccaggaagaggagctcacccggtcccccctgattggacagcagcgaggtcccaccgggcgcctccgcggcttaaaaccgaagcgggggcgagggggaggtagagcccgccccctgcgcg

SEQ ID NO: 830 - DNA, 216 bp, Homo sapiens
  source 1..216: mol_type = unassigned DNA
cggcgttccactcactggcgcccacggcccgcaggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccg

SEQ ID NO: 831 - DNA, 344 bp, Homo sapiens
  source 1..344: mol_type = unassigned DNA
cgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacg

SEQ ID NO: 832 - DNA, 28 bp, Homo sapiens
  source 1..28: mol_type = unassigned DNA
cgtctcggcctggctgccaaacagaacg

SEQ ID NO: 833 - DNA, 124 bp, Homo sapiens
  source 1..124: mol_type = unassigned DNA
cggcgcgcacggccaaggcacgcgcgctggcacacgcgggcgcggacacgcgcggacacacacgtgcgggacacgccctcccccgacggcggcgctaacctctcggtaagtccagcgccccacg

SEQ ID NO: 834 - DNA, 80 bp, Homo sapiens
  source 1..80: mol_type = unassigned DNA
cgaggtgcaggcggcgcgggcgctcaccgtgagcgccgtgctgctggcgttcgttgcgctcttcgtgaccctggcgggcg

SEQ ID NO: 835 - DNA, 62 bp, Homo sapiens
  source 1..62: mol_type = unassigned DNA
cgaggcgtggaggggcagccgcggcggggcgacccttacctgctcactgcggggcctgtccg

SEQ ID NO: 836 - DNA, 165 bp, Homo sapiens
  source 1..165: mol_type = unassigned DNA
cgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcg

SEQ ID NO: 837 - DNA, 43 bp, Homo sapiens
  source 1..43: mol_type = unassigned DNA
cgcgctccgaggaagcgccggaaccaccagaagcacagggacg

SEQ ID NO: 838 - DNA, 86 bp, Homo sapiens
  source 1..86: mol_type = unassigned DNA
cgccacctccaaccagctgcaagccgagctgcccacctgggaccgggccggcccggcgggcttggctcccggcgaaggcggcggcg

SEQ ID NO: 839 - DNA, 23 bp, Homo sapiens
  source 1..23: mol_type = unassigned DNA
cgcccccttatcccacgggctcg

SEQ ID NO: 840 - skipped

SEQ ID NO: 841 - DNA, 99 bp, Homo sapiens
  source 1..99: mol_type = unassigned DNA
cggcaggagcagctcacagccaggagcgctctcccgcccccaacgccgcgctcccccctccaaaacggtttaaaaaaatccaccaattgcatggccgcg

SEQ ID NO: 842 - DNA, 73 bp, Homo sapiens
  source 1..73: mol_type = unassigned DNA
cgaccatttctgtgcttctaggagcccaccctgggcggcagggaggcgttgcgtggggctcacgagttccacg

SEQ ID NO: 843 - skipped

SEQ ID NO: 844 - DNA, 52 bp, Homo sapiens
  source 1..52: mol_type = unassigned DNA
cgctcccaggacccccgcccgctctctcctgactcggtccctgcccgccccg

SEQ ID NO: 845 - DNA, 50 bp, Homo sapiens
  source 1..50: mol_type = unassigned DNA
cgcagccgccgcgtccgcacctgaccatggagtgcgccctcctgctcgcg

SEQ ID NO: 846 - DNA, 50 bp, Homo sapiens
  source 1..50: mol_type = unassigned DNA
cgaacgcagagtccacacgtggattcccgcgcctgtgatgccccgacccg

SEQ ID NO: 847-848 - skipped (2 entries)

SEQ ID NO: 849 - DNA, 52 bp, Homo sapiens
  source 1..52: mol_type = unassigned DNA
cgcctggggcccacgcgagccgcgagcccctgcctgctcctgcgctaccccg

SEQ ID NO: 850-852 - skipped (3 entries)

SEQ ID NO: 853 - DNA, 138 bp, Homo sapiens
  source 1..138: mol_type = unassigned DNA
cgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcg

SEQ ID NO: 854-856 - skipped (3 entries)

SEQ ID NO: 857 - DNA, 1017 bp, synthetic construct
  misc_feature 1..1017: note = Description of Artificial Sequence: Synthetic polynucleotide
  source 1..1017: mol_type = other DNA
yggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagyg

SEQ ID NO: 858 - DNA, 166 bp, synthetic construct
  misc_feature 1..166: note = Description of Artificial Sequence: Synthetic polynucleotide
  source 1..166: mol_type = other DNA
ygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygyg

SEQ ID NO: 859-864 - skipped (6 entries)

SEQ ID NO: 865 - DNA, 14 bp, synthetic construct
  misc_feature 1..14: note = Description of Artificial Sequence: Synthetic oligonucleotide
  source 1..14: mol_type = other DNA
ygygttttagygyg

SEQ ID NO: 866-868 - skipped (3 entries)

SEQ ID NO: 869 - DNA, 125 bp, synthetic construct
  misc_feature 1..125: note = Description of Artificial Sequence: Synthetic polynucleotide
  source 1..125: mol_type = other DNA
yggttttatttatttgtttygaagagtggttttagttttgygtttttttttgygattttatatatagggatagttttaggtatagttttagtagtaggagtatggyggggygagggygygggayg

SEQ ID NO: 870 - skipped

SEQ ID NO: 871 - DNA, 131 bp, synthetic construct
  misc_feature 1..131: note = Description of Artificial Sequence: Synthetic polynucleotide
  source 1..131: mol_type = other DNA
yggggtgtgaagtggyggygggtagaggggttygtaggggttgggattygygtgtttttttttgtttyggtgyggagtaygatgtgttygggygggggygaggaygttygggaggggttgggttgygtayg

SEQ ID NO: 872 - DNA, 94 bp, synthetic construct
  misc_feature 1..94: note = Description of Artificial Sequence: Synthetic oligonucleotide
  source 1..94: mol_type = other DNA
ygggtttgttttyggtttygttyggagggtgtgygggttttygtttygttggtttygtttgtttattayggygygtttaaatttaygyggttyg

SEQ ID NO: 873-874 - skipped (2 entries)

SEQ ID NO: 875 - DNA, 27 bp, synthetic construct
  misc_feature 1..27: note = Description of Artificial Sequence: Synthetic oligonucleotide
  source 1..27: mol_type = other DNA
ygygatggggaggggaatatttgygyg

SEQ ID NO: 876 - DNA, 164 bp, synthetic construct
  misc_feature 1..164: note = Description of Artificial Sequence: Synthetic polynucleotide
  source 1..164: mol_type = other DNA
ygagattagaggggaaattygaaaaagtaagtttttgyggtagtagttaggaaatattygttaggaattggttgygattttaattttagyggttygaagttttagtttttttatttttatygyggtagagtygttttygtagatatttttygaggagaatygyg

SEQ ID NO: 877-878 - skipped (2 entries)

SEQ ID NO: 879 - DNA, 68 bp, synthetic construct
  misc_feature 1..68: note = Description of Artificial Sequence: Synthetic oligonucleotide
  source 1..68: mol_type = other DNA
ygttgggttygtygaggtyggggtttttttatgggagggaggtggttgyggyggaatttttagatgyg

SEQ ID NO: 880 - DNA, 508 bp, synthetic construct
  misc_feature 1..508: note = Description of Artificial Sequence: Synthetic polynucleotide
  source 1..508: mol_type = other DNA
yggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgyg

SEQ ID NO: 881-890 - skipped (10 entries)

SEQ ID NO: 891 - DNA, 396 bp, synthetic construct
  misc_feature 1..396: note = Description of Artificial Sequence: Synthetic polynucleotide
  source 1..396: mol_type = other DNA
tgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttyg

SEQ ID NO: 892 - skipped

SEQ ID NO: 893 - DNA, 70 bp, synthetic construct
  misc_feature 1..70: note = Description of Artificial Sequence: Synthetic oligonucleotide
  source 1..70: mol_type = other DNA
ygggtygttatttgtttatttgttttatttaggatatttttttaaataatttttaagtggaaaaattayg

SEQ ID NO: 894 - skipped

SEQ ID NO: 895 - DNA, 68 bp, synthetic construct
  misc_feature 1..68: note = Description of Artificial Sequence: Synthetic oligonucleotide
  source 1..68: mol_type = other DNA
ygygggggaygyggggygyggygygttgagygygggtgtygaggttggagggygyggtygggttttyg

SEQ ID NO: 896 - DNA, 88 bp, synthetic construct
  misc_feature 1..88: note = Description of Artificial Sequence: Synthetic oligonucleotide
  source 1..88: mol_type = other DNA
ygagggtyggttygtttttggggattygyggatgtygygagggggygtygygttattgaaggttgggaygggggyggtgygyggggyg

SEQ ID NO: 897-898 - skipped (2 entries)

SEQ ID NO: 899 - DNA, 87 bp, synthetic construct
  misc_feature 1..87: note = Description of Artificial Sequence: Synthetic oligonucleotide
  source 1..87: mol_type = other DNA
ygagttgtttygtttttttattttgggggygaagaagggtyggggagtgggggaaagygggaggygtygyggtttgggaggttttyg

SEQ ID NO: 900 - DNA, 45 bp, synthetic construct
  misc_feature 1..45: note = Description of Artificial Sequence: Synthetic oligonucleotide
  source 1..45: mol_type = other DNA
ygagtttttgygttgtttttgtygtyggagttygggtttgttayg

SEQ ID NO: 901 - skipped

SEQ ID NO: 902 - DNA, 173 bp, synthetic construct
  misc_feature 1..173: note = Description of Artificial Sequence: Synthetic polynucleotide
  source 1..173: mol_type = other DNA
yggttggaatttttttaagtattgttttgagtttatttttaaatgaaagggggaaaaatttaaattagattagaatttgaaatagttgaaatagttatygatttttagtttgtttttaagtttggtagagattgtgaaagttttaattttttygygatgttagttayggttyg

SEQ ID NO: 903 - skipped

SEQ ID NO: 904 - DNA, 48 bp, synthetic construct
  misc_feature 1..48: note = Description of Artificial Sequence: Synthetic oligonucleotide
  source 1..48: mol_type = other DNA
ygaagaygagaygtagagttttaattgtagttagagataaaggtttyg

SEQ ID NO: 905-906 - skipped (2 entries)

SEQ ID NO: 907 - DNA, 36 bp, synthetic construct
  misc_feature 1..36: note = Description of Artificial Sequence: Synthetic oligonucleotide
  source 1..36: mol_type = other DNA
ygatygtggygttagtttttygttttttttgtttyg

SEQ ID NO: 908-912 - skipped (5 entries)

SEQ ID NO: 913 - DNA, 97 bp, synthetic construct
  misc_feature 1..97: note = Description of Artificial Sequence: Synthetic oligonucleotide
  source 1..97: mol_type = other DNA
ygtttgtaaggaygggagtyggggagggtgtagggygagtttaaaggaygggtagagtaagtttygggaagaggtaggggttttttttttygggtyg

SEQ ID NO: 914-915 - skipped (2 entries)

SEQ ID NO: 916 - DNA, 67 bp, synthetic construct
  misc_feature 1..67: note = Description of Artificial Sequence: Synthetic oligonucleotide
  source 1..67: mol_type = other DNA
ygttagatttttatagttttttataygttatttttattgttttagggaattataagtataggtatyg

SEQ ID NO: 917 - skipped

SEQ ID NO: 918 - DNA, 29 bp, synthetic construct
  misc_feature 1..29: note = Description of Artificial Sequence: Synthetic oligonucleotide
  source 1..29: mol_type = other DNA
ygatagggtagagggttagtagttattyg

SEQ ID NO: 919 - DNA, 49 bp, synthetic construct
  misc_feature 1..49: note = Description of Artificial Sequence: Synthetic oligonucleotide
  source 1..49: mol_type = other DNA
yggtygagtttaagtggttgaagygyggaygaggatgygyggggtttyg

SEQ ID NO: 920 - DNA, 188 bp, synthetic construct
  misc_feature 1..188: note = Description of Artificial Sequence: Synthetic polynucleotide
  source 1..188: mol_type = other DNA
ygggagttygaagtygtttygagygggggtgggyggtgagyggattttygggtgttgattaggtgtttggtggtagagtagggaaggggggaayggaygtygattttagggattttttattygtttaygttttttggygttggttataygtygtygttttagtattaattggaggtttttagtggayg

SEQ ID NO: 921-922 - skipped (2 entries)

SEQ ID NO: 923 - DNA, 113 bp, synthetic construct
  misc_feature 1..113: note = Description of Artificial Sequence: Synthetic polynucleotide
  source 1..113: mol_type = other DNA
yggtygtgggyggttgyggygyggtygyggygaggggygagyggggttggtttygtygttygggygagagtatttttttgggggttaattttgyggtttygtttttattygyg

SEQ ID NO: 924 - DNA, 208 bp, synthetic construct
  misc_feature 1..208: note = Description of Artificial Sequence: Synthetic polynucleotide
  source 1..208: mol_type = other DNA
yggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyg

SEQ ID NO: 925 - DNA, 96 bp, synthetic construct
  misc_feature 1..96: note = Description of Artificial Sequence: Synthetic oligonucleotide
  source 1..96: mol_type = other DNA
yggttygttygttttttagtagttttggggtgttyggggyggttttgtaagygggagagagyggygaggyggyggygtygagtgyggggggatgyg

SEQ ID NO: 926 - DNA, 236 bp, synthetic construct
  misc_feature 1..236: note = Description of Artificial Sequence: Synthetic polynucleotide
  source 1..236: mol_type = other DNA
yggtgagtattygtygtggggaagggttttggggatttattggaggtygyggttygtagtagttaggggtygagttayggttayggaygttttggtgtttyggttygtgtygggtttttaggyggaggaggygttygttgggtttagattttygattttagtttyggtttttyggygtttgggttgygyggagtttttgtttygygtttyggatttttaygygtagtttttaygyg

SEQ ID NO: 927 - DNA, 211 bp, synthetic construct
  misc_feature 1..211: note = Description of Artificial Sequence: Synthetic polynucleotide
  source 1..211: mol_type = other DNA
ygtttttagtygtgttttggttgygtagttggaaaggttgagtagtttattgttgtttttttgttyggttttggatatatygtttgaatttttgggygtttttgttgttaagtgggggatagtattatttattggggaggaaaattttaggaatgtggattttggggttaygtaggggttgggaagtgaagggtagggaaygygggyggyg

SEQ ID NO: 928 - DNA, 193 bp, synthetic construct
  misc_feature 1..193: note = Description of Artificial Sequence: Synthetic polynucleotide
  source 1..193: mol_type = other DNA
ygygygtygaagttgtgayggtttattaagtagagatttgygaggtatatagagagggaatgaggyggaatygttygggggttygttgatattgtagagtttttygtagtatygttgttttaaatttygtttttttaggygtgygygtatagygagttagaggaggtttygtttygatttggggtttttygyg

SEQ ID NO: 929 - skipped

SEQ ID NO: 930 - DNA, 199 bp, synthetic construct
  misc_feature 1..199: note = Description of Artificial Sequence: Synthetic polynucleotide
  source 1..199: mol_type = other DNA
ygagtaggaggatttaaygaatttagtttgtggatatgttttaatttttattttygttttttttaggtttgtttaggtgaggatgatgggagggaaaagyggtgtatagtygtaatattggtattttgtaagagtygtyggggtattgatatagagggatatygtattggagatgyggtgtttayggagatttattgyg

SEQ ID NO: 931 - DNA, 87 bp, synthetic construct
  misc_feature 1..87: note = Description of Artificial Sequence: Synthetic oligonucleotide
  source 1..87: mol_type = other DNA
yggttagtagaggyggygtttggttttggatgttgtagyggagaygttaaggagattgaatgtagggagygaggygtagyggtygyg

SEQ ID NO: 932 - DNA, 68 bp, synthetic construct
  misc_feature 1..68: note = Description of Artificial Sequence: Synthetic oligonucleotide
  source 1..68: mol_type = other DNA
ygygygagagtgtttagttgggaaatgtagtttygaattaatatygtatgttttataattagtttayg

SEQ ID NO: 933 - DNA, 61 bp, synthetic construct
  misc_feature 1..61: note = Description of Artificial Sequence: Synthetic oligonucleotide
  source 1..61: mol_type = other DNA
ygtttttggtatttagggaatggtttgtaaattttaatgtattatagattagtttttatyg

SEQ ID NO: 934 - DNA, 40 bp, synthetic construct
  misc_feature 1..40: note = Description of Artificial Sequence: Synthetic oligonucleotide
  source 1..40: mol_type = other DNA
ygggtgttttgtygttgtygtttttgttgtygtygattyg

SEQ ID NO: 935 - DNA, 647 bp, synthetic construct
  misc_feature 1..647: note = Description of Artificial Sequence: Synthetic polynucleotide
  source 1..647: mol_type = other DNA
ygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtyg

SEQ ID NO: 936 - DNA, 327 bp, synthetic construct
  misc_feature 1..327: note = Description of Artificial Sequence: Synthetic polynucleotide
  source 1..327: mol_type = other DNA
ygyggaggagggtygggttgattgtygtygttgagttgttttyggaygggagygtttgtttayggtatttattttttttagyggtggaaatgtggagaagtaagtgggaggyggtgtygggaattgattttttttaaaayggtyggygtygttgttttgaaatgggyggttaagtgtttgtgggattaagggyggttttagagatgttyggaaaatygttgttayggttagagtgyggygtagaygyggtagagttggaggtgttygyggtgtaggttgttgtttaygtygtttaggttaggtgttgagggtttagttygygtttyg

SEQ ID NO: 937 - skipped

SEQ ID NO: 938 - DNA, 324 bp, synthetic construct
  misc_feature 1..324: note = Description of Artificial Sequence: Synthetic polynucleotide
  source 1..324: mol_type = other DNA
ygtagttgttgtagtygttgyggttgtygttatttggtaggaggtatagggtatgggtgagggaggttgyggtagyggttaygagttgttgaggaagttagattgtaggtatttggggggygttaggtagtygtagtygtyggtttyggygttygttaygtygtattygtttgyggygttttyggtttygaagagttttttgtygggttggaagtgygygggyggyggtyggaagggtttttttatgyggyggyggygtyggtagttgtttttttygaatatgttttygtaggtygggtttagygtttagtagttgtttttgyg

SEQ ID NO: 939 - DNA, 77 bp, synthetic construct
  misc_feature 1..77: note = Description of Artificial Sequence: Synthetic oligonucleotide
  source 1..77: mol_type = other DNA
yggygtagyggygggaattygaggtygagygtygyggyggtagygttagaagygtatttatygggtayggygaggyg

SEQ ID NO: 940 - DNA, 158 bp, synthetic construct
  misc_feature 1..158: note = Description of Artificial Sequence: Synthetic polynucleotide
  source 1..158: mol_type = other DNA
ygttttggattttygaagttagttttttgygtagyggattagagaggtttattygyggaygttaatttaatttttgggyggggttygggggttgagtagaaggygaggtttggggagtayggataattttgagggttgtttgtgtyggggtgggagyg

SEQ ID NO: 941 - DNA, 79 bp, synthetic construct
  misc_feature 1..79: note = Description of Artificial Sequence: Synthetic oligonucleotide
  source 1..79: mol_type = other DNA
ygtttttaaaaattaaataaattaataagagaattaattaataggtagygttgygatygttaggagygyggagygygyg

SEQ ID NO: 942 - DNA, 137 bp, synthetic construct
  misc_feature 1..137: note = Description of Artificial Sequence: Synthetic polynucleotide
  source 1..137: mol_type = other DNA
ygttttttttgatttttaaggttagaaagatttattatttttttygagagggygtagttatagatttattagagagggygggtagggtgtyggaagttagagaayggygtttygygtttttttatygttttagggyg

SEQ ID NO: 943 - DNA, 112 bp, synthetic construct
  misc_feature 1..112: note = Description of Artificial Sequence: Synthetic polynucleotide
  source 1..112: mol_type = other DNA
ygygggttatgtattgttgttggtgtttattatgtttaattttttggattataagtggtataaggagtygttgtagtagtgtaatttygatgggtygttgggtgtygtagyg

SEQ ID NO: 944-945 - skipped (2 entries)

SEQ ID NO: 946 - DNA, 282 bp, synthetic construct
  misc_feature 1..282: note = Description of Artificial Sequence: Synthetic polynucleotide
  source 1..282: mol_type = other DNA
ygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtyg

SEQ ID NO: 947 - DNA, 81 bp, synthetic construct
  misc_feature 1..81: note = Description of Artificial Sequence: Synthetic oligonucleotide
  source 1..81: mol_type = other DNA
yggttgttaattygtttaatttgttgygygggtggtygtttagagtygygggtttgyggggygtttttygtygtygygtyg

SEQ ID NO: 948 - DNA, 53 bp, synthetic construct
  misc_feature 1..53: note = Description of Artificial Sequence: Synthetic oligonucleotide
  source 1..53: mol_type = other DNA
yggtygtggagattttaatygagtttaygttggygtaaaaggtaaaagtygyg

SEQ ID NO: 949 - DNA, 40 bp, synthetic construct
  misc_feature 1..40: note = Description of Artificial Sequence: Synthetic oligonucleotide
  source 1..40: mol_type = other DNA
ygygtygagggggygttagyggggaygtgagttggygtyg

SEQ ID NO: 950 - DNA, 206 bp, synthetic construct
  misc_feature 1..206: note = Description of Artificial Sequence: Synthetic polynucleotide
  source 1..206: mol_type = other DNA
yggtagtttgagygtttyggatggttygyggyggggyggtttgtaagagygaygygyggttgttgttggggygggaygygttgyggtyggygttygttttgttggttttygtygtgttgttgggygtygygttyggtttyggtttyggtttttggtttggttgtygygygggtygttagygtaygygatattaggtgggtyggtyg

SEQ ID NO: 951 - DNA, 38 bp, synthetic construct
  misc_feature 1..38: note = Description of Artificial Sequence: Synthetic oligonucleotide
  source 1..38: mol_type = other DNA
ygagggtayggyggtygtygtttygygtagtagtagyg

SEQ ID NO: 952 - skipped

SEQ ID NO: 953 - DNA, 25 bp, synthetic construct
  misc_feature 1..25: note = Description of Artificial Sequence: Synthetic oligonucleotide
  source 1..25: mol_type = other DNA
ygagygaatgtaaygygtatatayg

SEQ ID NO: 954 - DNA, 79 bp, synthetic construct
  misc_feature 1..79: note = Description of Artificial Sequence: Synthetic oligonucleotide
  source 1..79: mol_type = other DNA
ygtttttttttttttttaaaaaaaaaatttaaataatttttaaataatatttaataggaaagaagaaggaaaaggagyg

SEQ ID NO: 955 - DNA, 33 bp, synthetic construct
  misc_feature 1..33: note = Description of Artificial Sequence: Synthetic oligonucleotide
  source 1..33: mol_type = other DNA
ygagggtaayggtygaggygttaygyggggtyg

SEQ ID NO: 956 - DNA, 132 bp, synthetic construct
  misc_feature 1..132: note = Description of Artificial Sequence: Synthetic polynucleotide
  source 1..132: mol_type = other DNA
ygtaggttaggyggtygtgggtygagttggttatgattattttttygygggygttttgtttgggygagtgtttttygtagygttygtatttygtttttttygtgtgtagtttygygtygtygtygttygtyg

SEQ ID NO: 957 - DNA, 32 bp, synthetic construct
  misc_feature 1..32: note = Description of Artificial Sequence: Synthetic oligonucleotide
  source 1..32: mol_type = other DNA
ygttttyggggtagaggagggggtgttaggyg

SEQ ID NO: 958-959 - skipped (2 entries)

SEQ ID NO: 960 - DNA, 20 bp, synthetic construct
  misc_feature 1..20: note = Description of Artificial Sequence: Synthetic oligonucleotide
  source 1..20: mol_type = other DNA
yggygtygttggtatattyg

SEQ ID NO: 961 - DNA, 85 bp, synthetic construct
  misc_feature 1..85: note = Description of Artificial Sequence: Synthetic oligonucleotide
  source 1..85: mol_type = other DNA
yggygggygtaggggtagggtatgattgaygygttttttgtttgygtttatgtgagagaaagyggtygagggagggagygtgtyg

SEQ ID NO: 962 - DNA, 230 bp, synthetic construct
  misc_feature 1..230: note = Description of Artificial Sequence: Synthetic polynucleotide
  source 1..230: mol_type = other DNA
ygtaggggtygagaaagtggyggagaggyggtggtygaggtttaggggygagygygggttgagttggtttttgttgygtttaygagygatatttattttttygttgyggaygtttygygggygttaggttgggggttttgygatygatttttttygttttygaggtatygtygggttygtttggtaggtagygygtttygygagttggagggtygagtttygyggggtyg

SEQ ID NO: 963 - DNA, 84 bp, synthetic construct
  misc_feature 1..84: note = Description of Artificial Sequence: Synthetic oligonucleotide
  source 1..84: mol_type = other DNA
ygtaagagttggttaaaatgtttttaggtgygtgggggtttyggggttttagttggagttygatattttgagattggyggttyg

SEQ ID NO: 964 - DNA, 42 bp, synthetic construct
  misc_feature 1..42: note = Description of Artificial Sequence: Synthetic oligonucleotide
  source 1..42: mol_type = other DNA
ygygygagttttttygtttggttgagttaaaaagggatygyg

SEQ ID NO: 965 - DNA, 45 bp, synthetic construct
  misc_feature 1..45: note = Description of Artificial Sequence: Synthetic oligonucleotide
  source 1..45: mol_type = other DNA
yggaygattttttttattttttygaggaygaggaggagtayggyg

SEQ ID NO: 966 - DNA, 26 bp, synthetic construct
  misc_feature 1..26: note = Description of Artificial Sequence: Synthetic oligonucleotide
  source 1..26: mol_type = other DNA
ygygggataagggatgttggygggyg

SEQ ID NO: 967 - DNA, 50 bp, synthetic construct
  misc_feature 1..50: note = Description of Artificial Sequence: Synthetic oligonucleotide
  source 1..50: mol_type = other DNA
ygaggtttttttygyggygygyggtagttttagtttttatttaaatttyg

SEQ ID NO: 968 - DNA, 56 bp, synthetic construct
  misc_feature 1..56: note = Description of Artificial Sequence: Synthetic oligonucleotide
  source 1..56: mol_type = other DNA
ygttggtttattygygtgtaygtttattttttaygygygtttttggtttagaagyg

SEQ ID NO: 969 - DNA, 44 bp, synthetic construct
  misc_feature 1..44: note = Description of Artificial Sequence: Synthetic oligonucleotide
  source 1..44: mol_type = other DNA
ygagygtgtgygygygygaggggagygygtgygyggtgaggayg

SEQ ID NO: 970-971 - skipped (2 entries)

SEQ ID NO: 972 - DNA, 58 bp, synthetic construct
  misc_feature 1..58: note = Description of Artificial Sequence: Synthetic oligonucleotide
  source 1..58: mol_type = other DNA
ygttygtttattygttaggtaggyggtggtgtygatttatttgagtagttgtttygyg

SEQ ID NO: 973 - DNA, 151 bp, synthetic construct
  misc_feature 1..151: note = Description of Artificial Sequence: Synthetic polynucleotide
  source 1..151: mol_type = other DNA
ygtattggtttttttygttttygttygtaygaaagttttgttygaygtttgtagttagtatygttygtattgtttagggagggtttgygtygagatttagtggtygagtgagttatagagtygttggttttggggaygttgttttttatyg

SEQ ID NO: 974 - DNA, 17 bp, synthetic construct
  misc_feature 1..17: note = Description of Artificial Sequence: Synthetic oligonucleotide
  source 1..17: mol_type = other DNA
yggttttggggagttyg

SEQ ID NO: 975 - DNA, 70 bp, synthetic construct
  misc_feature 1..70: note = Description of Artificial Sequence: Synthetic oligonucleotide
  source 1..70: mol_type = other DNA
ygtagaggggttagtaattttatgggtggtggggttttttatttttggaygtagyggggagtagygggyg

SEQ ID NO: 976 - DNA, 59 bp, synthetic construct
  misc_feature 1..59: note = Description of Artificial Sequence: Synthetic oligonucleotide
  source 1..59: mol_type = other DNA
yggygtttagygtttaagygttaattygttgaaagttttttagygaaattttagggayg

SEQ ID NO: 977 - DNA, 25 bp, synthetic construct
  misc_feature 1..25: note = Description of Artificial Sequence: Synthetic oligonucleotide
  source 1..25: mol_type = other DNA
yggttyggatagaggttatttagyg

SEQ ID NO: 978 - DNA, 57 bp, synthetic construct
  misc_feature 1..57: note = Description of Artificial Sequence: Synthetic oligonucleotide
  source 1..57: mol_type = other DNA
ygtttttygttatttgatattagttaggtagtttttagggttagagygttagygtyg

SEQ ID NO: 979 - DNA, 111 bp, synthetic construct
  misc_feature 1..111: note = Description of Artificial Sequence: Synthetic polynucleotide
  source 1..111: mol_type = other DNA
ygtttagggttggggttyggtgggaattttttygtgttygaagggaygatttygttagagagtttttygatttttgtatttatygtttttggtaggaygtggagttgttyg

SEQ ID NO: 980 - DNA, 211 bp, synthetic construct
  misc_feature 1..211: note = Description of Artificial Sequence: Synthetic polynucleotide
  source 1..211: mol_type = other DNA
ygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattyg

SEQ ID NO: 981 - DNA, 75 bp, synthetic construct
  misc_feature 1..75: note = Description of Artificial Sequence: Synthetic oligonucleotide
  source 1..75: mol_type = other DNA
ygtttttattatttttttaaatattgtagtaagttgtagtaaggygggtaaatatygatagygygygtgggggyg

SEQ ID NO: 982 - skipped

SEQ ID NO: 983 - DNA, 66 bp, synthetic construct
  misc_feature 1..66: note = Description of Artificial Sequence: Synthetic oligonucleotide
  source 1..66: mol_type = other DNA
yggttatttgtttttygttttyggggygtygtttagtttygygttaggygttttttttagygttyg

SEQ ID NO: 984 - skipped

SEQ ID NO: 985 - DNA, 163 bp, synthetic construct
  misc_feature 1..163: note = Description of Artificial Sequence: Synthetic polynucleotide
  source 1..163: mol_type = other DNA
ygygygtttttyggygggtyggygggttyggaagtttygttgttygggtygggtttttaagttygtagtygttttgattaaaataggtatygygayggyggyggtaggyggyggtagttagggttggggtygtatygygtaygygtatgygttygtygtttyg

SEQ ID NO: 986 - DNA, 99 bp, synthetic construct
  misc_feature 1..99: note = Description of Artificial Sequence: Synthetic oligonucleotide
  source 1..99: mol_type = other DNA
ygtttttgttttggagygyggtygggagtaaaatygtaggagtgggagggtagygagttagttggatttygagtygyggagygygttggttttgtttyg

SEQ ID NO: 987 - DNA, 96 bp, synthetic construct
  misc_feature 1..96: note = Description of Artificial Sequence: Synthetic oligonucleotide
  source 1..96: mol_type = other DNA
ygygttttygtaggyggtattgttygyggygyggygtgtgtatygagygagtgaaggtatgtgtggygggygyggttggagttgtygtygtygtyg

SEQ ID NO: 988 - skipped

SEQ ID NO: 989 - DNA, 16 bp, synthetic construct
  misc_feature 1..16: note = Description of Artificial Sequence: Synthetic oligonucleotide
  source 1..16: mol_type = other DNA
yggygagattggtayg

SEQ ID NO: 990 - skipped

SEQ ID NO: 991 - DNA, 141 bp, synthetic construct
  misc_feature 1..141: note = Description of Artificial Sequence: Synthetic polynucleotide
  source 1..141: mol_type = other DNA
ygyggttgatggttgaygygttgygyggttgygtgtttgttttttayggygtggtggagygygayggygaaagttatttgtagttgtaggatttgttygatggtttygayggattttgtgtgttygattgtaaaatgggyg

SEQ ID NO: 992 - skipped

SEQ ID NO: 993 - DNA, 37 bp, synthetic construct
  misc_feature 1..37: note = Description of Artificial Sequence: Synthetic oligonucleotide
  source 1..37: mol_type = other DNA
ygtttttaattaatygtataaaattygtaatatttyg

SEQ ID NO: 994 - DNA, 52 bp, synthetic construct
  misc_feature 1..52: note = Description of Artificial Sequence: Synthetic oligonucleotide
  source 1..52: mol_type = other DNA
ygggtyggggtatttggygttttgtgtgggtggygggagyggggaygtttyg

SEQ ID NO: 995-998 - skipped (4 entries)

SEQ ID NO: 999 - DNA, 17 bp, synthetic construct
  misc_feature 1..17: note = Description of Artificial Sequence: Synthetic oligonucleotide
  source 1..17: mol_type = other DNA
ygagttggggygggayg

SEQ ID NO: 1000 - DNA, 136 bp, synthetic construct
  misc_feature 1..136: note = Description of Artificial Sequence: Synthetic polynucleotide
  source 1..136: mol_type = other DNA
ygygagttttttgaygyggggattagttatgaatygggggtgtgtgtttgtttttagagatttggtaaggtgyggagttttttagaagtgyggttaagyggtagyggagayggygagttaggaattttttttygyg

SEQ ID NO: 1001 - DNA, 31 bp, synthetic construct
  misc_feature 1..31: note = Description of Artificial Sequence: Synthetic oligonucleotide
  source 1..31: mol_type = other DNA
ygygtttagygtttygtttattttttggtyg

SEQ ID NO: 1002 - DNA, 25 bp, synthetic construct
  misc_feature 1..25: note = Description of Artificial Sequence: Synthetic oligonucleotide
  source 1..25: mol_type = other DNA
ygtgtattttgaggtttggttggyg

SEQ ID NO: 1003 - DNA, 12 bp, synthetic construct
  misc_feature 1..12: note = Description of Artificial Sequence: Synthetic oligonucleotide
  source 1..12: mol_type = other DNA
ygttgaygagyg

SEQ ID NO: 1004 - skipped

SEQ ID NO: 1005 - DNA, 199 bp, synthetic construct
  misc_feature 1..199: note = Description of Artificial Sequence: Synthetic polynucleotide
  source 1..199: mol_type = other DNA
ygygttygyggtygyggtygttgtatggygttgagatggygggggygtygygyggyggaggyggyggyggaggyggygygggygagttygggggygtygagygggyggtygggataagtygtyggygygggtttygggygtgygaygaggagttygtttgtttagagttggaggygttgtttygyggttataygttgyg

SEQ ID NO: 1006 - DNA, 91 bp, synthetic construct
  misc_feature 1..91: note = Description of Artificial Sequence: Synthetic oligonucleotide
  source 1..91: mol_type = other DNA
yggtttygggtgtagggtggygggttyggyggygygygttttttttttttttttggyggttygtaygtgtygttygygtygygtttttayg

SEQ ID NO: 1007 - DNA, 108 bp, synthetic construct
  misc_feature 1..108: note = Description of Artificial Sequence: Synthetic polynucleotide
  source 1..108: mol_type = other DNA
ygygtttttattgttttatttttttygtttttggagtttttyggtgattttattatagtttttgttattttgtgatttgtaggtattgggagatttatagggaggayg

SEQ ID NO: 1008 - DNA, 13 bp, synthetic construct
  misc_feature 1..13: note = Description of Artificial Sequence: Synthetic oligonucleotide
  source 1..13: mol_type = other DNA
ygtatygatttyg

SEQ ID NO: 1009 - DNA, 176 bp, synthetic construct
  misc_feature 1..176: note = Description of Artificial Sequence: Synthetic polynucleotide
  source 1..176: mol_type = other DNA
yggttygttgggtaaggygttygagaaagygtttggygggaggaggtgygyggttttttgttttaggyggttygggtgttygttttatgyggggygagygttyggtygattttygtyggggyggagtttgaggggtggttgatttatgtayggggattgttatttygtygttttyg

SEQ ID NO: 1010 - skipped

SEQ ID NO: 1011 - DNA, 157 bp, synthetic construct
  misc_feature 1..157: note = Description of Artificial Sequence: Synthetic polynucleotide
  source 1..157: mol_type = other DNA
ygagaagtttygygggagayggyggtttttaaagttattttgggtygygggagygygggatyggggttgygggygtygagagygygtygtttgtygttttygtgygtygtygtygtttttgygygaygtttttyggttaggtttgggaaagygttyg

SEQ ID NO: 1012 - DNA, 66 bp, synthetic construct
  misc_feature 1..66: note = Description of Artificial Sequence: Synthetic oligonucleotide
  source 1..66: mol_type = other DNA
ygygaatygttaggggttttygygttttttttttatttaggttttttgtttttttygtygyggtyg

SEQ ID NO: 1013 - DNA, 498 bp, synthetic construct
  misc_feature 1..498: note = Description of Artificial Sequence: Synthetic polynucleotide
  source 1..498: mol_type = other DNA
ygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayg

SEQ ID NO: 1014 - DNA, 27 bp, synthetic construct
  misc_feature 1..27: note = Description of Artificial Sequence: Synthetic oligonucleotide
  source 1..27: mol_type = other DNA
ygygggttygaaygtttttygygtttg

SEQ ID NO: 1015-1016 - skipped (2 entries)

SEQ ID NO: 1017 - DNA, 16 bp, synthetic construct
  misc_feature 1..16: note = Description of Artificial Sequence: Synthetic oligonucleotide
  source 1..16: mol_type = other DNA
ygtygtttgtttygyg

SEQ ID NO: 1018 - DNA, 53 bp, synthetic construct
  misc_feature 1..53: note = Description of Artificial Sequence: Synthetic oligonucleotide
  source 1..53: mol_type = other DNA
ygyggagggygtygaattagagtttgyggggtttgatagttttttttgyggyg

SEQ ID NO: 1019-1022 - skipped (4 entries)

SEQ ID NO: 1023 - DNA, 14 bp, synthetic construct
  misc_feature 1..14: note = Description of Artificial Sequence: Synthetic oligonucleotide
  source 1..14: mol_type = other DNA
ygtgtttatttayg

SEQ ID NO: 1024 - DNA, 186 bp, synthetic construct
  misc_feature 1..186: note = Description of Artificial Sequence: Synthetic polynucleotide
  source 1..186: mol_type = other DNA
yggygggaaggtttgggtgtttatagatagagttggagtttttyggtgggtggtatagataattagttggggttgttttatatgtaatttaattataggggaaataggtttaaatatygggtgataagtagygtaattgtttygggtgattttgtaattttttttttattaattttttttataayg

SEQ ID NO: 1025 - DNA, 79 bp, synthetic construct
  misc_feature 1..79: note = Description of Artificial Sequence: Synthetic oligonucleotide
  source 1..79: mol_type = other DNA
yggggtaygttygttttyggyggggtttttygtttygttgtgggagtggtagtgggtgtyggggtggagaaagtaygyg

SEQ ID NO: 1026 - DNA, 49 bp, synthetic construct
  misc_feature 1..49: note = Description of Artificial Sequence: Synthetic oligonucleotide
  source 1..49: mol_type = other DNA
ygtygygttygygtygygttttttgtaggtaaygggagaygttttygyg

SEQ ID NO: 1027 - DNA, 17 bp, synthetic construct
  misc_feature 1..17: note = Description of Artificial Sequence: Synthetic oligonucleotide
  source 1..17: mol_type = other DNA
yggatgaatygttygyg

SEQ ID NO: 1028-1030 - skipped (3 entries)

SEQ ID NO: 1031 - DNA, 165 bp, synthetic construct
  misc_feature 1..165: note = Description of Artificial Sequence: Synthetic polynucleotide
  source 1..165: mol_type = other DNA
ygggaaygttgtagtttggttgagygtgatttttaggttttgtgaggaaaagtygagygygttatatygaggygttagtygtttattttattataaggtaaaagatttatgttgttttagttattttaaagttgggagatatattgtattttttattagatttyg

SEQ ID NO: 1032 - DNA, 14 bp, synthetic construct
  misc_feature 1..14: note = Description of Artificial Sequence: Synthetic oligonucleotide
  source 1..14: mol_type = other DNA
ygygygggttagyg

SEQ ID NO: 1033-1034 - skipped (2 entries)

SEQ ID NO: 1035 - DNA, 97 bp, synthetic construct
  misc_feature 1..97: note = Description of Artificial Sequence: Synthetic oligonucleotide
  source 1..97: mol_type = other DNA
ygtgtgtttagggttagtagtaygtataagtgttagygtayggtygtygygtttatgtttaatgygggtttygttgggygtgygggygtgyggggyg

SEQ ID NO: 1036 - skipped

SEQ ID NO: 1037 - DNA, 98 bp, synthetic construct
  misc_feature 1..98: note = Description of Artificial Sequence: Synthetic oligonucleotide
  source 1..98: mol_type = other DNA
ygyggatygygygttttygtygttttgtttttaaatttttgtygtagtttttttttaagttagygaatttattttttaaaattagaaattgaatttyg

SEQ ID NO: 1038 - DNA, 69 bp, synthetic construct
  misc_feature 1..69: note = Description of Artificial Sequence: Synthetic oligonucleotide
  source 1..69: mol_type = other DNA
yggaggggyggaggaggtgttggyggyggtattgagyggyggyggygtagggygygygggtttttygyg

SEQ ID NO: 1039-1042 - skipped (4 entries)

SEQ ID NO: 1043 - DNA, 103 bp, synthetic construct
  misc_feature 1..103: note = Description of Artificial Sequence: Synthetic polynucleotide
  source 1..103: mol_type = other DNA
yggttttaggayggtagggatygygatggagyggtttygggggyggtygggggayggygyggtggyggtyggttagttygttttttygggggyggygggygyg

SEQ ID NO: 1044 - skipped

SEQ ID NO: 1045 - DNA, 21 bp, synthetic construct
  misc_feature 1..21: note = Description of Artificial Sequence: Synthetic oligonucleotide
  source 1..21: mol_type = other DNA
yggtttttggyggyggyggyg

SEQ ID NO: 1046 - DNA, 148 bp, synthetic construct
  misc_feature 1..148: note = Description of Artificial Sequence: Synthetic polynucleotide
  source 1..148: mol_type = other DNA
yggygttttaaaggggaggattttgyggygygggtaagaggyggygggagygygyggttygggagtgtggttgtagtgygtygggatattagggtttygygtttygtatttaagaggttttygygttttaatttttygygttygygyg

SEQ ID NO: 1047-1048 - skipped (2 entries)

SEQ ID NO: 1049 - DNA, 26 bp, synthetic construct
  misc_feature 1..26: note = Description of Artificial Sequence: Synthetic oligonucleotide
  source 1..26: mol_type = other DNA
ygtygagaggtagygygtgatggtyg

SEQ ID NO: 1050 - DNA, 119 bp, synthetic construct
  misc_feature 1..119: note = Description of Artificial Sequence: Synthetic polynucleotide
  source 1..119: mol_type = other DNA
ygtaygtttaagtgygygygttgtygtaattatggygttttgttttggtttaagggttataagygttattgtygttttaaggattgtatttgygagaagtgtatttttattatygagyg

SEQ ID NO: 1051 - DNA, 66 bp, synthetic construct
  misc_feature 1..66: note = Description of Artificial Sequence: Synthetic oligonucleotide
  source 1..66: mol_type = other DNA
yggttygatttttttygtttagtttgggttagaggaagtygaaagyggttttagtaaggtgaggyg

SEQ ID NO: 1052 - DNA, 60 bp, synthetic construct
  misc_feature 1..60: note = Description of Artificial Sequence: Synthetic oligonucleotide
  source 1..60: mol_type = other DNA
ygagygaagtygtygtgtttgggtagaaggygttttaggaggygygaggttttagtygyg

SEQ ID NO: 1053 - skipped

SEQ ID NO: 1054 - DNA, 124 bp, synthetic construct
  misc_feature 1..124: note = Description of Artificial Sequence: Synthetic polynucleotide
  source 1..124: mol_type = other DNA
ygttyggagygggatttgtttgttttagtgtaygtygyggagygaattatygggttggygggggtggaggggtgtaggygtgggggttgygggtygttygggttttgggttttttttgtygtyg

SEQ ID NO: 1055 - skipped

SEQ ID NO: 1056 - DNA, 156 bp, synthetic construct
  misc_feature 1..156: note = Description of Artificial Sequence: Synthetic polynucleotide
  source 1..156: mol_type = other DNA
yggggtatygyggygttygtygtygttttttygtaggtgattatttttttgtaggtgttttygggttttaggtggttgygtgtttgygttatggttgatattttgggygagyggtatttggtgatttgtaagggygygayggtggaggtygaggyg

SEQ ID NO: 1057 - skipped

SEQ ID NO: 1058 - DNA, 91 bp, synthetic construct
  misc_feature 1..91: note = Description of Artificial Sequence: Synthetic oligonucleotide
  source 1..91: mol_type = other DNA
ygygygtygtygaaattttgttttygtygtygtttatygataggttgtggagaaggttatygatygatgttatygagttatttttgaagyg

SEQ ID NO: 1059-1060 - skipped (2 entries)

SEQ ID NO: 1061 - DNA, 89 bp, synthetic construct
  misc_feature 1..89: note = Description of Artificial Sequence: Synthetic oligonucleotide
  source 1..89: mol_type = other DNA
ygttattygygtgttagtagttgggygtttygattttttagatygygtgagtttagtaaagyggttaggygygygtttgtagttyggyg

SEQ ID NO: 1062 - DNA, 13 bp, synthetic construct
  misc_feature 1..13: note = Description of Artificial Sequence: Synthetic oligonucleotide
  source 1..13: mol_type = other DNA
ygtttttaattyg

SEQ ID NO: 1063 - skipped

SEQ ID NO: 1064 - DNA, 47 bp, synthetic construct
  misc_feature 1..47: note = Description of Artificial Sequence: Synthetic oligonucleotide
  source 1..47: mol_type = other DNA
ygagygttagattttagtaataaaaggttaggygaggttatatygyg

SEQ ID NO: 1065-1066 - skipped (2 entries)

SEQ ID NO: 1067 - DNA, 159 bp, synthetic construct
  misc_feature 1..159: note = Description of Artificial Sequence: Synthetic polynucleotide
  source 1..159: mol_type = other DNA
ygatgttygyggygtgaaagygttygyggygggygtygatttttgttttagttttttgtttttttygtttygtttgtttygtgtttttgtgattttggttttggygtygtygtttaggygtttygtaatgtagttgtttttgygtttyggygggaggyg

SEQ ID NO: 1068-1070 - skipped (3 entries)

SEQ ID NO: 1071 - DNA, 78 bp, synthetic construct
  misc_feature 1..78: note = Description of Artificial Sequence: Synthetic oligonucleotide
  source 1..78: mol_type = other DNA
ygggygtygaggtttgggttttagtygtggygttygtttyggygtagtggggagtygygggygtyggagaagyggtyg

SEQ ID NO: 1072 - skipped

SEQ ID NO: 1073 - DNA, 48 bp, synthetic construct
  misc_feature 1..48: note = Description of Artificial Sequence: Synthetic oligonucleotide
  source 1..48: mol_type = other DNA
ygyggaggagtttygtattygatygtgtatagygatygagttggygyg

SEQ ID NO: 1074-1076 - skipped (3 entries)

SEQ ID NO: 1077 - DNA, 157 bp, synthetic construct
  misc_feature 1..157: note = Description of Artificial Sequence: Synthetic polynucleotide
  source 1..157: mol_type = other DNA
ygtttttatagttttgttttgatagttaaggaaaaaatttgttaaaaattagaggygttgttgagtgttggygtgggaatgttagtttagttagagttttgttttgggttatttaaataaaaatagatatgttggtggtaaatgttagttgaatayg

SEQ ID NO: 1078 - skipped

SEQ ID NO: 1079 - DNA, 82 bp, synthetic construct
  misc_feature 1..82: note = Description of Artificial Sequence: Synthetic oligonucleotide
  source 1..82: mol_type = other DNA
ygygygttagtttttygtttygtggaagygtttttttttygatttyggttgattttygttygtygtttttttygygggtgyg

SEQ ID NO: 1080 - DNA, 23 bp, synthetic construct
  misc_feature 1..23: note = Description of Artificial Sequence: Synthetic oligonucleotide
  source 1..23: mol_type = other DNA
ygtttggtygttttatttggtyg

SEQ ID NO: 1081 - DNA, 38 bp, synthetic construct
  misc_feature 1..38: note = Description of Artificial Sequence: Synthetic oligonucleotide
  source 1..38: mol_type = other DNA
ygagttttygygygtttaygagtagttttgygagttyg

SEQ ID NO: 1082 - skipped

SEQ ID NO: 1083 - DNA, 165 bp, synthetic construct
  misc_feature 1..165: note = Description of Artificial Sequence: Synthetic polynucleotide
  source 1..165: mol_type = other DNA
ygtgtttttttttagygagygtagygagttgtttttgaagtttaggtagattaggtygtygtagaagatgaagaagttttyggggattygttggatgyggttgtyggttattagtagtttgygtaygtttagggggaaagggtttggtaygttgggtagttygyg

SEQ ID NO: 1084-1086 - skipped (3 entries)

SEQ ID NO: 1087 - DNA, 23 bp, synthetic construct
  misc_feature 1..23: note = Description of Artificial Sequence: Synthetic oligonucleotide
  source 1..23: mol_type = other DNA
yggtgttygggggtygtttgtyg

SEQ ID NO: 1088 - skipped

SEQ ID NO: 1089 - DNA, 66 bp, synthetic construct
  misc_feature 1..66: note = Description of Artificial Sequence: Synthetic oligonucleotide
  source 1..66: mol_type = other DNA
yggtygtggygggttttttggggyggtagttttaggygygggygygtagtagtttygaaggygtyg

SEQ ID NO: 1090 - DNA, 43 bp, synthetic construct
  misc_feature 1..43: note = Description of Artificial Sequence: Synthetic oligonucleotide
  source 1..43: mol_type = other DNA
ygaataaaaagagtttaggtygygygggygggttgygygttyg

SEQ ID NO: 1091 - skipped

SEQ ID NO: 1092 - DNA, 62 bp, synthetic construct
  misc_feature 1..62: note = Description of Artificial Sequence: Synthetic oligonucleotide
  source 1..62: mol_type = other DNA
ygtttagatgyggyggyggygayggttttagttgygtttygtggttattttygtgtagygyg

SEQ ID NO: 1093 - skipped

SEQ ID NO: 1094 - DNA, 138 bp, synthetic construct
  misc_feature 1..138: note = Description of Artificial Sequence: Synthetic polynucleotide
  source 1..138: mol_type = other DNA
ygaaagattygaaattttaaaagttttattgygtgtttttgggaggggagggggygygttaggaaaggagtggaaaaaagtgggygaggaggagygttgaaaattttttgataagtagttttygtgygttygagagyg

SEQ ID NO: 1095-1098 - skipped (4 entries)

SEQ ID NO: 1099 - DNA, 187 bp, synthetic construct
  misc_feature 1..187: note = Description of Artificial Sequence: Synthetic polynucleotide
  source 1..187: mol_type = other DNA
yggtagaagtgggaggtataygaggagttattggaaayggygtttttgtggaggagtygggggggatggggagtagagggagggggttttgttgttttagygtttygaggtygtggagyggtagtagttgtagtyggagtagtattagtaatagtaatagtgagygggayggagttaggatygttyg

SEQ ID NO: 1100-1101 - skipped (2 entries)

SEQ ID NO: 1102 - DNA, 110 bp, synthetic construct
  misc_feature 1..110: note = Description of Artificial Sequence: Synthetic polynucleotide
  source 1..110: mol_type = other DNA
ygyggygtgtagttyggyggatgttgttaggttaggygatttygtygtttttggagygygagygygttttagtttgtagygatgattttggaattagattttgatttgyg

SEQ ID NO: 1103 - skipped

SEQ ID NO: 1104 - DNA, 189 bp, synthetic construct
  misc_feature 1..189: note = Description of Artificial Sequence: Synthetic polynucleotide
  source 1..189: mol_type = other DNA
ygggaggttttgttygttyggtggttgtygyggtttttttygygttgttttttaygtttggtttattatgtaygaggtaggtaatttgttttttttttyggggatttatttyggagataagaaggtagtttgttttttgtaatggtttttgttggagtgyggyggggtttaggygygagygggggtayg

SEQ ID NO: 1105 - DNA, 42 bp, synthetic construct
  misc_feature 1..42: note = Description of Artificial Sequence: Synthetic oligonucleotide
  source 1..42: mol_type = other DNA
ygttgaaggtgggtggaaygagggygtttgagtgtattygyg

SEQ ID NO: 1106 - DNA, 33 bp, synthetic construct
  misc_feature 1..33: note = Description of Artificial Sequence: Synthetic oligonucleotide
  source 1..33: mol_type = other DNA
ygygygggggttttaggtattttgygttttayg

SEQ ID NO: 1107 - DNA, 15 bp, synthetic construct
  misc_feature 1..15: note = Description of Artificial Sequence: Synthetic oligonucleotide
  source 1..15: mol_type = other DNA
ygygttagtygaayg

SEQ ID NO: 1108 - DNA, 51 bp, synthetic construct
  misc_feature 1..51: note = Description of Artificial Sequence: Synthetic oligonucleotide
  source 1..51: mol_type = other DNA
ygttgggatagagttgtttgttggagttgtygtagatygtygtggtgggyg

SEQ ID NO: 1109 - skipped

SEQ ID NO: 1110 - DNA, 268 bp, synthetic construct
  misc_feature 1..268: note = Description of Artificial Sequence: Synthetic polynucleotide
  source 1..268: mol_type = other DNA
yggagygygtagttygtttttgaataagaagtgagtataatggygtgtttgtaaaaaaaagttttaagttygttttttttaaaaaatattttgaatgttgtatgttttatgttttttagygtttygygggagagattyggttatagagtaggaggtgagatttttttttyggtatttttatttttttggtygtaygtttttttgttttagttttttttgggaggattgtaaatgtttttttttagtaagyggtygttttttattttyg

SEQ ID NO: 1111 - skipped

SEQ ID NO: 1112 - DNA, 33 bp, synthetic construct
  misc_feature 1..33: note = Description of Artificial Sequence: Synthetic oligonucleotide
  source 1..33: mol_type = other DNA
yggagtttttaggagtagttagatygattatyg

SEQ ID NO: 1113 - DNA, 23 bp, synthetic construct
  misc_feature 1..23: note = Description of Artificial Sequence: Synthetic oligonucleotide
  source 1..23: mol_type = other DNA
ygtttattagttygagattttyg

SEQ ID NO: 1114 - DNA, 40 bp, synthetic construct
  misc_feature 1..40: note = Description of Artificial Sequence: Synthetic oligonucleotide
  source 1..40: mol_type = other DNA
ygtttygattygaygttttttygttygattaggtgtttyg

SEQ ID NO: 1115 - DNA, 10 bp, synthetic construct
  misc_feature 1..10: note = Description of Artificial Sequence: Synthetic oligonucleotide
  source 1..10: mol_type = other DNA
ygyggtttyg

SEQ ID NO: 1116 - DNA, 181 bp, synthetic construct
  misc_feature 1..181: note = Description of Artificial Sequence: Synthetic polynucleotide
  source 1..181: mol_type = other DNA
yggttgttgatygtttttttygygttygttagggtttttgtttygygttagttatygygygttttttttttgtttatgtygtagttttygtggtttttgttttggattygggatgttaggttgagataygttttgtaaatttttggtagaaatgggygtaagggggtggatttygttttyg

SEQ ID NO: 1117 - DNA, 195 bp, synthetic construct
  misc_feature 1..195: note = Description of Artificial Sequence: Synthetic polynucleotide
  source 1..195: mol_type = other DNA
ygatttaggaygtyggygtttgttaggattttttygtttgtttttygygtttygygygygtttatgttattattayggggagggtgtatgyggtaggtgtttggtygaggttttygggagygagtygtttttaygtgttttagtttgtttttttttygaagttagaygttggygttgtagttttgttgtttgayg

SEQ ID NO: 1118 - skipped

SEQ ID NO: 1119 - DNA, 358 bp, synthetic construct
  misc_feature 1..358: note = Description of Artificial Sequence: Synthetic polynucleotide
  source 1..358: mol_type = other DNA
yggygttygagtgattttgtttagtttygttttgygtttttgtaaattaygttgttgygttaattataaatttggttaatatgtttttgtaattttattatttaaaaaygtttttaggtatttggtygttgttagattaggttygygggttyggaggaggtttttttatttgttttygttagtttyggggatygtgygyggttttygtgtggttttygtttaygaggtttttygggtaggaatygtygygygatttttgtttagyggtygygttttggttaygggygatttttgtygggaattttgttttyggttaagttgygttttygtatttyggtggtttttattygagttygyg

SEQ ID NO: 1120 - DNA, 13 bp, synthetic construct
  misc_feature 1..13: note = Description of Artificial Sequence: Synthetic oligonucleotide
  source 1..13: mol_type = other DNA
ygtagttgtggyg

SEQ ID NO: 1121-1122 - skipped (2 entries)

SEQ ID NO: 1123 - DNA, 95 bp, synthetic construct
  misc_feature 1..95: note = Description of Artificial Sequence: Synthetic oligonucleotide
  source 1..95: mol_type = other DNA
ygtgyggggttatttgaaggttggggygyggaagtttaatttygtgttgattgggttttaagttttttgygttttygtttygtttygagtgttyg

SEQ ID NO: 1124 - DNA, 45 bp, synthetic construct
  misc_feature 1..45: note = Description of Artificial Sequence: Synthetic oligonucleotide
  source 1..45: mol_type = other DNA
yggtagtaggttggagygtatygtgygygttttgttttttyggyg

SEQ ID NO: 1125 - DNA, 104 bp, synthetic construct
  misc_feature 1..104: note = Description of Artificial Sequence: Synthetic polynucleotide
  source 1..104: mol_type = other DNA
yggttgagtyggagtttaygyggygygygtttttygygaggaatttttyggtttgtaggttgtttgttattttygtttttygaygygtttttttttggttygyg

SEQ ID NO: 1126 - DNA, 87 bp, synthetic construct
  misc_feature 1..87: note = Description of Artificial Sequence: Synthetic oligonucleotide
  source 1..87: mol_type = other DNA
ygttttygttttygttgatattttgtaaagtygyggyggtagyggyggggattaygttgyggtgtattatttttygttattttttyg

SEQ ID NO: 1127 - DNA, 62 bp, synthetic construct
  misc_feature 1..62: note = Description of Artificial Sequence: Synthetic oligonucleotide
  source 1..62: mol_type = other DNA
ygatagtttgygagtttyggttgtaagtggtttttttttttygyggttgttgtttagtgtyg

SEQ ID NO: 1128-1135 - skipped (8 entries)

SEQ ID NO: 1136 - DNA, 145 bp, synthetic construct
  misc_feature 1..145: note = Description of Artificial Sequence: Synthetic polynucleotide
  source 1..145: mol_type = other DNA
ygtyggtttgttggygatttggygtatttgttygygygttttggttttagttgtygtaggttttttttgtatttatttttagtttttaaagttagtgtagttagtatygtttatttggagttttaatttttttttgygattttyg

SEQ ID NO: 1137 - skipped

SEQ ID NO: 1138 - DNA, 19 bp, synthetic construct
  misc_feature 1..19: note = Description of Artificial Sequence: Synthetic oligonucleotide
  source 1..19: mol_type = other DNA
ygtttatygttaggagtyg

SEQ ID NO: 1139 - DNA, 35 bp, synthetic construct
  misc_feature 1..35: note = Description of Artificial Sequence: Synthetic oligonucleotide
  source 1..35: mol_type = other DNA
yggyggyggyggyggttttattagyggagttttyg

SEQ ID NO: 1140-1141 - skipped (2 entries)

SEQ ID NO: 1142 - DNA, 36 bp, synthetic construct
  misc_feature 1..36: note = Description of Artificial Sequence: Synthetic oligonucleotide
  source 1..36: mol_type = other DNA
ygagttggygttggttygttggttgtaggagagtyg

SEQ ID NO: 1143 - skipped

SEQ ID NO: 1144 - DNA, 42 bp, synthetic construct
  misc_feature 1..42: note = Description of Artificial Sequence: Synthetic oligonucleotide
  source 1..42: mol_type = other DNA
yggttgagttttygtttgtttaattttatttgttattgtayg

SEQ ID NO: 1145-1146 - skipped (2 entries)

SEQ ID NO: 1147 - DNA, 18 bp, synthetic construct
  misc_feature 1..18: note = Description of Artificial Sequence: Synthetic oligonucleotide
  source 1..18: mol_type = other DNA
ygygtagygttygygtyg

SEQ ID NO: 1148-1150 - skipped (3 entries)

SEQ ID NO: 1151 - DNA, 118 bp, synthetic construct
  misc_feature 1..118: note = Description of Artificial Sequence: Synthetic polynucleotide
  source 1..118: mol_type = other DNA
ygtgttagatttyggtttygygatttaggtgagtgtygttatygtygtttggagggatttaagggttttgggttgggatttggggtygtatyggggtttgaggtagaatagygaygyg

SEQ ID NO: 1152 - DNA, 22 bp, synthetic construct
  misc_feature 1..22: note = Description of Artificial Sequence: Synthetic oligonucleotide
  source 1..22: mol_type = other DNA
ygaatygygggyggygyggayg

SEQ ID NO: 1153-1156 - skipped (4 entries)

SEQ ID NO: 1157 - DNA, 31 bp, synthetic construct
  misc_feature 1..31: note = Description of Artificial Sequence: Synthetic oligonucleotide
  source 1..31: mol_type = other DNA
ygataagagttyggtgttgagatgtgttayg

SEQ ID NO: 1158-1166 - skipped (9 entries)

SEQ ID NO: 1167 - DNA, 69 bp, synthetic construct
  misc_feature 1..69: note = Description of Artificial Sequence: Synthetic oligonucleotide
  source 1..69: mol_type = other DNA
ygttaggggyggttagyggtygtttggttggygtgtyggyggygttyggggagggygggtyggggggyg

SEQ ID NO: 1168 - DNA, 415 bp, synthetic construct
  misc_feature 1..415: note = Description of Artificial Sequence: Synthetic polynucleotide
  source 1..415: mol_type = other DNA
ygtttttttttttggttygattggttttggttttttttaygtttttagtttttaaattggygttygttttatggttygtgtaggaygttaaaagtayggtaaattttagggygatttttagtagaygttttygaygtatgatgtygagtygttatyggttttygtygttttttgtygygttyggggttyggtttgyggtygtygttgygttttgaagygtatygygtygtyggggtttygttatttygtygttygtttttygggtygggtttttttygttttttttaggygttgtttttattttaggyggtttttgttagttgtaatatagagataaattttygaggyggggagatttttagggtatygggatgttgaagtttygyggtttttatttttaagtttaattygtgyg

SEQ ID NO: 1169-1173 - skipped (5 entries)

SEQ ID NO: 1174 - DNA, 62 bp, synthetic construct
  misc_feature 1..62: note = Description of Artificial Sequence: Synthetic oligonucleotide
  source 1..62: mol_type = other DNA
ygygttygtygttagttygtatagygtttygtatattttygtaygygtttgaaatgygtayg

SEQ ID NO: 1175-1178 - skipped (4 entries)

SEQ ID NO: 1179 - DNA, 20 bp, synthetic construct
  misc_feature 1..20: note = Description of Artificial Sequence: Synthetic oligonucleotide
  source 1..20: mol_type = other DNA
ygtaaaygtaaaagttttyg

SEQ ID NO: 1180 - DNA, 69 bp, synthetic construct
  misc_feature 1..69: note = Description of Artificial Sequence: Synthetic oligonucleotide
  source 1..69: mol_type = other DNA
ygttttttggggtttttggttgtygagtttygttaaggtaaagaygttagtaagygaggaagygtagyg

SEQ ID NO: 1181 - skipped

SEQ ID NO: 1182 - DNA, 318 bp, synthetic construct
  misc_feature 1..318: note = Description of Artificial Sequence: Synthetic polynucleotide
  source 1..318: mol_type = other DNA
ygtttygyggtagtgttagttttttggggattaggaagggygatttttgtttgggagttagtgtttgggtygtygggttygggtaagygttgggggtttggttygagaagatgyggataggtggtttagggygtygyggattttygttttttgygggtatygggagtttagggtygaggygygtygtttygaggggtttttttttttaataatgygttyggaatggagttygygttttgatagygygggttagttygaaatygtttagaattygtttygatgagtgggtgagtygttttgggagtttgtygygtttyg

SEQ ID NO: 1183 - DNA, 27 bp, synthetic construct
  misc_feature 1..27: note = Description of Artificial Sequence: Synthetic oligonucleotide
  source 1..27: mol_type = other DNA
ygtggtggtttttygagyggaggygyg

SEQ ID NO: 1184 - skipped

SEQ ID NO: 1185 - DNA, 13 bp, synthetic construct
  misc_feature 1..13: note = Description of Artificial Sequence: Synthetic oligonucleotide
  source 1..13: mol_type = other DNA
ygagtttttygyg

SEQ ID NO: 1186 - DNA, 189 bp, synthetic construct
  misc_feature 1..189: note = Description of Artificial Sequence: Synthetic polynucleotide
  source 1..189: mol_type = other DNA
yggtgaygatgtgtagagttttttggtatagattgtttatttygttttttttgtggaaatttatygtttggtttttttttygtttttttttttttttttagttagtygttttttttttttttygtatttttaatttttttggygttttaagttatagttygttygyggtgattttggttggagattgyg

SEQ ID NO: 1187-1188 - skipped (2 entries)

SEQ ID NO: 1189 - DNA, 13 bp, synthetic construct
  misc_feature 1..13: note = Description of Artificial Sequence: Synthetic oligonucleotide
  source 1..13: mol_type = other DNA
ygggggttgagyg

SEQ ID NO: 1190 - DNA, 51 bp, synthetic construct
  misc_feature 1..51: note = Description of Artificial Sequence: Synthetic oligonucleotide
  source 1..51: mol_type = other DNA
yggygtgtgtygtgygtggggtggggtgygggttgggyggtttygttttyg

SEQ ID NO: 1191 - DNA, 289 bp, synthetic construct
  misc_feature 1..289: note = Description of Artificial Sequence: Synthetic polynucleotide
  source 1..289: mol_type = other DNA
ygttygttygtatttygtttttttyggttttttttttaaattttaaaygtatygtygtgttttaaagaaggtgtttaygtygtttttagatttyggagygttttttttttattttygggattttttaggtygtttatttttttygtttttygtttagatttgagagggatygaaaatatattttygattygggtagttagggtygaaattgttaagaggagaaaaggtaaagyggaaggagggtggttataaatagatttttttgtttttttttaaaaggatattgtyg

SEQ ID NO: 1192 - skipped

SEQ ID NO: 1193 - DNA, 165 bp, synthetic construct
  misc_feature 1..165: note = Description of Artificial Sequence: Synthetic polynucleotide
  source 1..165: mol_type = other DNA
yggatttgttttygtagtygttgyggatttttyggtygttatggygattgtgaaatgtggggtggggygtatgygttggaagttattygygygggtagtttttgagtgtttttttaygtgttttttagygygagtagtattttygtttttgygttttttagagyg

SEQ ID NO: 1194 - DNA, 21 bp, synthetic construct
  misc_feature 1..21: note = Description of Artificial Sequence: Synthetic oligonucleotide
  source 1..21: mol_type = other DNA
ygtygtttttgtattatttyg

SEQ ID NO: 1195-1197 - skipped (3 entries)

SEQ ID NO: 1198 - DNA, 159 bp, synthetic construct
  misc_feature 1..159: note = Description of Artificial Sequence: Synthetic polynucleotide
  source 1..159: mol_type = other DNA
yggttgygttggtygtattgtttttttataatatgagtagygtyggyggygatygtttgggtygyggtaagtyggttygttgyggttttatttttttygtgggtygygtgtatygttggatggtggatagtygygtggygttgygtatttaygagtayg

SEQ ID NO: 1199 - skipped

SEQ ID NO: 1200 - DNA, 129 bp, synthetic construct
  misc_feature 1..129: note = Description of Artificial Sequence: Synthetic polynucleotide
  source 1..129: mol_type = other DNA
yggggggyggaatttagagaggtaaagtgattygtttttaaatygtaatattaggaggatagtagggttagatggaatttttyggtttatagttttygatttygggtaagtgttttattygggygtayg

SEQ ID NO: 1201 - skipped

SEQ ID NO: 1202 - DNA, 120 bp, synthetic construct
  misc_feature 1..120: note = Description of Artificial Sequence: Synthetic polynucleotide
  source 1..120: mol_type = other DNA
ygttggagatggygagtttygagattttttttattttttgtttttagagtaattttatggtattaaaaaaaaaaaaaaaaaaaaaaaaaaaaaaaaaaaaaaaaaaagaaggagaaggyg

SEQ ID NO: 1203 - skipped

SEQ ID NO: 1204 - DNA, 171 bp, synthetic construct
  misc_feature 1..171: note = Description of Artificial Sequence: Synthetic polynucleotide
  source 1..171: mol_type = other DNA
ygyggaygttgaygattttttttaygttygataagttttygttttygtygtatygttggyggttaatygggygttgygaggatttaaattagagagttygggatattattgtgggggttggaggtygttttttaatttgggtttagtattaataggtgtagtagtygagyg

SEQ ID NO: 1205-1207 - skipped (3 entries)

SEQ ID NO: 1208 - DNA, 64 bp, synthetic construct
  misc_feature 1..64: note = Description of Artificial Sequence: Synthetic oligonucleotide
  source 1..64: mol_type = other DNA
yggtaggtgagyggygyggttgtaggtgagtagtagtttyggttygygygtttagtttttttyg

SEQ ID NO: 1209-1212 - skipped (4 entries)

SEQ ID NO: 1213 - DNA, 16 bp, synthetic construct
  misc_feature 1..16: note = Description of Artificial Sequence: Synthetic oligonucleotide
  source 1..16: mol_type = other DNA
ygtttygtagggttyg

SEQ ID NO: 1214-1216 - skipped (3 entries)

SEQ ID NO: 1217 - DNA, 18 bp, synthetic construct
  misc_feature 1..18: note = Description of Artificial Sequence: Synthetic oligonucleotide
  source 1..18: mol_type = other DNA
ygtattttttyggtygyg

SEQ ID NO: 1218 - DNA, 118 bp, synthetic construct
  misc_feature 1..118: note = Description of Artificial Sequence: Synthetic polynucleotide
  source 1..118: mol_type = other DNA
ygggyggatgggggttatygaggyggttygtttttaggygtatatttygtatatttttttgttaagtgaaggggttaaaatgtatagatgggggagtttatttaggaatagaggygyg

SEQ ID NO: 1219-1223 - skipped (5 entries)

SEQ ID NO: 1224 - DNA, 22 bp, synthetic construct
  misc_feature 1..22: note = Description of Artificial Sequence: Synthetic oligonucleotide
  source 1..22: mol_type = other DNA
ygygtygttttagaggagttyg

SEQ ID NO: 1225 - DNA, 112 bp, synthetic construct
  misc_feature 1..112: note = Description of Artificial Sequence: Synthetic polynucleotide
  source 1..112: mol_type = other DNA
ygggagygtaygagtgtgtgtgtgtgtgtgtgtgttygyggtgtgttygyggttyggtgtataygygygygggttgtaaagttaggagttgygggagygtttttttgtttyg

SEQ ID NO: 1226 - DNA, 109 bp, synthetic construct
  misc_feature 1..109: note = Description of Artificial Sequence: Synthetic polynucleotide
  source 1..109: mol_type = other DNA
ygttttgtttgggttgggtttatttaygttttgggtggggtttaggaattgygtgygggygtagygggtgagtatgttgatgatgattatttggttttatttttttayg

SEQ ID NO: 1227-1229 - skipped (3 entries)

SEQ ID NO: 1230 - DNA, 431 bp, synthetic construct
  misc_feature 1..431: note = Description of Artificial Sequence: Synthetic polynucleotide
  source 1..431: mol_type = other DNA
ygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggatayg

SEQ ID NO: 1231 - skipped

SEQ ID NO: 1232 - DNA, 40 bp, synthetic construct
  misc_feature 1..40: note = Description of Artificial Sequence: Synthetic oligonucleotide
  source 1..40: mol_type = other DNA
ygtygygtttygttgtagtttygttggagagatggggayg

SEQ ID NO: 1233 - skipped

SEQ ID NO: 1234 - DNA, 22 bp, synthetic construct
  misc_feature 1..22: note = Description of Artificial Sequence: Synthetic oligonucleotide
  source 1..22: mol_type = other DNA
ygttagtaggtttagggttayg

SEQ ID NO: 1235 - skipped

SEQ ID NO: 1236 - DNA, 47 bp, synthetic construct
  misc_feature 1..47: note = Description of Artificial Sequence: Synthetic oligonucleotide
  source 1..47: mol_type = other DNA
ygggtattttgtattgtaygtagtatatgttgtggttttttagttyg

SEQ ID NO: 1237 - DNA, 24 bp, synthetic construct
  misc_feature 1..24: note = Description of Artificial Sequence: Synthetic oligonucleotide
  source 1..24: mol_type = other DNA
ygtygttgggggatttttggtayg

SEQ ID NO: 1238 - skipped

SEQ ID NO: 1239 - DNA, 45 bp, synthetic construct
  misc_feature 1..45: note = Description of Artificial Sequence: Synthetic oligonucleotide
  source 1..45: mol_type = other DNA
ygggattttaggtttatttagtaagttaattggttgaggttttyg

SEQ ID NO: 1240 - skipped

SEQ ID NO: 1241 - DNA, 258 bp, synthetic construct
  misc_feature 1..258: note = Description of Artificial Sequence: Synthetic polynucleotide
  source 1..258: mol_type = other DNA
ygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygyg

SEQ ID NO: 1242 - DNA, 45 bp, synthetic construct
  misc_feature 1..45: note = Description of Artificial Sequence: Synthetic oligonucleotide
  source 1..45: mol_type = other DNA
ygttttggyggtttygagggatttgggttygggtttgyggtygyg

SEQ ID NO: 1243-1244 - skipped (2 entries)

SEQ ID NO: 1245 - DNA, 67 bp, synthetic construct
  misc_feature 1..67: note = Description of Artificial Sequence: Synthetic oligonucleotide
  source 1..67: mol_type = other DNA
yggggygttaatagtttaggatttgggttgtaggttggtttttgtattaattagyggggyggtttyg

SEQ ID NO: 1246 - DNA, 43 bp, synthetic construct
  misc_feature 1..43: note = Description of Artificial Sequence: Synthetic oligonucleotide
  source 1..43: mol_type = other DNA
yggttgattygtagyggtagyggtagtagygaggattygagyg

SEQ ID NO: 1247-1248 - skipped (2 entries)

SEQ ID NO: 1249 - DNA, 113 bp, synthetic construct
  misc_feature 1..113: note = Description of Artificial Sequence: Synthetic polynucleotide
  source 1..113: mol_type = other DNA
ygtgtgtttagttgaatttagtatatttttttygtatttttygtttttttttttttttttttgaatttgtttttttgttttgygggtttttaatttttttygaatttygggyg

SEQ ID NO: 1250-1251 - skipped (2 entries)

SEQ ID NO: 1252 - DNA, 84 bp, synthetic construct
  misc_feature 1..84: note = Description of Artificial Sequence: Synthetic oligonucleotide
  source 1..84: mol_type = other DNA
ygttgygygtygttttygyggagtygagyggyggtggttgyggaagygattggggttgygyggatattagygttttagagttyg

SEQ ID NO: 1253 - skipped

SEQ ID NO: 1254 - DNA, 48 bp, synthetic construct
  misc_feature 1..48: note = Description of Artificial Sequence: Synthetic oligonucleotide
  source 1..48: mol_type = other DNA
ygygttttattttgtagyggtggttttggaattagattttgatttgyg

SEQ ID NO: 1255 - DNA, 228 bp, synthetic construct
  misc_feature 1..228: note = Description of Artificial Sequence: Synthetic polynucleotide
  source 1..228: mol_type = other DNA
ygggtygygygtttatttgygttttygtygtygaaggagtttatgtaygggaagtagatggygagygtttygaaggaggyggatagattgaggyggttttgygagygttttatgttygygtyggygtygggygtttyggtygyggyggyggyggyggyggygggyggtttgggtagtttggtygttttatttttgaygyggagtayggygygyggygtggtggyggyg

SEQ ID NO: 1256 - DNA, 47 bp, synthetic construct
  misc_feature 1..47: note = Description of Artificial Sequence: Synthetic oligonucleotide
  source 1..47: mol_type = other DNA
ygtattttggtygtaataagygygttttaygtygttaygtattagyg

SEQ ID NO: 1257 - DNA, 185 bp, synthetic construct
  misc_feature 1..185: note = Description of Artificial Sequence: Synthetic polynucleotide
  source 1..185: mol_type = other DNA
ygygtagggggygggttttatttttttttygttttygtttyggttttaagtygyggaggygttyggtgggatttygttgttgtttaattaggggggatygggtgagtttttttttttggagtygggttttattagygtygtaggtttataggtygggggtgggggttttggatygaggggyggyg

SEQ ID NO: 1258 - DNA, 216 bp, synthetic construct
  misc_feature 1..216: note = Description of Artificial Sequence: Synthetic polynucleotide
  source 1..216: mol_type = other DNA
ygggggygttaatttygggagtaggaggtygggttttagtygtygggttttgygygtttgttttttgyggygyggtyggtatttgtagttggggtggtygygtaagtgttgtaygygtagtygttyggttttttttaygaagggtygttttttygtygygtttagttttttttaygttttgtttgygggtygtgggygttagtgagtggaaygtyg

SEQ ID NO: 1259 - DNA, 344 bp, synthetic construct
  misc_feature 1..344: note = Description of Artificial Sequence: Synthetic polynucleotide
  source 1..344: mol_type = other DNA
ygtggtttygtgtttyggggygygttttagtttyggtattattagtttttygtttttttyggaggggygttygagtgygttygatayggttagtagygtygyggygagtagtagtagygtgggtattggtttaaagtttygagatttyggagttygtttygygttttttatgtygttgtttagtttgygtttttygaatttttygggtatagttygttgtattggagttttaggagatatygttygtagtagygtayggagygagggatttttagttygggtygggagagtaaagtttygttggtttgttttggattgttaaaattaataatttttattattyg

SEQ ID NO: 1260 - DNA, 28 bp, synthetic construct
  misc_feature 1..28: note = Description of Artificial Sequence: Synthetic oligonucleotide
  source 1..28: mol_type = other DNA
ygttttgtttggtagttaggtygagayg

SEQ ID NO: 1261 - DNA, 124 bp, synthetic construct
  misc_feature 1..124: note = Description of Artificial Sequence: Synthetic polynucleotide
  source 1..124: mol_type = other DNA
ygtggggygttggatttatygagaggttagygtygtygtygggggagggygtgtttygtaygtgtgtgttygygygtgttygygttygygtgtgttagygygygtgttttggtygtgygygtyg

SEQ ID NO: 1262 - DNA, 80 bp, synthetic construct
  misc_feature 1..80: note = Description of Artificial Sequence: Synthetic oligonucleotide
  source 1..80: mol_type = other DNA
ygttygttagggttaygaagagygtaaygaaygttagtagtayggygtttayggtgagygttygygtygtttgtatttyg

SEQ ID NO: 1263 - DNA, 62 bp, synthetic construct
  misc_feature 1..62: note = Description of Artificial Sequence: Synthetic oligonucleotide
  source 1..62: mol_type = other DNA
yggataggtttygtagtgagtaggtaagggtygtttygtygyggttgtttttttaygtttyg

SEQ ID NO: 1264 - DNA, 165 bp, synthetic construct
  misc_feature 1..165: note = Description of Artificial Sequence: Synthetic polynucleotide
  source 1..165: mol_type = other DNA
ygatygtatgygtygatttgtygttgggygttygtttttttttgttggggttgggygyggtttyggagtttggyggyggtggtgagggygtayggttagttgtagyggygttgtgtttgtygtggatttaggatattttaggtttggtggyggggttaggtggyg

SEQ ID NO: 1265 - DNA, 43 bp, synthetic construct
  misc_feature 1..43: note = Description of Artificial Sequence: Synthetic oligonucleotide
  source 1..43: mol_type = other DNA
ygtttttgtgtttttggtggtttyggygttttttyggagygyg

SEQ ID NO: 1266 - DNA, 86 bp, synthetic construct
  misc_feature 1..86: note = Description of Artificial Sequence: Synthetic oligonucleotide
  source 1..86: mol_type = other DNA
ygtygtygttttygtygggagttaagttygtygggtyggttyggttttaggtgggtagttyggtttgtagttggttggaggtggyg

SEQ ID NO: 1267 - DNA, 23 bp, synthetic construct
  misc_feature 1..23: note = Description of Artificial Sequence: Synthetic oligonucleotide
  source 1..23: mol_type = other DNA
ygagttygtgggataagggggyg

SEQ ID NO: 1268 - skipped

SEQ ID NO: 1269 - DNA, 99 bp, synthetic construct
  misc_feature 1..99: note = Description of Artificial Sequence: Synthetic oligonucleotide
  source 1..99: mol_type = other DNA
ygyggttatgtaattggtggatttttttaaatygttttggaggggggagygyggygttgggggygggagagygtttttggttgtgagttgtttttgtyg

SEQ ID NO: 1270 - DNA, 73 bp, synthetic construct
  misc_feature 1..73: note = Description of Artificial Sequence: Synthetic oligonucleotide
  source 1..73: mol_type = other DNA
ygtggaattygtgagttttaygtaaygtttttttgtygtttagggtgggtttttagaagtatagaaatggtyg

SEQ ID NO: 1271 - skipped

SEQ ID NO: 1272 - DNA, 52 bp, synthetic construct
  misc_feature 1..52: note = Description of Artificial Sequence: Synthetic oligonucleotide
  source 1..52: mol_type = other DNA
yggggygggtagggatygagttaggagagagygggygggggttttgggagyg

SEQ ID NO: 1273 - DNA, 50 bp, synthetic construct
  misc_feature 1..50: note = Description of Artificial Sequence: Synthetic oligonucleotide
  source 1..50: mol_type = other DNA
ygygagtaggagggygtattttatggttaggtgyggaygyggyggttgyg

SEQ ID NO: 1274 - DNA, 50 bp, synthetic construct
  misc_feature 1..50: note = Description of Artificial Sequence: Synthetic oligonucleotide
  source 1..50: mol_type = other DNA
ygggtyggggtattataggygygggaatttaygtgtggattttgygttyg

SEQ ID NO: 1275-1276 - skipped (2 entries)

SEQ ID NO: 1277 - DNA, 52 bp, synthetic construct
  misc_feature 1..52: note = Description of Artificial Sequence: Synthetic oligonucleotide
  source 1..52: mol_type = other DNA
yggggtagygtaggagtaggtaggggttygyggttygygtgggttttaggyg

SEQ ID NO: 1278-1280 - skipped (3 entries)

SEQ ID NO: 1281 - DNA, 138 bp, synthetic construct
  misc_feature 1..138: note = Description of Artificial Sequence: Synthetic polynucleotide
  source 1..138: mol_type = other DNA
ygagtggtagtagtaggagyggggtgaygaataagattaygaaggatttgaatttggagatatagtttagygtygaggttatygygygggagggagattggygggygagaygagtgaggggtagttagaggygtygyg

SEQ ID NO: 1282-1284 - skipped (3 entries)

SEQ ID NO: 1285 - DNA, 1017 bp, synthetic construct
  misc_feature 1..1017: note = Description of Artificial Sequence: Synthetic polynucleotide
  source 1..1017: mol_type = other DNA
cggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcg

SEQ ID NO: 1286 - DNA, 166 bp, synthetic construct
  misc_feature 1..166: note = Description of Artificial Sequence: Synthetic polynucleotide
  source 1..166: mol_type = other DNA
cgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcg

SEQ ID NO: 1287-1292 - skipped (6 entries)

SEQ ID NO: 1293 - DNA, 14 bp, synthetic construct
  misc_feature 1..14: note = Description of Artificial Sequence: Synthetic oligonucleotide
  source 1..14: mol_type = other DNA
cgcgttttagcgcg

SEQ ID NO: 1294-1296 - skipped (3 entries)

SEQ ID NO: 1297 - DNA, 125 bp, synthetic construct
  misc_feature 1..125: note = Description of Artificial Sequence: Synthetic polynucleotide
  source 1..125: mol_type = other DNA
cggttttatttatttgtttcgaagagtggttttagttttgcgtttttttttgcgattttatatatagggatagttttaggtatagttttagtagtaggagtatggcggggcgagggcgcgggacg

SEQ ID NO: 1298 - skipped

SEQ ID NO: 1299 - DNA, 131 bp, synthetic construct
  misc_feature 1..131: note = Description of Artificial Sequence: Synthetic polynucleotide
  source 1..131: mol_type = other DNA
cggggtgtgaagtggcggcgggtagaggggttcgtaggggttgggattcgcgtgtttttttttgtttcggtgcggagtacgatgtgttcgggcgggggcgaggacgttcgggaggggttgggttgcgtacg

SEQ ID NO: 1300 - DNA, 94 bp, synthetic construct
  misc_feature 1..94: note = Description of Artificial Sequence: Synthetic oligonucleotide
  source 1..94: mol_type = other DNA
cgggtttgttttcggtttcgttcggagggtgtgcgggttttcgtttcgttggtttcgtttgtttattacggcgcgtttaaatttacgcggttcg

SEQ ID NO: 1301-1302 - skipped (2 entries)

SEQ ID NO: 1303 - DNA, 27 bp, synthetic construct
  misc_feature 1..27: note = Description of Artificial Sequence: Synthetic oligonucleotide
  source 1..27: mol_type = other DNA
cgcgatggggaggggaatatttgcgcg

SEQ ID NO: 1304 - DNA, 164 bp, synthetic construct
  misc_feature 1..164: note = Description of Artificial Sequence: Synthetic polynucleotide
  source 1..164: mol_type = other DNA
cgagattagaggggaaattcgaaaaagtaagtttttgcggtagtagttaggaaatattcgttaggaattggttgcgattttaattttagcggttcgaagttttagtttttttatttttatcgcggtagagtcgttttcgtagatatttttcgaggagaatcgcg

SEQ ID NO: 1305-1306 - skipped (2 entries)

SEQ ID NO: 1307 - DNA, 68 bp, synthetic construct
  misc_feature 1..68: note = Description of Artificial Sequence: Synthetic oligonucleotide
  source 1..68: mol_type = other DNA
cgttgggttcgtcgaggtcggggtttttttatgggagggaggtggttgcggcggaatttttagatgcg

SEQ ID NO: 1308 - DNA, 508 bp, synthetic construct
  misc_feature 1..508: note = Description of Artificial Sequence: Synthetic polynucleotide
  source 1..508: mol_type = other DNA
cggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcg

SEQ ID NO: 1309-1318 - skipped (10 entries)

SEQ ID NO: 1319 - DNA, 396 bp, synthetic construct
  misc_feature 1..396: note = Description of Artificial Sequence: Synthetic polynucleotide
  source 1..396: mol_type = other DNA
tgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcg

SEQ ID NO: 1320 - skipped

SEQ ID NO: 1321 - DNA, 70 bp, synthetic construct
  misc_feature 1..70: note = Description of Artificial Sequence: Synthetic oligonucleotide
  source 1..70: mol_type = other DNA
cgggtcgttatttgtttatttgttttatttaggatatttttttaaataatttttaagtggaaaaattacg

SEQ ID NO: 1322 - skipped

SEQ ID NO: 1323 - DNA, 68 bp, synthetic construct
  misc_feature 1..68: note = Description of Artificial Sequence: Synthetic oligonucleotide
  source 1..68: mol_type = other DNA
cgcgggggacgcggggcgcggcgcgttgagcgcgggtgtcgaggttggagggcgcggtcgggttttcg

SEQ ID NO: 1324 - DNA, 88 bp, synthetic construct
  misc_feature 1..88: note = Description of Artificial Sequence: Synthetic oligonucleotide
  source 1..88: mol_type = other DNA
cgagggtcggttcgtttttggggattcgcggatgtcgcgagggggcgtcgcgttattgaaggttgggacgggggcggtgcgcggggcg

SEQ ID NO: 1325-1326 - skipped (2 entries)

SEQ ID NO: 1327 - DNA, 87 bp, synthetic construct
  misc_feature 1..87: note = Description of Artificial Sequence: Synthetic oligonucleotide
  source 1..87: mol_type = other DNA
cgagttgtttcgtttttttattttgggggcgaagaagggtcggggagtgggggaaagcgggaggcgtcgcggtttgggaggttttcg

SEQ ID NO: 1328 - DNA, 45 bp, synthetic construct
  misc_feature 1..45: note = Description of Artificial Sequence: Synthetic oligonucleotide
  source 1..45: mol_type = other DNA
cgagtttttgcgttgtttttgtcgtcggagttcgggtttgttacg

SEQ ID NO: 1329 - skipped

SEQ ID NO: 1330 - DNA, 173 bp, synthetic construct
  misc_feature 1..173: note = Description of Artificial Sequence: Synthetic polynucleotide
  source 1..173: mol_type = other DNA
cggttggaatttttttaagtattgttttgagtttatttttaaatgaaagggggaaaaatttaaattagattagaatttgaaatagttgaaatagttatcgatttttagtttgtttttaagtttggtagagattgtgaaagttttaattttttcgcgatgttagttacggttcg

SEQ ID NO: 1331 - skipped

SEQ ID NO: 1332 - DNA, 48 bp, synthetic construct
  misc_feature 1..48: note = Description of Artificial Sequence: Synthetic oligonucleotide
  source 1..48: mol_type = other DNA
cgaagacgagacgtagagttttaattgtagttagagataaaggtttcg

SEQ ID NO: 1333-1334 - skipped (2 entries)

SEQ ID NO: 1335 - DNA, 36 bp, synthetic construct
  misc_feature 1..36: note = Description of Artificial Sequence: Synthetic oligonucleotide
  source 1..36: mol_type = other DNA
cgatcgtggcgttagtttttcgttttttttgtttcg

SEQ ID NO: 1336-1340 - skipped (5 entries)

SEQ ID NO: 1341 - DNA, 97 bp, synthetic construct
  misc_feature 1..97: note = Description of Artificial Sequence: Synthetic oligonucleotide
  source 1..97: mol_type = other DNA
cgtttgtaaggacgggagtcggggagggtgtagggcgagtttaaaggacgggtagagtaagtttcgggaagaggtaggggttttttttttcgggtcg

SEQ ID NO: 1342-1343 - skipped (2 entries)

SEQ ID NO: 1344 - DNA, 67 bp, synthetic construct
  misc_feature 1..67: note = Description of Artificial Sequence: Synthetic oligonucleotide
  source 1..67: mol_type = other DNA
cgttagatttttatagttttttatacgttatttttattgttttagggaattataagtataggtatcg

SEQ ID NO: 1345 - skipped

SEQ ID NO: 1346 - DNA, 29 bp, synthetic construct
  misc_feature 1..29: note = Description of Artificial Sequence: Synthetic oligonucleotide
  source 1..29: mol_type = other DNA
cgatagggtagagggttagtagttattcg

SEQ ID NO: 1347 - DNA, 49 bp, synthetic construct
  misc_feature 1..49: note = Description of Artificial Sequence: Synthetic oligonucleotide
  source 1..49: mol_type = other DNA
cggtcgagtttaagtggttgaagcgcggacgaggatgcgcggggtttcg

SEQ ID NO: 1348 - DNA, 188 bp, synthetic construct
  misc_feature 1..188: note = Description of Artificial Sequence: Synthetic polynucleotide
  source 1..188: mol_type = other DNA
cgggagttcgaagtcgtttcgagcgggggtgggcggtgagcggattttcgggtgttgattaggtgtttggtggtagagtagggaaggggggaacggacgtcgattttagggattttttattcgtttacgttttttggcgttggttatacgtcgtcgttttagtattaattggaggtttttagtggacg

SEQ ID NO: 1349-1350 - skipped (2 entries)

SEQ ID NO: 1351 - DNA, 113 bp, synthetic construct
  misc_feature 1..113: note = Description of Artificial Sequence: Synthetic polynucleotide
  source 1..113: mol_type = other DNA
cggtcgtgggcggttgcggcgcggtcgcggcgaggggcgagcggggttggtttcgtcgttcgggcgagagtatttttttgggggttaattttgcggtttcgtttttattcgcg

SEQ ID NO: 1352 - DNA, 208 bp, synthetic construct
  misc_feature 1..208: note = Description of Artificial Sequence: Synthetic polynucleotide
  source 1..208: mol_type = other DNA
cggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcg

SEQ ID NO: 1353 - DNA, 96 bp, synthetic construct
  misc_feature 1..96: note = Description of Artificial Sequence: Synthetic oligonucleotide
  source 1..96: mol_type = other DNA
cggttcgttcgttttttagtagttttggggtgttcggggcggttttgtaagcgggagagagcggcgaggcggcggcgtcgagtgcggggggatgcg

SEQ ID NO: 1354 - DNA, 236 bp, synthetic construct
  misc_feature 1..236: note = Description of Artificial Sequence: Synthetic polynucleotide
  source 1..236: mol_type = other DNA
cggtgagtattcgtcgtggggaagggttttggggatttattggaggtcgcggttcgtagtagttaggggtcgagttacggttacggacgttttggtgtttcggttcgtgtcgggtttttaggcggaggaggcgttcgttgggtttagattttcgattttagtttcggtttttcggcgtttgggttgcgcggagtttttgtttcgcgtttcggatttttacgcgtagtttttacgcg

SEQ ID NO: 1355 - DNA, 211 bp, synthetic construct
  misc_feature 1..211: note = Description of Artificial Sequence: Synthetic polynucleotide
  source 1..211: mol_type = other DNA
cgtttttagtcgtgttttggttgcgtagttggaaaggttgagtagtttattgttgtttttttgttcggttttggatatatcgtttgaatttttgggcgtttttgttgttaagtgggggatagtattatttattggggaggaaaattttaggaatgtggattttggggttacgtaggggttgggaagtgaagggtagggaacgcgggcggcg

SEQ ID NO: 1356 - DNA, 193 bp, synthetic construct
  misc_feature 1..193: note = Description of Artificial Sequence: Synthetic polynucleotide
  source 1..193: mol_type = other DNA
cgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagttagaggaggtttcgtttcgatttggggtttttcgcg

SEQ ID NO: 1357 - skipped

SEQ ID NO: 1358 - DNA, 199 bp, synthetic construct
  misc_feature 1..199: note = Description of Artificial Sequence: Synthetic polynucleotide
  source 1..199: mol_type = other DNA
cgagtaggaggatttaacgaatttagtttgtggatatgttttaatttttattttcgttttttttaggtttgtttaggtgaggatgatgggagggaaaagcggtgtatagtcgtaatattggtattttgtaagagtcgtcggggtattgatatagagggatatcgtattggagatgcggtgtttacggagatttattgcg

SEQ ID NO: 1359 - DNA, 87 bp, synthetic construct
  misc_feature 1..87: note = Description of Artificial Sequence: Synthetic oligonucleotide
  source 1..87: mol_type = other DNA
cggttagtagaggcggcgtttggttttggatgttgtagcggagacgttaaggagattgaatgtagggagcgaggcgtagcggtcgcg

SEQ ID NO: 1360 - DNA, 68 bp, synthetic construct
  misc_feature 1..68: note = Description of Artificial Sequence: Synthetic oligonucleotide
  source 1..68: mol_type = other DNA
cgcgcgagagtgtttagttgggaaatgtagtttcgaattaatatcgtatgttttataattagtttacg

SEQ ID NO: 1361 - DNA, 61 bp, synthetic construct
  misc_feature 1..61: note = Description of Artificial Sequence: Synthetic oligonucleotide
  source 1..61: mol_type = other DNA
cgtttttggtatttagggaatggtttgtaaattttaatgtattatagattagtttttatcg

SEQ ID NO: 1362 - DNA, 40 bp, synthetic construct
  misc_feature 1..40: note = Description of Artificial Sequence: Synthetic oligonucleotide
  source 1..40: mol_type = other DNA
cgggtgttttgtcgttgtcgtttttgttgtcgtcgattcg

SEQ ID NO: 1363 - DNA, 647 bp, synthetic construct
  misc_feature 1..647: note = Description of Artificial Sequence: Synthetic polynucleotide
  source 1..647: mol_type = other DNA
cgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcg

SEQ ID NO: 1364 - DNA, 327 bp, synthetic construct
  misc_feature 1..327: note = Description of Artificial Sequence: Synthetic polynucleotide
  source 1..327: mol_type = other DNA
cgcggaggagggtcgggttgattgtcgtcgttgagttgttttcggacgggagcgtttgtttacggtatttattttttttagcggtggaaatgtggagaagtaagtgggaggcggtgtcgggaattgattttttttaaaacggtcggcgtcgttgttttgaaatgggcggttaagtgtttgtgggattaagggcggttttagagatgttcggaaaatcgttgttacggttagagtgcggcgtagacgcggtagagttggaggtgttcgcggtgtaggttgttgtttacgtcgtttaggttaggtgttgagggtttagttcgcgtttcg

SEQ ID NO: 1365 - skipped

SEQ ID NO: 1366 - DNA, 324 bp, synthetic construct
  misc_feature 1..324: note = Description of Artificial Sequence: Synthetic polynucleotide
  source 1..324: mol_type = other DNA
cgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcg

SEQ ID NO: 1367 - DNA, 77 bp, synthetic construct
  misc_feature 1..77: note = Description of Artificial Sequence: Synthetic oligonucleotide
  source 1..77: mol_type = other DNA
cggcgtagcggcgggaattcgaggtcgagcgtcgcggcggtagcgttagaagcgtatttatcgggtacggcgaggcg

SEQ ID NO: 1368 - DNA, 158 bp, synthetic construct
  misc_feature 1..158: note = Description of Artificial Sequence: Synthetic polynucleotide
  source 1..158: mol_type = other DNA
cgttttggattttcgaagttagttttttgcgtagcggattagagaggtttattcgcggacgttaatttaatttttgggcggggttcgggggttgagtagaaggcgaggtttggggagtacggataattttgagggttgtttgtgtcggggtgggagcg

SEQ ID NO: 1369 - DNA, 79 bp, synthetic construct
  misc_feature 1..79: note = Description of Artificial Sequence: Synthetic oligonucleotide
  source 1..79: mol_type = other DNA
cgtttttaaaaattaaataaattaataagagaattaattaataggtagcgttgcgatcgttaggagcgcggagcgcgcg

SEQ ID NO: 1370 - DNA, 137 bp, synthetic construct
  misc_feature 1..137: note = Description of Artificial Sequence: Synthetic polynucleotide
  source 1..137: mol_type = other DNA
cgttttttttgatttttaaggttagaaagatttattatttttttcgagagggcgtagttatagatttattagagagggcgggtagggtgtcggaagttagagaacggcgtttcgcgtttttttatcgttttagggcg

SEQ ID NO: 1371 - DNA, 112 bp, synthetic construct
  misc_feature 1..112: note = Description of Artificial Sequence: Synthetic polynucleotide
  source 1..112: mol_type = other DNA
cgcgggttatgtattgttgttggtgtttattatgtttaattttttggattataagtggtataaggagtcgttgtagtagtgtaatttcgatgggtcgttgggtgtcgtagcg

SEQ ID NO: 1372-1373 - skipped (2 entries)

SEQ ID NO: 1374 - DNA, 282 bp, synthetic construct
  misc_feature 1..282: note = Description of Artificial Sequence: Synthetic polynucleotide
  source 1..282: mol_type = other DNA
cgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcg

SEQ ID NO: 1375 - DNA, 81 bp, synthetic construct
  misc_feature 1..81: note = Description of Artificial Sequence: Synthetic oligonucleotide
  source 1..81: mol_type = other DNA
cggttgttaattcgtttaatttgttgcgcgggtggtcgtttagagtcgcgggtttgcggggcgtttttcgtcgtcgcgtcg

SEQ ID NO: 1376 - DNA, 53 bp, synthetic construct
  misc_feature 1..53: note = Description of Artificial Sequence: Synthetic oligonucleotide
  source 1..53: mol_type = other DNA
cggtcgtggagattttaatcgagtttacgttggcgtaaaaggtaaaagtcgcg

SEQ ID NO: 1377 - DNA, 40 bp, synthetic construct
  misc_feature 1..40: note = Description of Artificial Sequence: Synthetic oligonucleotide
  source 1..40: mol_type = other DNA
cgcgtcgagggggcgttagcggggacgtgagttggcgtcg

SEQ ID NO: 1378 - DNA, 206 bp, synthetic construct
  misc_feature 1..206: note = Description of Artificial Sequence: Synthetic polynucleotide
  source 1..206: mol_type = other DNA
cggtagtttgagcgtttcggatggttcgcggcggggcggtttgtaagagcgacgcgcggttgttgttggggcgggacgcgttgcggtcggcgttcgttttgttggttttcgtcgtgttgttgggcgtcgcgttcggtttcggtttcggtttttggtttggttgtcgcgcgggtcgttagcgtacgcgatattaggtgggtcggtcg

SEQ ID NO: 1379 - DNA, 38 bp, synthetic construct
  misc_feature 1..38: note = Description of Artificial Sequence: Synthetic oligonucleotide
  source 1..38: mol_type = other DNA
cgagggtacggcggtcgtcgtttcgcgtagtagtagcg

SEQ ID NO: 1380 - skipped

SEQ ID NO: 1381 - DNA, 25 bp, synthetic construct
  misc_feature 1..25: note = Description of Artificial Sequence: Synthetic oligonucleotide
  source 1..25: mol_type = other DNA
cgagcgaatgtaacgcgtatatacg

SEQ ID NO: 1382 - DNA, 79 bp, synthetic construct
  misc_feature 1..79: note = Description of Artificial Sequence: Synthetic oligonucleotide
  source 1..79: mol_type = other DNA
cgtttttttttttttttaaaaaaaaaatttaaataatttttaaataatatttaataggaaagaagaaggaaaaggagcg

SEQ ID NO: 1383 - DNA, 33 bp, synthetic construct
  misc_feature 1..33: note = Description of Artificial Sequence: Synthetic oligonucleotide
  source 1..33: mol_type = other DNA
cgagggtaacggtcgaggcgttacgcggggtcg

SEQ ID NO: 1384 - DNA, 132 bp, synthetic construct
  misc_feature 1..132: note = Description of Artificial Sequence: Synthetic polynucleotide
  source 1..132: mol_type = other DNA
cgtaggttaggcggtcgtgggtcgagttggttatgattattttttcgcgggcgttttgtttgggcgagtgtttttcgtagcgttcgtatttcgtttttttcgtgtgtagtttcgcgtcgtcgtcgttcgtcg

SEQ ID NO: 1385 - DNA, 32 bp, synthetic construct
  misc_feature 1..32: note = Description of Artificial Sequence: Synthetic oligonucleotide
  source 1..32: mol_type = other DNA
cgttttcggggtagaggagggggtgttaggcg

SEQ ID NO: 1386-1387 - skipped (2 entries)

SEQ ID NO: 1388 - DNA, 20 bp, synthetic construct
  misc_feature 1..20: note = Description of Artificial Sequence: Synthetic oligonucleotide
  source 1..20: mol_type = other DNA
cggcgtcgttggtatattcg

SEQ ID NO: 1389 - DNA, 85 bp, synthetic construct
  misc_feature 1..85: note = Description of Artificial Sequence: Synthetic oligonucleotide
  source 1..85: mol_type = other DNA
cggcgggcgtaggggtagggtatgattgacgcgttttttgtttgcgtttatgtgagagaaagcggtcgagggagggagcgtgtcg

SEQ ID NO: 1390 - DNA, 230 bp, synthetic construct
  misc_feature 1..230: note = Description of Artificial Sequence: Synthetic polynucleotide
  source 1..230: mol_type = other DNA
cgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcggggtcg

SEQ ID NO: 1391 - DNA, 84 bp, synthetic construct
  misc_feature 1..84: note = Description of Artificial Sequence: Synthetic oligonucleotide
  source 1..84: mol_type = other DNA
cgtaagagttggttaaaatgtttttaggtgcgtgggggtttcggggttttagttggagttcgatattttgagattggcggttcg

SEQ ID NO: 1392 - DNA, 42 bp, synthetic construct
  misc_feature 1..42: note = Description of Artificial Sequence: Synthetic oligonucleotide
  source 1..42: mol_type = other DNA
cgcgcgagttttttcgtttggttgagttaaaaagggatcgcg

SEQ ID NO: 1393 - DNA, 45 bp, synthetic construct
  misc_feature 1..45: note = Description of Artificial Sequence: Synthetic oligonucleotide
  source 1..45: mol_type = other DNA
cggacgattttttttattttttcgaggacgaggaggagtacggcg

SEQ ID NO: 1394 - DNA, 26 bp, synthetic construct
  misc_feature 1..26: note = Description of Artificial Sequence: Synthetic oligonucleotide
  source 1..26: mol_type = other DNA
cgcgggataagggatgttggcgggcg

SEQ ID NO: 1395 - DNA, 50 bp, synthetic construct
  misc_feature 1..50: note = Description of Artificial Sequence: Synthetic oligonucleotide
  source 1..50: mol_type = other DNA
cgaggtttttttcgcggcgcgcggtagttttagtttttatttaaatttcg

SEQ ID NO: 1396 - DNA, 56 bp, synthetic construct
  misc_feature 1..56: note = Description of Artificial Sequence: Synthetic oligonucleotide
  source 1..56: mol_type = other DNA
cgttggtttattcgcgtgtacgtttattttttacgcgcgtttttggtttagaagcg

SEQ ID NO: 1397 - DNA, 44 bp, synthetic construct; identical to SEQ ID NO: 113
  misc_feature 1..44: note = Description of Artificial Sequence: Synthetic oligonucleotide
  source 1..44: mol_type = other DNA

SEQ ID NO: 1398-1399 - skipped (2 entries)

SEQ ID NO: 1400 - DNA, 58 bp, synthetic construct
  misc_feature 1..58: note = Description of Artificial Sequence: Synthetic oligonucleotide
  source 1..58: mol_type = other DNA
cgttcgtttattcgttaggtaggcggtggtgtcgatttatttgagtagttgtttcgcg

SEQ ID NO: 1401 - DNA, 151 bp, synthetic construct
  misc_feature 1..151: note = Description of Artificial Sequence: Synthetic polynucleotide
  source 1..151: mol_type = other DNA
cgtattggtttttttcgttttcgttcgtacgaaagttttgttcgacgtttgtagttagtatcgttcgtattgtttagggagggtttgcgtcgagatttagtggtcgagtgagttatagagtcgttggttttggggacgttgttttttatcg

SEQ ID NO: 1402 - DNA, 17 bp, synthetic construct
  misc_feature 1..17: note = Description of Artificial Sequence: Synthetic oligonucleotide
  source 1..17: mol_type = other DNA
cggttttggggagttcg

SEQ ID NO: 1403 - DNA, 70 bp, synthetic construct
  misc_feature 1..70: note = Description of Artificial Sequence: Synthetic oligonucleotide
  source 1..70: mol_type = other DNA
cgtagaggggttagtaattttatgggtggtggggttttttatttttggacgtagcggggagtagcgggcg

SEQ ID NO: 1404 - DNA, 59 bp, synthetic construct
  misc_feature 1..59: note = Description of Artificial Sequence: Synthetic oligonucleotide
  source 1..59: mol_type = other DNA
cggcgtttagcgtttaagcgttaattcgttgaaagttttttagcgaaattttagggacg

SEQ ID NO: 1405 - DNA, 25 bp, synthetic construct
  misc_feature 1..25: note = Description of Artificial Sequence: Synthetic oligonucleotide
  source 1..25: mol_type = other DNA
cggttcggatagaggttatttagcg

SEQ ID NO: 1406 - DNA, 57 bp, synthetic construct
  misc_feature 1..57: note = Description of Artificial Sequence: Synthetic oligonucleotide
  source 1..57: mol_type = other DNA
cgtttttcgttatttgatattagttaggtagtttttagggttagagcgttagcgtcg

SEQ ID NO: 1407 - DNA, 111 bp, synthetic construct
  misc_feature 1..111: note = Description of Artificial Sequence: Synthetic polynucleotide
  source 1..111: mol_type = other DNA
cgtttagggttggggttcggtgggaattttttcgtgttcgaagggacgatttcgttagagagtttttcgatttttgtatttatcgtttttggtaggacgtggagttgttcg

SEQ ID NO: 1408 - DNA, 211 bp, synthetic construct
  misc_feature 1..211: note = Description of Artificial Sequence: Synthetic polynucleotide
  source 1..211: mol_type = other DNA
cgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcg

SEQ ID NO: 1409 - DNA, 75 bp, synthetic construct
  misc_feature 1..75: note = Description of Artificial Sequence: Synthetic oligonucleotide
  source 1..75: mol_type = other DNA
cgtttttattatttttttaaatattgtagtaagttgtagtaaggcgggtaaatatcgatagcgcgcgtgggggcg

SEQ ID NO: 1410 - skipped

SEQ ID NO: 1411 - DNA, 66 bp, synthetic construct
  misc_feature 1..66: note = Description of Artificial Sequence: Synthetic oligonucleotide
  source 1..66: mol_type = other DNA
cggttatttgtttttcgttttcggggcgtcgtttagtttcgcgttaggcgttttttttagcgttcg

SEQ ID NO: 1412 - skipped

SEQ ID NO: 1413 - DNA, 163 bp, synthetic construct
  misc_feature 1..163: note = Description of Artificial Sequence: Synthetic polynucleotide
  source 1..163: mol_type = other DNA
cgcgcgtttttcggcgggtcggcgggttcggaagtttcgttgttcgggtcgggtttttaagttcgtagtcgttttgattaaaataggtatcgcgacggcggcggtaggcggcggtagttagggttggggtcgtatcgcgtacgcgtatgcgttcgtcgtttcg

SEQ ID NO: 1414 - DNA, 99 bp, synthetic construct
  misc_feature 1..99: note = Description of Artificial Sequence: Synthetic oligonucleotide
  source 1..99: mol_type = other DNA
cgtttttgttttggagcgcggtcgggagtaaaatcgtaggagtgggagggtagcgagttagttggatttcgagtcgcggagcgcgttggttttgtttcg

SEQ ID NO: 1415 - DNA, 96 bp, synthetic construct
  misc_feature 1..96: note = Description of Artificial Sequence: Synthetic oligonucleotide
  source 1..96: mol_type = other DNA
cgcgttttcgtaggcggtattgttcgcggcgcggcgtgtgtatcgagcgagtgaaggtatgtgtggcgggcgcggttggagttgtcgtcgtcgtcg

SEQ ID NO: 1416 - skipped

SEQ ID NO: 1417 - DNA, 16 bp, synthetic construct
  misc_feature 1..16: note = Description of Artificial Sequence: Synthetic oligonucleotide
  source 1..16: mol_type = other DNA
cggcgagattggtacg

SEQ ID NO: 1418 - skipped

SEQ ID NO: 1419 - DNA, 141 bp, synthetic construct
  misc_feature 1..141: note = Description of Artificial Sequence: Synthetic polynucleotide
  source 1..141: mol_type = other DNA
cgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcg

SEQ ID NO: 1420 - skipped

SEQ ID NO: 1421 - DNA, 37 bp, synthetic construct
  misc_feature 1..37: note = Description of Artificial Sequence: Synthetic oligonucleotide
  source 1..37: mol_type = other DNA
cgtttttaattaatcgtataaaattcgtaatatttcg

SEQ ID NO: 1422 - DNA, 52 bp, synthetic construct
  misc_feature 1..52: note = Description of Artificial Sequence: Synthetic oligonucleotide
  source 1..52: mol_type = other DNA
cgggtcggggtatttggcgttttgtgtgggtggcgggagcggggacgtttcg

SEQ ID NO: 1423-1426 - skipped (4 entries)

SEQ ID NO: 1427 - DNA, 17 bp, synthetic construct
  misc_feature 1..17: note = Description of Artificial Sequence: Synthetic oligonucleotide
  source 1..17: mol_type = other DNA
cgagttggggcgggacg

SEQ ID NO: 1428 - DNA, 136 bp, synthetic construct
  misc_feature 1..136: note = Description of Artificial Sequence: Synthetic polynucleotide
  source 1..136: mol_type = other DNA
cgcgagttttttgacgcggggattagttatgaatcgggggtgtgtgtttgtttttagagatttggtaaggtgcggagttttttagaagtgcggttaagcggtagcggagacggcgagttaggaattttttttcgcg

SEQ ID NO: 1429 - DNA, 31 bp, synthetic construct
  misc_feature 1..31: note = Description of Artificial Sequence: Synthetic oligonucleotide
  source 1..31: mol_type = other DNA
cgcgtttagcgtttcgtttattttttggtcg

SEQ ID NO: 1430 - DNA, 25 bp, synthetic construct
  misc_feature 1..25: note = Description of Artificial Sequence: Synthetic oligonucleotide
  source 1..25: mol_type = other DNA
cgtgtattttgaggtttggttggcg

SEQ ID NO: 1431 - DNA, 12 bp, synthetic construct
  misc_feature 1..12: note = Description of Artificial Sequence: Synthetic oligonucleotide
  source 1..12: mol_type = other DNA
cgttgacgagcg

SEQ ID NO: 1432 - skipped

SEQ ID NO: 1433 - DNA, 199 bp, synthetic construct
  misc_feature 1..199: note = Description of Artificial Sequence: Synthetic polynucleotide
  source 1..199: mol_type = other DNA
cgcgttcgcggtcgcggtcgttgtatggcgttgagatggcgggggcgtcgcgcggcggaggcggcggcggaggcggcgcgggcgagttcgggggcgtcgagcgggcggtcgggataagtcgtcggcgcgggtttcgggcgtgcgacgaggagttcgtttgtttagagttggaggcgttgtttcgcggttatacgttgcg

SEQ ID NO: 1434 - DNA, 91 bp, synthetic construct
  misc_feature 1..91: note = Description of Artificial Sequence: Synthetic oligonucleotide
  source 1..91: mol_type = other DNA
cggtttcgggtgtagggtggcgggttcggcggcgcgcgttttttttttttttttggcggttcgtacgtgtcgttcgcgtcgcgtttttacg

SEQ ID NO: 1435 - DNA, 108 bp, synthetic construct
  misc_feature 1..108: note = Description of Artificial Sequence: Synthetic polynucleotide
  source 1..108: mol_type = other DNA
cgcgtttttattgttttatttttttcgtttttggagtttttcggtgattttattatagtttttgttattttgtgatttgtaggtattgggagatttatagggaggacg

SEQ ID NO: 1436 - DNA, 13 bp, synthetic construct
  misc_feature 1..13: note = Description of Artificial Sequence: Synthetic oligonucleotide
  source 1..13: mol_type = other DNA
cgtatcgatttcg

SEQ ID NO: 1437 - DNA, 176 bp, synthetic construct
  misc_feature 1..176: note = Description of Artificial Sequence: Synthetic polynucleotide
  source 1..176: mol_type = other DNA
cggttcgttgggtaaggcgttcgagaaagcgtttggcgggaggaggtgcgcggttttttgttttaggcggttcgggtgttcgttttatgcggggcgagcgttcggtcgattttcgtcggggcggagtttgaggggtggttgatttatgtacggggattgttatttcgtcgttttcg

SEQ ID NO: 1438 - skipped

SEQ ID NO: 1439 - DNA, 157 bp, synthetic construct
  misc_feature 1..157: note = Description of Artificial Sequence: Synthetic polynucleotide
  source 1..157: mol_type = other DNA
cgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgttcg

SEQ ID NO: 1440 - DNA, 66 bp, synthetic construct
  misc_feature 1..66: note = Description of Artificial Sequence: Synthetic oligonucleotide
  source 1..66: mol_type = other DNA
cgcgaatcgttaggggttttcgcgttttttttttatttaggttttttgtttttttcgtcgcggtcg

SEQ ID NO: 1441 - DNA, 498 bp, synthetic construct
  misc_feature 1..498: note = Description of Artificial Sequence: Synthetic polynucleotide
  source 1..498: mol_type = other DNA
cgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacg

SEQ ID NO: 1442 - DNA, 27 bp, synthetic construct
  misc_feature 1..27: note = Description of Artificial Sequence: Synthetic oligonucleotide
  source 1..27: mol_type = other DNA
cgcgggttcgaacgtttttcgcgtttg

SEQ ID NO: 1443-1444 - skipped (2 entries)

SEQ ID NO: 1445 - DNA, 16 bp, synthetic construct
  misc_feature 1..16: note = Description of Artificial Sequence: Synthetic oligonucleotide
  source 1..16: mol_type = other DNA
cgtcgtttgtttcgcg

SEQ ID NO: 1446 - DNA, 53 bp, synthetic construct
  misc_feature 1..53: note = Description of Artificial Sequence: Synthetic oligonucleotide
  source 1..53: mol_type = other DNA
cgcggagggcgtcgaattagagtttgcggggtttgatagttttttttgcggcg

SEQ ID NO: 1447-1450 - skipped (4 entries)

SEQ ID NO: 1451 - DNA, 14 bp, synthetic construct
  misc_feature 1..14: note = Description of Artificial Sequence: Synthetic oligonucleotide
  source 1..14: mol_type = other DNA
cgtgtttatttacg

SEQ ID NO: 1452 - DNA, 186 bp, synthetic construct
  misc_feature 1..186: note = Description of Artificial Sequence: Synthetic polynucleotide
  source 1..186: mol_type = other DNA
cggcgggaaggtttgggtgtttatagatagagttggagtttttcggtgggtggtatagataattagttggggttgttttatatgtaatttaattataggggaaataggtttaaatatcgggtgataagtagcgtaattgtttcgggtgattttgtaattttttttttattaattttttttataacg

SEQ ID NO: 1453 - DNA, 79 bp, synthetic construct
  misc_feature 1..79: note = Description of Artificial Sequence: Synthetic oligonucleotide
  source 1..79: mol_type = other DNA
cggggtacgttcgttttcggcggggtttttcgtttcgttgtgggagtggtagtgggtgtcggggtggagaaagtacgcg

SEQ ID NO: 1454 - DNA, 49 bp, synthetic construct
  misc_feature 1..49: note = Description of Artificial Sequence: Synthetic oligonucleotide
  source 1..49: mol_type = other DNA
cgtcgcgttcgcgtcgcgttttttgtaggtaacgggagacgttttcgcg

SEQ ID NO: 1455 - DNA, 17 bp, synthetic construct
  misc_feature 1..17: note = Description of Artificial Sequence: Synthetic oligonucleotide
  source 1..17: mol_type = other DNA
cggatgaatcgttcgcg

SEQ ID NO: 1456-1458 - skipped (3 entries)

SEQ ID NO: 1459 - DNA, 165 bp, synthetic construct
  misc_feature 1..165: note = Description of Artificial Sequence: Synthetic polynucleotide
  source 1..165: mol_type = other DNA
cgggaacgttgtagtttggttgagcgtgatttttaggttttgtgaggaaaagtcgagcgcgttatatcgaggcgttagtcgtttattttattataaggtaaaagatttatgttgttttagttattttaaagttgggagatatattgtattttttattagatttcg

SEQ ID NO: 1460 - DNA, 14 bp, synthetic construct
  misc_feature 1..14: note = Description of Artificial Sequence: Synthetic oligonucleotide
  source 1..14: mol_type = other DNA
cgcgcgggttagcg

SEQ ID NO: 1461-1462 - skipped (2 entries)

SEQ ID NO: 1463 - DNA, 97 bp, synthetic construct
  misc_feature 1..97: note = Description of Artificial Sequence: Synthetic oligonucleotide
  source 1..97: mol_type = other DNA
cgtgtgtttagggttagtagtacgtataagtgttagcgtacggtcgtcgcgtttatgtttaatgcgggtttcgttgggcgtgcgggcgtgcggggcg

SEQ ID NO: 1464 - skipped

SEQ ID NO: 1465 - DNA, 98 bp, synthetic construct
  misc_feature 1..98: note = Description of Artificial Sequence: Synthetic oligonucleotide
  source 1..98: mol_type = other DNA
cgcggatcgcgcgttttcgtcgttttgtttttaaatttttgtcgtagtttttttttaagttagcgaatttattttttaaaattagaaattgaatttcg

SEQ ID NO: 1466 - DNA, 69 bp, synthetic construct
  misc_feature 1..69: note = Description of Artificial Sequence: Synthetic oligonucleotide
  source 1..69: mol_type = other DNA
cggaggggcggaggaggtgttggcggcggtattgagcggcggcggcgtagggcgcgcgggtttttcgcg

SEQ ID NO: 1467-1470 - skipped (4 entries)

SEQ ID NO: 1471 - DNA, 103 bp, synthetic construct
  misc_feature 1..103: note = Description of Artificial Sequence: Synthetic polynucleotide
  source 1..103: mol_type = other DNA
cggttttaggacggtagggatcgcgatggagcggtttcgggggcggtcgggggacggcgcggtggcggtcggttagttcgttttttcgggggcggcgggcgcg

SEQ ID NO: 1472 - skipped

SEQ ID NO: 1473 - DNA, 21 bp, synthetic construct
  misc_feature 1..21: note = Description of Artificial Sequence: Synthetic oligonucleotide
  source 1..21: mol_type = other DNA
cggtttttggcggcggcggcg

SEQ ID NO: 1474 - DNA, 148 bp, synthetic construct
  misc_feature 1..148: note = Description of Artificial Sequence: Synthetic polynucleotide
  source 1..148: mol_type = other DNA
cggcgttttaaaggggaggattttgcggcgcgggtaagaggcggcgggagcgcgcggttcgggagtgtggttgtagtgcgtcgggatattagggtttcgcgtttcgtatttaagaggttttcgcgttttaatttttcgcgttcgcgcg

SEQ ID NO: 1475-1476 - skipped (2 entries)

SEQ ID NO: 1477 - DNA, 26 bp, synthetic construct
  misc_feature 1..26: note = Description of Artificial Sequence: Synthetic oligonucleotide
  source 1..26: mol_type = other DNA
cgtcgagaggtagcgcgtgatggtcg

SEQ ID NO: 1478 - DNA, 119 bp, synthetic construct
  misc_feature 1..119: note = Description of Artificial Sequence: Synthetic polynucleotide
  source 1..119: mol_type = other DNA
cgtacgtttaagtgcgcgcgttgtcgtaattatggcgttttgttttggtttaagggttataagcgttattgtcgttttaaggattgtatttgcgagaagtgtatttttattatcgagcg

SEQ ID NO: 1479 - DNA, 66 bp, synthetic construct
  misc_feature 1..66: note = Description of Artificial Sequence: Synthetic oligonucleotide
  source 1..66: mol_type = other DNA
cggttcgatttttttcgtttagtttgggttagaggaagtcgaaagcggttttagtaaggtgaggcg

SEQ ID NO: 1480 - DNA, 60 bp, synthetic construct
  misc_feature 1..60: note = Description of Artificial Sequence: Synthetic oligonucleotide
  source 1..60: mol_type = other DNA
cgagcgaagtcgtcgtgtttgggtagaaggcgttttaggaggcgcgaggttttagtcgcg

SEQ ID NO: 1481 - skipped

SEQ ID NO: 1482 - DNA, 124 bp, synthetic construct
  misc_feature 1..124: note = Description of Artificial Sequence: Synthetic polynucleotide
  source 1..124: mol_type = other DNA
cgttcggagcgggatttgtttgttttagtgtacgtcgcggagcgaattatcgggttggcgggggtggaggggtgtaggcgtgggggttgcgggtcgttcgggttttgggttttttttgtcgtcg

SEQ ID NO: 1483 - skipped

SEQ ID NO: 1484 - DNA, 156 bp, synthetic construct
  misc_feature 1..156: note = Description of Artificial Sequence: Synthetic polynucleotide
  source 1..156: mol_type = other DNA
cggggtatcgcggcgttcgtcgtcgttttttcgtaggtgattatttttttgtaggtgttttcgggttttaggtggttgcgtgtttgcgttatggttgatattttgggcgagcggtatttggtgatttgtaagggcgcgacggtggaggtcgaggcg

SEQ ID NO: 1485 - skipped

SEQ ID NO: 1486 - DNA, 91 bp, synthetic construct
  misc_feature 1..91: note = Description of Artificial Sequence: Synthetic oligonucleotide
  source 1..91: mol_type = other DNA
cgcgcgtcgtcgaaattttgttttcgtcgtcgtttatcgataggttgtggagaaggttatcgatcgatgttatcgagttatttttgaagcg

SEQ ID NO: 1487-1488 - skipped (2 entries)

SEQ ID NO: 1489 - DNA, 89 bp, synthetic construct
  misc_feature 1..89: note = Description of Artificial Sequence: Synthetic oligonucleotide
  source 1..89: mol_type = other DNA
cgttattcgcgtgttagtagttgggcgtttcgattttttagatcgcgtgagtttagtaaagcggttaggcgcgcgtttgtagttcggcg

SEQ ID NO: 1490 - DNA, 13 bp, synthetic construct
  misc_feature 1..13: note = Description of Artificial Sequence: Synthetic oligonucleotide
  source 1..13: mol_type = other DNA
cgtttttaattcg

SEQ ID NO: 1491 - skipped

SEQ ID NO: 1492 - DNA, 47 bp, synthetic construct
  misc_feature 1..47: note = Description of Artificial Sequence: Synthetic oligonucleotide
  source 1..47: mol_type = other DNA
cgagcgttagattttagtaataaaaggttaggcgaggttatatcgcg

SEQ ID NO: 1493-1494 - skipped (2 entries)

SEQ ID NO: 1495 - DNA, 159 bp, synthetic construct
  misc_feature 1..159: note = Description of Artificial Sequence: Synthetic polynucleotide
  source 1..159: mol_type = other DNA
cgatgttcgcggcgtgaaagcgttcgcggcgggcgtcgatttttgttttagttttttgtttttttcgtttcgtttgtttcgtgtttttgtgattttggttttggcgtcgtcgtttaggcgtttcgtaatgtagttgtttttgcgtttcggcgggaggcg

SEQ ID NO: 1496-1498 - skipped (3 entries)

SEQ ID NO: 1499 - DNA, 78 bp, synthetic construct
  misc_feature 1..78: note = Description of Artificial Sequence: Synthetic oligonucleotide
  source 1..78: mol_type = other DNA
cgggcgtcgaggtttgggttttagtcgtggcgttcgtttcggcgtagtggggagtcgcgggcgtcggagaagcggtcg

SEQ ID NO: 1500 - skipped

SEQ ID NO: 1501 - DNA, 48 bp, synthetic construct
  misc_feature 1..48: note = Description of Artificial Sequence: Synthetic oligonucleotide
  source 1..48: mol_type = other DNA
cgcggaggagtttcgtattcgatcgtgtatagcgatcgagttggcgcg

SEQ ID NO: 1502-1504 - skipped (3 entries)

SEQ ID NO: 1505 - DNA, 157 bp, synthetic construct
  misc_feature 1..157: note = Description of Artificial Sequence: Synthetic polynucleotide
  source 1..157: mol_type = other DNA
cgtttttatagttttgttttgatagttaaggaaaaaatttgttaaaaattagaggcgttgttgagtgttggcgtgggaatgttagtttagttagagttttgttttgggttatttaaataaaaatagatatgttggtggtaaatgttagttgaatacg

SEQ ID NO: 1506 - skipped

SEQ ID NO: 1507 - DNA, 82 bp, synthetic construct
  misc_feature 1..82: note = Description of Artificial Sequence: Synthetic oligonucleotide
  source 1..82: mol_type = other DNA
cgcgcgttagtttttcgtttcgtggaagcgtttttttttcgatttcggttgattttcgttcgtcgtttttttcgcgggtgcg

SEQ ID NO: 1508 - DNA, 23 bp, synthetic construct
  misc_feature 1..23: note = Description of Artificial Sequence: Synthetic oligonucleotide
  source 1..23: mol_type = other DNA
cgtttggtcgttttatttggtcg

SEQ ID NO: 1509 - DNA, 38 bp, synthetic construct
  misc_feature 1..38: note = Description of Artificial Sequence: Synthetic oligonucleotide
  source 1..38: mol_type = other DNA
cgagttttcgcgcgtttacgagtagttttgcgagttcg

SEQ ID NO: 1510 - skipped

SEQ ID NO: 1511 - DNA, 165 bp, synthetic construct
  misc_feature 1..165: note = Description of Artificial Sequence: Synthetic polynucleotide
  source 1..165: mol_type = other DNA
cgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcg

SEQ ID NO: 1512-1514 - skipped (3 entries)

SEQ ID NO: 1515 - DNA, 23 bp, synthetic construct
  misc_feature 1..23: note = Description of Artificial Sequence: Synthetic oligonucleotide
  source 1..23: mol_type = other DNA
cggtgttcgggggtcgtttgtcg

SEQ ID NO: 1516 - skipped

SEQ ID NO: 1517 - DNA, 66 bp, synthetic construct
  misc_feature 1..66: note = Description of Artificial Sequence: Synthetic oligonucleotide
  source 1..66: mol_type = other DNA
cggtcgtggcgggttttttggggcggtagttttaggcgcgggcgcgtagtagtttcgaaggcgtcg

SEQ ID NO: 1518 - DNA, 43 bp, synthetic construct
  misc_feature 1..43: note = Description of Artificial Sequence: Synthetic oligonucleotide
  source 1..43: mol_type = other DNA
cgaataaaaagagtttaggtcgcgcgggcgggttgcgcgttcg

SEQ ID NO: 1519 - skipped

SEQ ID NO: 1520 - DNA, 62 bp, synthetic construct
  misc_feature 1..62: note = Description of Artificial Sequence: Synthetic oligonucleotide
  source 1..62: mol_type = other DNA
cgtttagatgcggcggcggcgacggttttagttgcgtttcgtggttattttcgtgtagcgcg

SEQ ID NO: 1521 - skipped

SEQ ID NO: 1522 - DNA, 138 bp, synthetic construct
  misc_feature 1..138: note = Description of Artificial Sequence: Synthetic polynucleotide
  source 1..138: mol_type = other DNA
cgaaagattcgaaattttaaaagttttattgcgtgtttttgggaggggagggggcgcgttaggaaaggagtggaaaaaagtgggcgaggaggagcgttgaaaattttttgataagtagttttcgtgcgttcgagagcg

SEQ ID NO: 1523-1526 - skipped (4 entries)

SEQ ID NO: 1527 - DNA, 187 bp, synthetic construct
  misc_feature 1..187: note = Description of Artificial Sequence: Synthetic polynucleotide
  source 1..187: mol_type = other DNA
cggtagaagtgggaggtatacgaggagttattggaaacggcgtttttgtggaggagtcgggggggatggggagtagagggagggggttttgttgttttagcgtttcgaggtcgtggagcggtagtagttgtagtcggagtagtattagtaatagtaatagtgagcgggacggagttaggatcgttcg

SEQ ID NO: 1528-1529 - skipped (2 entries)

SEQ ID NO: 1530 - DNA, 110 bp, synthetic construct
  misc_feature 1..110: note = Description of Artificial Sequence: Synthetic polynucleotide
  source 1..110: mol_type = other DNA
cgcggcgtgtagttcggcggatgttgttaggttaggcgatttcgtcgtttttggagcgcgagcgcgttttagtttgtagcgatgattttggaattagattttgatttgcg

SEQ ID NO: 1531 - skipped

SEQ ID NO: 1532 - DNA, 189 bp, synthetic construct
  misc_feature 1..189: note = Description of Artificial Sequence: Synthetic polynucleotide
  source 1..189: mol_type = other DNA
cgggaggttttgttcgttcggtggttgtcgcggtttttttcgcgttgttttttacgtttggtttattatgtacgaggtaggtaatttgttttttttttcggggatttatttcggagataagaaggtagtttgttttttgtaatggtttttgttggagtgcggcggggtttaggcgcgagcgggggtacg

SEQ ID NO: 1533 - DNA, 42 bp, synthetic construct
  misc_feature 1..42: note = Description of Artificial Sequence: Synthetic oligonucleotide
  source 1..42: mol_type = other DNA
cgttgaaggtgggtggaacgagggcgtttgagtgtattcgcg

SEQ ID NO: 1534 - DNA, 33 bp, synthetic construct
  misc_feature 1..33: note = Description of Artificial Sequence: Synthetic oligonucleotide
  source 1..33: mol_type = other DNA
cgcgcgggggttttaggtattttgcgttttacg

SEQ ID NO: 1535 - DNA, 15 bp, synthetic construct
  misc_feature 1..15: note = Description of Artificial Sequence: Synthetic oligonucleotide
  source 1..15: mol_type = other DNA
cgcgttagtcgaacg

SEQ ID NO: 1536 - DNA, 51 bp, synthetic construct
  misc_feature 1..51: note = Description of Artificial Sequence: Synthetic oligonucleotide
  source 1..51: mol_type = other DNA
cgttgggatagagttgtttgttggagttgtcgtagatcgtcgtggtgggcg

SEQ ID NO: 1537 - skipped

SEQ ID NO: 1538 - DNA, 268 bp, synthetic construct
  misc_feature 1..268: note = Description of Artificial Sequence: Synthetic polynucleotide
  source 1..268: mol_type = other DNA
cggagcgcgtagttcgtttttgaataagaagtgagtataatggcgtgtttgtaaaaaaaagttttaagttcgttttttttaaaaaatattttgaatgttgtatgttttatgttttttagcgtttcgcgggagagattcggttatagagtaggaggtgagatttttttttcggtatttttatttttttggtcgtacgtttttttgttttagttttttttgggaggattgtaaatgtttttttttagtaagcggtcgttttttattttcg

SEQ ID NO: 1539 - skipped

SEQ ID NO: 1540 - DNA, 33 bp, synthetic construct
  misc_feature 1..33: note = Description of Artificial Sequence: Synthetic oligonucleotide
  source 1..33: mol_type = other DNA
cggagtttttaggagtagttagatcgattatcg

SEQ ID NO: 1541 - DNA, 23 bp, synthetic construct
  misc_feature 1..23: note = Description of Artificial Sequence: Synthetic oligonucleotide
  source 1..23: mol_type = other DNA
cgtttattagttcgagattttcg

SEQ ID NO: 1542 - DNA, 40 bp, synthetic construct
  misc_feature 1..40: note = Description of Artificial Sequence: Synthetic oligonucleotide
  source 1..40: mol_type = other DNA
cgtttcgattcgacgttttttcgttcgattaggtgtttcg

SEQ ID NO: 1543 - DNA, 10 bp, synthetic construct
  misc_feature 1..10: note = Description of Artificial Sequence: Synthetic oligonucleotide
  source 1..10: mol_type = other DNA
cgcggtttcg

SEQ ID NO: 1544 - DNA, 181 bp, synthetic construct
  misc_feature 1..181: note = Description of Artificial Sequence: Synthetic polynucleotide
  source 1..181: mol_type = other DNA
cggttgttgatcgtttttttcgcgttcgttagggtttttgtttcgcgttagttatcgcgcgttttttttttgtttatgtcgtagttttcgtggtttttgttttggattcgggatgttaggttgagatacgttttgtaaatttttggtagaaatgggcgtaagggggtggatttcgttttcg

SEQ ID NO: 1545 - DNA, 195 bp, synthetic construct
  misc_feature 1..195: note = Description of Artificial Sequence: Synthetic polynucleotide
  source 1..195: mol_type = other DNA
cgatttaggacgtcggcgtttgttaggattttttcgtttgtttttcgcgtttcgcgcgcgtttatgttattattacggggagggtgtatgcggtaggtgtttggtcgaggttttcgggagcgagtcgtttttacgtgttttagtttgtttttttttcgaagttagacgttggcgttgtagttttgttgtttgacg

SEQ ID NO: 1546 - skipped

SEQ ID NO: 1547 - DNA, 358 bp, synthetic construct
  misc_feature 1..358: note = Description of Artificial Sequence: Synthetic polynucleotide
  source 1..358: mol_type = other DNA
cggcgttcgagtgattttgtttagtttcgttttgcgtttttgtaaattacgttgttgcgttaattataaatttggttaatatgtttttgtaattttattatttaaaaacgtttttaggtatttggtcgttgttagattaggttcgcgggttcggaggaggtttttttatttgttttcgttagtttcggggatcgtgcgcggttttcgtgtggttttcgtttacgaggtttttcgggtaggaatcgtcgcgcgatttttgtttagcggtcgcgttttggttacgggcgatttttgtcgggaattttgttttcggttaagttgcgttttcgtatttcggtggtttttattcgagttcgcg

SEQ ID NO: 1548 - DNA, 13 bp, synthetic construct
  misc_feature 1..13: note = Description of Artificial Sequence: Synthetic oligonucleotide
  source 1..13: mol_type = other DNA
cgtagttgtggcg

SEQ ID NO: 1549-1550 - skipped (2 entries)

SEQ ID NO: 1551 - DNA, 95 bp, synthetic construct
  misc_feature 1..95: note = Description of Artificial Sequence: Synthetic oligonucleotide
  source 1..95: mol_type = other DNA
cgtgcggggttatttgaaggttggggcgcggaagtttaatttcgtgttgattgggttttaagttttttgcgttttcgtttcgtttcgagtgttcg

SEQ ID NO: 1552 - DNA, 45 bp, synthetic construct
  misc_feature 1..45: note = Description of Artificial Sequence: Synthetic oligonucleotide
  source 1..45: mol_type = other DNA
cggtagtaggttggagcgtatcgtgcgcgttttgttttttcggcg

SEQ ID NO: 1553 - DNA, 104 bp, synthetic construct
  misc_feature 1..104: note = Description of Artificial Sequence: Synthetic polynucleotide
  source 1..104: mol_type = other DNA
cggttgagtcggagtttacgcggcgcgcgtttttcgcgaggaatttttcggtttgtaggttgtttgttattttcgtttttcgacgcgtttttttttggttcgcg

SEQ ID NO: 1554 - DNA, 87 bp, synthetic construct
  misc_feature 1..87: note = Description of Artificial Sequence: Synthetic oligonucleotide
  source 1..87: mol_type = other DNA
cgttttcgttttcgttgatattttgtaaagtcgcggcggtagcggcggggattacgttgcggtgtattatttttcgttattttttcg

SEQ ID NO: 1555 - DNA, 62 bp, synthetic construct
  misc_feature 1..62: note = Description of Artificial Sequence: Synthetic oligonucleotide
  source 1..62: mol_type = other DNA
cgatagtttgcgagtttcggttgtaagtggtttttttttttcgcggttgttgtttagtgtcg

SEQ ID NO: 1556-1563 - skipped (8 entries)

SEQ ID NO: 1564 - DNA, 145 bp, synthetic construct
  misc_feature 1..145: note = Description of Artificial Sequence: Synthetic polynucleotide
  source 1..145: mol_type = other DNA
cgtcggtttgttggcgatttggcgtatttgttcgcgcgttttggttttagttgtcgtaggttttttttgtatttatttttagtttttaaagttagtgtagttagtatcgtttatttggagttttaatttttttttgcgattttcg

SEQ ID NO: 1565 - skipped

SEQ ID NO: 1566 - DNA, 19 bp, synthetic construct
  misc_feature 1..19: note = Description of Artificial Sequence: Synthetic oligonucleotide
  source 1..19: mol_type = other DNA
cgtttatcgttaggagtcg

SEQ ID NO: 1567 - DNA, 35 bp, synthetic construct
  misc_feature 1..35: note = Description of Artificial Sequence: Synthetic oligonucleotide
  source 1..35: mol_type = other DNA
cggcggcggcggcggttttattagcggagttttcg

SEQ ID NO: 1568-1569 - skipped (2 entries)

SEQ ID NO: 1570 - DNA, 36 bp, synthetic construct
  misc_feature 1..36: note = Description of Artificial Sequence: Synthetic oligonucleotide
  source 1..36: mol_type = other DNA
cgagttggcgttggttcgttggttgtaggagagtcg

SEQ ID NO: 1571 - skipped

SEQ ID NO: 1572 - DNA, 42 bp, synthetic construct
  misc_feature 1..42: note = Description of Artificial Sequence: Synthetic oligonucleotide
  source 1..42: mol_type = other DNA
cggttgagttttcgtttgtttaattttatttgttattgtacg

SEQ ID NO: 1573-1574 - skipped (2 entries)

SEQ ID NO: 1575 - DNA, 18 bp, synthetic construct
  misc_feature 1..18: note = Description of Artificial Sequence: Synthetic oligonucleotide
  source 1..18: mol_type = other DNA
cgcgtagcgttcgcgtcg

SEQ ID NO: 1576-1578 - skipped (3 entries)

SEQ ID NO: 1579 - DNA, 118 bp, synthetic construct
  misc_feature 1..118: note = Description of Artificial Sequence: Synthetic polynucleotide
  source 1..118: mol_type = other DNA
cgtgttagatttcggtttcgcgatttaggtgagtgtcgttatcgtcgtttggagggatttaagggttttgggttgggatttggggtcgtatcggggtttgaggtagaatagcgacgcg

SEQ ID NO: 1580 - DNA, 22 bp, synthetic construct
  misc_feature 1..22: note = Description of Artificial Sequence: Synthetic oligonucleotide
  source 1..22: mol_type = other DNA
cgaatcgcgggcggcgcggacg

SEQ ID NO: 1581-1584 - skipped (4 entries)

SEQ ID NO: 1585 - DNA, 31 bp, synthetic construct
  misc_feature 1..31: note = Description of Artificial Sequence: Synthetic oligonucleotide
  source 1..31: mol_type = other DNA
cgataagagttcggtgttgagatgtgttacg

SEQ ID NO: 1586-1594 - skipped (9 entries)

SEQ ID NO: 1595 - DNA, 69 bp, synthetic construct
  misc_feature 1..69: note = Description of Artificial Sequence: Synthetic oligonucleotide
  source 1..69: mol_type = other DNA
cgttaggggcggttagcggtcgtttggttggcgtgtcggcggcgttcggggagggcgggtcggggggcg

SEQ ID NO: 1596 - DNA, 415 bp, synthetic construct
  misc_feature 1..415: note = Description of Artificial Sequence: Synthetic polynucleotide
  source 1..415: mol_type = other DNA
cgtttttttttttggttcgattggttttggttttttttacgtttttagtttttaaattggcgttcgttttatggttcgtgtaggacgttaaaagtacggtaaattttagggcgatttttagtagacgttttcgacgtatgatgtcgagtcgttatcggttttcgtcgttttttgtcgcgttcggggttcggtttgcggtcgtcgttgcgttttgaagcgtatcgcgtcgtcggggtttcgttatttcgtcgttcgtttttcgggtcgggtttttttcgttttttttaggcgttgtttttattttaggcggtttttgttagttgtaatatagagataaattttcgaggcggggagatttttagggtatcgggatgttgaagtttcgcggtttttatttttaagtttaattcgtgcg

SEQ ID NO: 1597-1601 - skipped (5 entries)

SEQ ID NO: 1602 - DNA, 62 bp, synthetic construct
  misc_feature 1..62: note = Description of Artificial Sequence: Synthetic oligonucleotide
  source 1..62: mol_type = other DNA
cgcgttcgtcgttagttcgtatagcgtttcgtatattttcgtacgcgtttgaaatgcgtacg

SEQ ID NO: 1603-1606 - skipped (4 entries)

SEQ ID NO: 1607 - DNA, 20 bp, synthetic construct
  misc_feature 1..20: note = Description of Artificial Sequence: Synthetic oligonucleotide
  source 1..20: mol_type = other DNA
cgtaaacgtaaaagttttcg

SEQ ID NO: 1608 - DNA, 69 bp, synthetic construct
  misc_feature 1..69: note = Description of Artificial Sequence: Synthetic oligonucleotide
  source 1..69: mol_type = other DNA
cgttttttggggtttttggttgtcgagtttcgttaaggtaaagacgttagtaagcgaggaagcgtagcg

SEQ ID NO: 1609 - skipped

SEQ ID NO: 1610 - DNA, 318 bp, synthetic construct
  misc_feature 1..318: note = Description of Artificial Sequence: Synthetic polynucleotide
  source 1..318: mol_type = other DNA
cgtttcgcggtagtgttagttttttggggattaggaagggcgatttttgtttgggagttagtgtttgggtcgtcgggttcgggtaagcgttgggggtttggttcgagaagatgcggataggtggtttagggcgtcgcggattttcgttttttgcgggtatcgggagtttagggtcgaggcgcgtcgtttcgaggggtttttttttttaataatgcgttcggaatggagttcgcgttttgatagcgcgggttagttcgaaatcgtttagaattcgtttcgatgagtgggtgagtcgttttgggagtttgtcgcgtttcg

SEQ ID NO: 1611 - DNA, 27 bp, synthetic construct
  misc_feature 1..27: note = Description of Artificial Sequence: Synthetic oligonucleotide
  source 1..27: mol_type = other DNA
cgtggtggtttttcgagcggaggcgcg

SEQ ID NO: 1612 - skipped

SEQ ID NO: 1613 - DNA, 13 bp, synthetic construct
  misc_feature 1..13: note = Description of Artificial Sequence: Synthetic oligonucleotide
  source 1..13: mol_type = other DNA
cgagtttttcgcg

SEQ ID NO: 1614 - DNA, 189 bp, synthetic construct
  misc_feature 1..189: note = Description of Artificial Sequence: Synthetic polynucleotide
  source 1..189: mol_type = other DNA
cggtgacgatgtgtagagttttttggtatagattgtttatttcgttttttttgtggaaatttatcgtttggtttttttttcgtttttttttttttttttagttagtcgttttttttttttttcgtatttttaatttttttggcgttttaagttatagttcgttcgcggtgattttggttggagattgcg

SEQ ID NO: 1615-1616 - skipped (2 entries)

SEQ ID NO: 1617 - DNA, 13 bp, synthetic construct
  misc_feature 1..13: note = Description of Artificial Sequence: Synthetic oligonucleotide
  source 1..13: mol_type = other DNA
cgggggttgagcg

SEQ ID NO: 1618 - DNA, 51 bp, synthetic construct
  misc_feature 1..51: note = Description of Artificial Sequence: Synthetic oligonucleotide
  source 1..51: mol_type = other DNA
cggcgtgtgtcgtgcgtggggtggggtgcgggttgggcggtttcgttttcg

SEQ ID NO: 1619 - DNA, 289 bp, synthetic construct
  misc_feature 1..289: note = Description of Artificial Sequence: Synthetic polynucleotide
  source 1..289: mol_type = other DNA
cgttcgttcgtatttcgtttttttcggttttttttttaaattttaaacgtatcgtcgtgttttaaagaaggtgtttacgtcgtttttagatttcggagcgttttttttttattttcgggattttttaggtcgtttatttttttcgtttttcgtttagatttgagagggatcgaaaatatattttcgattcgggtagttagggtcgaaattgttaagaggagaaaaggtaaagcggaaggagggtggttataaatagatttttttgtttttttttaaaaggatattgtcg

SEQ ID NO: 1620 - skipped

SEQ ID NO: 1621 - DNA, 165 bp, synthetic construct
  misc_feature 1..165: note = Description of Artificial Sequence: Synthetic polynucleotide
  source 1..165: mol_type = other DNA
cggatttgttttcgtagtcgttgcggatttttcggtcgttatggcgattgtgaaatgtggggtggggcgtatgcgttggaagttattcgcgcgggtagtttttgagtgtttttttacgtgttttttagcgcgagtagtattttcgtttttgcgttttttagagcg

SEQ ID NO: 1622 - DNA, 21 bp, synthetic construct
  misc_feature 1..21: note = Description of Artificial Sequence: Synthetic oligonucleotide
  source 1..21: mol_type = other DNA
cgtcgtttttgtattatttcg

SEQ ID NO: 1623-1625 - skipped (3 entries)

SEQ ID NO: 1626 - DNA, 159 bp, synthetic construct
  misc_feature 1..159: note = Description of Artificial Sequence: Synthetic polynucleotide
  source 1..159: mol_type = other DNA
cggttgcgttggtcgtattgtttttttataatatgagtagcgtcggcggcgatcgtttgggtcgcggtaagtcggttcgttgcggttttatttttttcgtgggtcgcgtgtatcgttggatggtggatagtcgcgtggcgttgcgtatttacgagtacg

SEQ ID NO: 1627 - skipped

SEQ ID NO: 1628 - DNA, 129 bp, synthetic construct
  misc_feature 1..129: note = Description of Artificial Sequence: Synthetic polynucleotide
  source 1..129: mol_type = other DNA
cggggggcggaatttagagaggtaaagtgattcgtttttaaatcgtaatattaggaggatagtagggttagatggaatttttcggtttatagttttcgatttcgggtaagtgttttattcgggcgtacg

SEQ ID NO: 1629 - skipped

SEQ ID NO: 1630 - DNA, 120 bp, synthetic construct
  misc_feature 1..120: note = Description of Artificial Sequence: Synthetic polynucleotide
  source 1..120: mol_type = other DNA
cgttggagatggcgagtttcgagattttttttattttttgtttttagagtaattttatggtattaaaaaaaaaaaaaaaaaaaaaaaaaaaaaaaaaaaaaaaaaaagaaggagaaggcg

SEQ ID NO: 1631 - skipped

SEQ ID NO: 1632 - DNA, 171 bp, synthetic construct
  misc_feature 1..171: note = Description of Artificial Sequence: Synthetic polynucleotide
  source 1..171: mol_type = other DNA
cgcggacgttgacgattttttttacgttcgataagttttcgttttcgtcgtatcgttggcggttaatcgggcgttgcgaggatttaaattagagagttcgggatattattgtgggggttggaggtcgttttttaatttgggtttagtattaataggtgtagtagtcgagcg

SEQ ID NO: 1633-1635 - skipped (3 entries)

SEQ ID NO: 1636 - DNA, 64 bp, synthetic construct
  misc_feature 1..64: note = Description of Artificial Sequence: Synthetic oligonucleotide
  source 1..64: mol_type = other DNA
cggtaggtgagcggcgcggttgtaggtgagtagtagtttcggttcgcgcgtttagtttttttcg

SEQ ID NO: 1637-1640 - skipped (4 entries)

SEQ ID NO: 1641 - DNA, 16 bp, synthetic construct
  misc_feature 1..16: note = Description of Artificial Sequence: Synthetic oligonucleotide
  source 1..16: mol_type = other DNA
cgtttcgtagggttcg

SEQ ID NO: 1642-1644 - skipped (3 entries)

SEQ ID NO: 1645 - DNA, 18 bp, synthetic construct
  misc_feature 1..18: note = Description of Artificial Sequence: Synthetic oligonucleotide
  source 1..18: mol_type = other DNA
cgtattttttcggtcgcg

SEQ ID NO: 1646 - DNA, 118 bp, synthetic construct
  misc_feature 1..118: note = Description of Artificial Sequence: Synthetic polynucleotide
  source 1..118: mol_type = other DNA
cgggcggatgggggttatcgaggcggttcgtttttaggcgtatatttcgtatatttttttgttaagtgaaggggttaaaatgtatagatgggggagtttatttaggaatagaggcgcg

SEQ ID NO: 1647-1651 - skipped (5 entries)

SEQ ID NO: 1652 - DNA, 22 bp, synthetic construct
  misc_feature 1..22: note = Description of Artificial Sequence: Synthetic oligonucleotide
  source 1..22: mol_type = other DNA
cgcgtcgttttagaggagttcg

SEQ ID NO: 1653 - DNA, 112 bp, synthetic construct
  misc_feature 1..112: note = Description of Artificial Sequence: Synthetic polynucleotide
  source 1..112: mol_type = other DNA
cgggagcgtacgagtgtgtgtgtgtgtgtgtgtgttcgcggtgtgttcgcggttcggtgtatacgcgcgcgggttgtaaagttaggagttgcgggagcgtttttttgtttcg

SEQ ID NO: 1654 - DNA, 109 bp, synthetic construct
  misc_feature 1..109: note = Description of Artificial Sequence: Synthetic polynucleotide
  source 1..109: mol_type = other DNA
cgttttgtttgggttgggtttatttacgttttgggtggggtttaggaattgcgtgcgggcgtagcgggtgagtatgttgatgatgattatttggttttatttttttacg

SEQ ID NO: 1655-1657 - skipped (3 entries)

SEQ ID NO: 1658 - DNA, 431 bp, synthetic construct
  misc_feature 1..431: note = Description of Artificial Sequence: Synthetic polynucleotide
  source 1..431: mol_type = other DNA
cgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacg

SEQ ID NO: 1659 - skipped

SEQ ID NO: 1660 - DNA, 40 bp, synthetic construct
  misc_feature 1..40: note = Description of Artificial Sequence: Synthetic oligonucleotide
  source 1..40: mol_type = other DNA
cgtcgcgtttcgttgtagtttcgttggagagatggggacg

SEQ ID NO: 1661 - skipped

SEQ ID NO: 1662 - DNA, 22 bp, synthetic construct
  misc_feature 1..22: note = Description of Artificial Sequence: Synthetic oligonucleotide
  source 1..22: mol_type = other DNA
cgttagtaggtttagggttacg

SEQ ID NO: 1663 - skipped

SEQ ID NO: 1664 - DNA, 47 bp, synthetic construct
  misc_feature 1..47: note = Description of Artificial Sequence: Synthetic oligonucleotide
  source 1..47: mol_type = other DNA
cgggtattttgtattgtacgtagtatatgttgtggttttttagttcg

SEQ ID NO: 1665 - DNA, 24 bp, synthetic construct
  misc_feature 1..24: note = Description of Artificial Sequence: Synthetic oligonucleotide
  source 1..24: mol_type = other DNA
cgtcgttgggggatttttggtacg

SEQ ID NO: 1666 - skipped

SEQ ID NO: 1667 - DNA, 45 bp, synthetic construct
  misc_feature 1..45: note = Description of Artificial Sequence: Synthetic oligonucleotide
  source 1..45: mol_type = other DNA
cgggattttaggtttatttagtaagttaattggttgaggttttcg

SEQ ID NO: 1668 - skipped

SEQ ID NO: 1669 - DNA, 258 bp, synthetic construct
  misc_feature 1..258: note = Description of Artificial Sequence: Synthetic polynucleotide
  source 1..258: mol_type = other DNA
cgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcg

SEQ ID NO: 1670 - DNA, 45 bp, synthetic construct
  misc_feature 1..45: note = Description of Artificial Sequence: Synthetic oligonucleotide
  source 1..45: mol_type = other DNA
cgttttggcggtttcgagggatttgggttcgggtttgcggtcgcg

SEQ ID NO: 1671-1672 - skipped (2 entries)

SEQ ID NO: 1673 - DNA, 67 bp, synthetic construct
  misc_feature 1..67: note = Description of Artificial Sequence: Synthetic oligonucleotide
  source 1..67: mol_type = other DNA
cggggcgttaatagtttaggatttgggttgtaggttggtttttgtattaattagcggggcggtttcg

SEQ ID NO: 1674 - DNA, 43 bp, synthetic construct
  misc_feature 1..43: note = Description of Artificial Sequence: Synthetic oligonucleotide
  source 1..43: mol_type = other DNA
cggttgattcgtagcggtagcggtagtagcgaggattcgagcg

SEQ ID NO: 1675-1676 - skipped (2 entries)

SEQ ID NO: 1677 - DNA, 113 bp, synthetic construct
  misc_feature 1..113: note = Description of Artificial Sequence: Synthetic polynucleotide
  source 1..113: mol_type = other DNA
cgtgtgtttagttgaatttagtatatttttttcgtatttttcgtttttttttttttttttttgaatttgtttttttgttttgcgggtttttaatttttttcgaatttcgggcg

SEQ ID NO: 1678-1679 - skipped (2 entries)

SEQ ID NO: 1680 - DNA, 84 bp, synthetic construct
  misc_feature 1..84: note = Description of Artificial Sequence: Synthetic oligonucleotide
  source 1..84: mol_type = other DNA
cgttgcgcgtcgttttcgcggagtcgagcggcggtggttgcggaagcgattggggttgcgcggatattagcgttttagagttcg

SEQ ID NO: 1681 - skipped

SEQ ID NO: 1682 - DNA, 48 bp, synthetic construct
  misc_feature 1..48: note = Description of Artificial Sequence: Synthetic oligonucleotide
  source 1..48: mol_type = other DNA
cgcgttttattttgtagcggtggttttggaattagattttgatttgcg

SEQ ID NO: 1683 - DNA, 228 bp, synthetic construct
  misc_feature 1..228: note = Description of Artificial Sequence: Synthetic polynucleotide
  source 1..228: mol_type = other DNA
cgggtcgcgcgtttatttgcgttttcgtcgtcgaaggagtttatgtacgggaagtagatggcgagcgtttcgaaggaggcggatagattgaggcggttttgcgagcgttttatgttcgcgtcggcgtcgggcgtttcggtcgcggcggcggcggcggcggcgggcggtttgggtagtttggtcgttttatttttgacgcggagtacggcgcgcggcgtggtggcggcg

SEQ ID NO: 1684 - DNA, 47 bp, synthetic construct
  misc_feature 1..47: note = Description of Artificial Sequence: Synthetic oligonucleotide
  source 1..47: mol_type = other DNA
cgtattttggtcgtaataagcgcgttttacgtcgttacgtattagcg

SEQ ID NO: 1685 - DNA, 185 bp, synthetic construct
  misc_feature 1..185: note = Description of Artificial Sequence: Synthetic polynucleotide
  source 1..185: mol_type = other DNA
cgcgtagggggcgggttttatttttttttcgttttcgtttcggttttaagtcgcggaggcgttcggtgggatttcgttgttgtttaattaggggggatcgggtgagtttttttttttggagtcgggttttattagcgtcgtaggtttataggtcgggggtgggggttttggatcgaggggcggcg

SEQ ID NO: 1686 - DNA, 216 bp, synthetic construct
  misc_feature 1..216: note = Description of Artificial Sequence: Synthetic polynucleotide
  source 1..216: mol_type = other DNA
cgggggcgttaatttcgggagtaggaggtcgggttttagtcgtcgggttttgcgcgtttgttttttgcggcgcggtcggtatttgtagttggggtggtcgcgtaagtgttgtacgcgtagtcgttcggttttttttacgaagggtcgttttttcgtcgcgtttagttttttttacgttttgtttgcgggtcgtgggcgttagtgagtggaacgtcg

SEQ ID NO: 1687 - DNA, 344 bp, synthetic construct
  misc_feature 1..344: note = Description of Artificial Sequence: Synthetic polynucleotide
  source 1..344: mol_type = other DNA
cgtggtttcgtgtttcggggcgcgttttagtttcggtattattagtttttcgtttttttcggaggggcgttcgagtgcgttcgatacggttagtagcgtcgcggcgagtagtagtagcgtgggtattggtttaaagtttcgagatttcggagttcgtttcgcgttttttatgtcgttgtttagtttgcgtttttcgaatttttcgggtatagttcgttgtattggagttttaggagatatcgttcgtagtagcgtacggagcgagggatttttagttcgggtcgggagagtaaagtttcgttggtttgttttggattgttaaaattaataatttttattattcg

SEQ ID NO: 1688 - DNA, 28 bp, synthetic construct
  misc_feature 1..28: note = Description of Artificial Sequence: Synthetic oligonucleotide
  source 1..28: mol_type = other DNA
cgttttgtttggtagttaggtcgagacg

SEQ ID NO: 1689 - DNA, 124 bp, synthetic construct
  misc_feature 1..124: note = Description of Artificial Sequence: Synthetic polynucleotide
  source 1..124: mol_type = other DNA
cgtggggcgttggatttatcgagaggttagcgtcgtcgtcgggggagggcgtgtttcgtacgtgtgtgttcgcgcgtgttcgcgttcgcgtgtgttagcgcgcgtgttttggtcgtgcgcgtcg

SEQ ID NO: 1690 - DNA, 80 bp, synthetic construct
  misc_feature 1..80: note = Description of Artificial Sequence: Synthetic oligonucleotide
  source 1..80: mol_type = other DNA
cgttcgttagggttacgaagagcgtaacgaacgttagtagtacggcgtttacggtgagcgttcgcgtcgtttgtatttcg

SEQ ID NO: 1691 - DNA, 62 bp, synthetic construct
  misc_feature 1..62: note = Description of Artificial Sequence: Synthetic oligonucleotide
  source 1..62: mol_type = other DNA
cggataggtttcgtagtgagtaggtaagggtcgtttcgtcgcggttgtttttttacgtttcg

SEQ ID NO: 1692 - DNA, 165 bp, synthetic construct
  misc_feature 1..165: note = Description of Artificial Sequence: Synthetic polynucleotide
  source 1..165: mol_type = other DNA
cgatcgtatgcgtcgatttgtcgttgggcgttcgtttttttttgttggggttgggcgcggtttcggagtttggcggcggtggtgagggcgtacggttagttgtagcggcgttgtgtttgtcgtggatttaggatattttaggtttggtggcggggttaggtggcg

SEQ ID NO: 1693 - DNA, 43 bp, synthetic construct
  misc_feature 1..43: note = Description of Artificial Sequence: Synthetic oligonucleotide
  source 1..43: mol_type = other DNA
cgtttttgtgtttttggtggtttcggcgttttttcggagcgcg

SEQ ID NO: 1694 - DNA, 86 bp, synthetic construct
  misc_feature 1..86: note = Description of Artificial Sequence: Synthetic oligonucleotide
  source 1..86: mol_type = other DNA
cgtcgtcgttttcgtcgggagttaagttcgtcgggtcggttcggttttaggtgggtagttcggtttgtagttggttggaggtggcg

SEQ ID NO: 1695 - DNA, 23 bp, synthetic construct
  misc_feature 1..23: note = Description of Artificial Sequence: Synthetic oligonucleotide
  source 1..23: mol_type = other DNA
cgagttcgtgggataagggggcg

SEQ ID NO: 1696 - skipped

SEQ ID NO: 1697 - DNA, 99 bp, synthetic construct
  misc_feature 1..99: note = Description of Artificial Sequence: Synthetic oligonucleotide
  source 1..99: mol_type = other DNA
cgcggttatgtaattggtggatttttttaaatcgttttggaggggggagcgcggcgttgggggcgggagagcgtttttggttgtgagttgtttttgtcg

SEQ ID NO: 1698 - DNA, 73 bp, synthetic construct
  misc_feature 1..73: note = Description of Artificial Sequence: Synthetic oligonucleotide
  source 1..73: mol_type = other DNA
cgtggaattcgtgagttttacgtaacgtttttttgtcgtttagggtgggtttttagaagtatagaaatggtcg

SEQ ID NO: 1699 - skipped

SEQ ID NO: 1700 - DNA, 52 bp, synthetic construct
  misc_feature 1..52: note = Description of Artificial Sequence: Synthetic oligonucleotide
  source 1..52: mol_type = other DNA
cggggcgggtagggatcgagttaggagagagcgggcgggggttttgggagcg

SEQ ID NO: 1701 - DNA, 50 bp, synthetic construct
  misc_feature 1..50: note = Description of Artificial Sequence: Synthetic oligonucleotide
  source 1..50: mol_type = other DNA
cgcgagtaggagggcgtattttatggttaggtgcggacgcggcggttgcg

SEQ ID NO: 1702 - DNA, 50 bp, synthetic construct
  misc_feature 1..50: note = Description of Artificial Sequence: Synthetic oligonucleotide
  source 1..50: mol_type = other DNA
cgggtcggggtattataggcgcgggaatttacgtgtggattttgcgttcg

SEQ ID NO: 1703-1704 - skipped (2 entries)

SEQ ID NO: 1705 - DNA, 52 bp, synthetic construct
  misc_feature 1..52: note = Description of Artificial Sequence: Synthetic oligonucleotide
  source 1..52: mol_type = other DNA
cggggtagcgtaggagtaggtaggggttcgcggttcgcgtgggttttaggcg

SEQ ID NO: 1706-1708 - skipped (3 entries)

SEQ ID NO: 1709 - DNA, 138 bp, synthetic construct
  misc_feature 1..138: note = Description of Artificial Sequence: Synthetic polynucleotide
  source 1..138: mol_type = other DNA
cgagtggtagtagtaggagcggggtgacgaataagattacgaaggatttgaatttggagatatagtttagcgtcgaggttatcgcgcgggagggagattggcgggcgagacgagtgaggggtagttagaggcgtcgcg

SEQ ID NO: 1710-1712 - skipped (3 entries)

SEQ ID NO: 1713 - DNA, 1017 bp, synthetic construct
  misc_feature 1..1017: note = Description of Artificial Sequence: Synthetic polynucleotide
  source 1..1017: mol_type = other DNA
ygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtyg

SEQ ID NO: 1714 - DNA, 166 bp, synthetic construct
  misc_feature 1..166: note = Description of Artificial Sequence: Synthetic polynucleotide
  source 1..166: mol_type = other DNA
ygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyg

SEQ ID NO: 1715-1720 - skipped (6 entries)

SEQ ID NO: 1721 - DNA, 14 bp, synthetic construct
  misc_feature 1..14: note = Description of Artificial Sequence: Synthetic oligonucleotide
  source 1..14: mol_type = other DNA
ygygttgagaygyg

SEQ ID NO: 1722-1724 - skipped (3 entries)

SEQ ID NO: 1725 - DNA, 125 bp, synthetic construct
  misc_feature 1..125: note = Description of Artificial Sequence: Synthetic polynucleotide
  source 1..125: mol_type = other DNA
ygtttygygttttygtttygttatgtttttgttgttggggttgtgtttggggttgtttttgtgtgtggggtygtaggaagaggygtagagttggggttatttttyggagtaggtaagtggagtyg

SEQ ID NO: 1726 - skipped

SEQ ID NO: 1727 - DNA, 131 bp, synthetic construct
  misc_feature 1..131: note = Description of Artificial Sequence: Synthetic polynucleotide
  source 1..131: mol_type = other DNA
ygtgygtagtttagtttttttyggaygttttygttttygttygggtatatygtgtttygtatygaggtagagaggggtaygyggattttagtttttgygagtttttttgttygtygttattttatatttyg

SEQ ID NO: 1728 - DNA, 94 bp, synthetic construct
  misc_feature 1..94: note = Description of Artificial Sequence: Synthetic oligonucleotide
  source 1..94: mol_type = other DNA
ygggtygygtgggtttgggygygtygtggtgggtaagyggggttagyggagygggaattygtatatttttygagyggagtygaggataggttyg

SEQ ID NO: 1729-1730 - skipped (2 entries)

SEQ ID NO: 1731 - DNA, 27 bp, synthetic construct
  misc_feature 1..27: note = Description of Artificial Sequence: Synthetic oligonucleotide
  source 1..27: mol_type = other DNA
ygygtaagtatttttttttttatygyg

SEQ ID NO: 1732 - DNA, 164 bp, synthetic construct
  misc_feature 1..164: note = Description of Artificial Sequence: Synthetic polynucleotide
  source 1..164: mol_type = other DNA
ygygatttttttygggaggtgtttgygaaggyggttttgtygyggtgggggtggggaggttagggtttyggatygttggagttggggtygtagttagtttttggygagtgttttttggttgttgtygtaggggtttgttttttyggattttttttttaatttyg

SEQ ID NO: 1733-1734 - skipped (2 entries)

SEQ ID NO: 1735 - DNA, 68 bp, synthetic construct
  misc_feature 1..68: note = Description of Artificial Sequence: Synthetic oligonucleotide
  source 1..68: mol_type = other DNA
ygtatttgaaaatttygtygtagttattttttttttatgggaaagtttygatttyggygggtttagyg

SEQ ID NO: 1736 - DNA, 508 bp, synthetic construct
  misc_feature 1..508: note = Description of Artificial Sequence: Synthetic polynucleotide
  source 1..508: mol_type = other DNA
ygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtyg

SEQ ID NO: 1737-1746 - skipped (10 entries)

SEQ ID NO: 1747 - DNA, 396 bp, synthetic construct
  misc_feature 1..396: note = Description of Artificial Sequence: Synthetic polynucleotide
  source 1..396: mol_type = other DNA
ygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttg

SEQ ID NO: 1748 - skipped

SEQ ID NO: 1749 - DNA, 70 bp, synthetic construct
  misc_feature 1..70: note = Description of Artificial Sequence: Synthetic oligonucleotide
  source 1..70: mol_type = other DNA
ygtgatttttttatttagagattatttagggagatgttttggatgggataagtagataaatggyggttyg

SEQ ID NO: 1750 - skipped

SEQ ID NO: 1751 - DNA, 68 bp, synthetic construct
  misc_feature 1..68: note = Description of Artificial Sequence: Synthetic oligonucleotide
  source 1..68: mol_type = other DNA
ygggagttyggtygygttttttagtttyggtattygygtttagygygtygygtttygygtttttygyg

SEQ ID NO: 1752 - DNA, 88 bp, synthetic construct
  misc_feature 1..88: note = Description of Artificial Sequence: Synthetic oligonucleotide
  source 1..88: mol_type = other DNA
ygtttygygtatygttttygttttagtttttagtggygyggygttttttygygatattygygggtttttaggagygagtygattttyg

SEQ ID NO: 1753-1754 - skipped (2 entries)

SEQ ID NO: 1755 - DNA, 87 bp, synthetic construct
  misc_feature 1..87: note = Description of Artificial Sequence: Synthetic oligonucleotide
  source 1..87: mol_type = other DNA
ygggggttttttaggtygyggygtttttygtttttttttatttttygattttttttygtttttaaaatgaggaaayggagtaattyg

SEQ ID NO: 1756 - DNA, 45 bp, synthetic construct
  misc_feature 1..45: note = Description of Artificial Sequence: Synthetic oligonucleotide
  source 1..45: mol_type = other DNA
ygtggtaaattygggtttygaygatagaggtagygtagaagttyg

SEQ ID NO: 1757 - skipped

SEQ ID NO: 1758 - DNA, 173 bp, synthetic construct
  misc_feature 1..173: note = Description of Artificial Sequence: Synthetic polynucleotide
  source 1..173: mol_type = other DNA
ygggtygtggttgatatygyggagaagttaggatttttatagtttttgttagatttgaaagtaagttggaaatygatagttgttttagttgttttagattttaatttggtttgggttttttttttttttatttgaaaatagatttagggtaatgtttaagagaattttaatyg

SEQ ID NO: 1759 - skipped

SEQ ID NO: 1760 - DNA, 48 bp, synthetic construct
  misc_feature 1..48: note = Description of Artificial Sequence: Synthetic oligonucleotide
  source 1..48: mol_type = other DNA
yggggtttttgtttttggttgtagttggagttttgygtttygttttyg

SEQ ID NO: 1761-1762 - skipped (2 entries)

SEQ ID NO: 1763 - DNA, 36 bp, synthetic construct
  misc_feature 1..36: note = Description of Artificial Sequence: Synthetic oligonucleotide
  source 1..36: mol_type = other DNA
yggggtagagggggygggaagttggygttayggtyg

SEQ ID NO: 1764-1768 - skipped (5 entries)

SEQ ID NO: 1769 - DNA, 97 bp, synthetic construct
  misc_feature 1..97: note = Description of Artificial Sequence: Synthetic oligonucleotide
  source 1..97: mol_type = other DNA
ygattygggagggaaaatttttgttttttttyggggtttgttttgttygttttttaaattygttttatatttttttygattttygtttttgtaagyg

SEQ ID NO: 1770-1771 - skipped (2 entries)

SEQ ID NO: 1772 - DNA, 67 bp, synthetic construct
  misc_feature 1..67: note = Description of Artificial Sequence: Synthetic oligonucleotide
  source 1..67: mol_type = other DNA
ygatgtttgtgtttgtggttttttgaggtagtgggagtggygtgtgaaggattgtgagagtttggyg

SEQ ID NO: 1773 - skipped

SEQ ID NO: 1774 - DNA, 29 bp, synthetic construct
  misc_feature 1..29: note = Description of Artificial Sequence: Synthetic oligonucleotide
  source 1..29: mol_type = other DNA
ygggtgattgttgattttttgttttgtyg

SEQ ID NO: 1775 - DNA, 49 bp, synthetic construct
  misc_feature 1..49: note = Description of Artificial Sequence: Synthetic oligonucleotide
  source 1..49: mol_type = other DNA
ygaggtttygygtattttygttygygttttagttatttaggttyggtyg

SEQ ID NO: 1776 - DNA, 188 bp, synthetic construct
  misc_feature 1..188: note = Description of Artificial Sequence: Synthetic polynucleotide
  source 1..188: mol_type = other DNA
ygtttattgaaaatttttagttggtgttggagyggyggygtgtggttaaygttaaggagygtgagygggtgagggatttttagggtygaygttygttttttttttttttgttttattattaaatatttggttaatattygggggttygtttatygtttattttygttygaggygatttygagttttyg

SEQ ID NO: 1777-1778 - skipped (2 entries)

SEQ ID NO: 1779 - DNA, 113 bp, synthetic construct
  misc_feature 1..113: note = Description of Artificial Sequence: Synthetic polynucleotide
  source 1..113: mol_type = other DNA
ygygggtgaaggyggagtygtagggttggtttttaaagggatgttttygttygagyggygagattagtttygttygtttttygtygyggtygygtygtagtygtttayggtyg

SEQ ID NO: 1780 - DNA, 208 bp, synthetic construct
  misc_feature 1..208: note = Description of Artificial Sequence: Synthetic polynucleotide
  source 1..208: mol_type = other DNA
ygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtyg

SEQ ID NO: 1781 - DNA, 96 bp, synthetic construct
  misc_feature 1..96: note = Description of Artificial Sequence: Synthetic oligonucleotide
  source 1..96: mol_type = other DNA
ygtattttttygtattyggygtygtygtttygtygttttttttygtttgtagggtygtttygggtattttagggttgttgaggggygggygggtyg

SEQ ID NO: 1782 - DNA, 236 bp, synthetic construct
  misc_feature 1..236: note = Description of Artificial Sequence: Synthetic polynucleotide
  source 1..236: mol_type = other DNA
ygygtggaggttgygygtaggggttygggaygygggatagggatttygygtagtttaggygtyggggaatyggggttggagtyggggatttgagtttagyggaygtttttttygtttggaggttyggtayggatygggatattagggygttygtggtygtggttyggtttttggttgttgygggtygyggtttttagtgggtttttaggatttttttttayggygggtatttatyg

SEQ ID NO: 1783 - DNA, 211 bp, synthetic construct
  misc_feature 1..211: note = Description of Artificial Sequence: Synthetic polynucleotide
  source 1..211: mol_type = other DNA
ygtygttygygttttttgttttttattttttaatttttgygtggttttagggtttatatttttggagtttttttttttagtaaatagtgttgttttttatttaatagtagaggygtttaggagtttaggygatgtgtttaaggtygaatagagggatagtagtgagttgtttaatttttttagttgygtagttaggatayggttgggggyg

SEQ ID NO: 1784 - DNA, 193 bp, synthetic construct
  misc_feature 1..193: note = Description of Artificial Sequence: Synthetic polynucleotide
  source 1..193: mol_type = other DNA
ygygggggattttaggtygggayggagttttttttggttygttgtgygygtaygtttggaaaggygggatttaaggtagygatgttgygggaggttttgtagtgttaaygagttttygaayggtttygttttattttttttttgtgtgtttygtaagtttttgtttagtaaatygttatagtttyggygygyg

SEQ ID NO: 1785 - skipped

SEQ ID NO: 1786 - DNA, 199 bp, synthetic construct
  misc_feature 1..199: note = Description of Artificial Sequence: Synthetic polynucleotide
  source 1..199: mol_type = other DNA
ygtaataaattttygtagatatygtatttttaatgyggtgtttttttgtgttagtgtttyggyggtttttgtagggtgttaatgttayggttgtatatygttttttttttttattatttttatttgaatagatttggaggaggyggaaatggaaattagggtatgtttataagttggattygttagatttttttgttyg

SEQ ID NO: 1787 - DNA, 87 bp, synthetic construct
  misc_feature 1..87: note = Description of Artificial Sequence: Synthetic oligonucleotide
  source 1..87: mol_type = other DNA
ygyggtygttaygtttygttttttgtatttagtttttttggygttttygttgtagtatttaagattaggygtygtttttgttagtyg

SEQ ID NO: 1788 - DNA, 68 bp, synthetic construct
  misc_feature 1..68: note = Description of Artificial Sequence: Synthetic oligonucleotide
  source 1..68: mol_type = other DNA
ygtaaattgattatgaaatataygatgttaattyggagttgtattttttagttgggtattttygygyg

SEQ ID NO: 1789 - DNA, 61 bp, synthetic construct
  misc_feature 1..61: note = Description of Artificial Sequence: Synthetic oligonucleotide
  source 1..61: mol_type = other DNA
yggtgaaaattagtttgtggtgtattgagatttgtaaattattttttgaatgttaggggyg

SEQ ID NO: 1790 - DNA, 40 bp, synthetic construct
  misc_feature 1..40: note = Description of Artificial Sequence: Synthetic oligonucleotide
  source 1..40: mol_type = other DNA
yggatyggyggtagtagaagyggtagyggtaaagtattyg

SEQ ID NO: 1791 - DNA, 647 bp, synthetic construct
  misc_feature 1..647: note = Description of Artificial Sequence: Synthetic polynucleotide
  source 1..647: mol_type = other DNA
yggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttyg

SEQ ID NO: 1792 - DNA, 327 bp, synthetic construct
  misc_feature 1..327: note = Description of Artificial Sequence: Synthetic polynucleotide
  source 1..327: mol_type = other DNA
ygaggygygggttgagtttttagtatttggtttgagyggygtgggtagtagtttgtatygyggatatttttaattttgtygygtttgygtygtattttggtygtggtagygatttttygggtatttttgaggtygtttttagttttataagtatttagtygtttattttagagtagyggygtygatygttttaagaggagttagttttygatatygttttttatttatttttttatatttttatygttggagggggtgagtgtygtggataggygttttygttyggggatagtttagyggyggtagttagttygattttttttygyg

SEQ ID NO: 1793 - skipped

SEQ ID NO: 1794 - DNA, 324 bp, synthetic construct
  misc_feature 1..324: note = Description of Artificial Sequence: Synthetic polynucleotide
  source 1..324: mol_type = other DNA
ygtaagggtaattattggaygttggattyggtttgygaagatatgttygagaagggtaattatyggygtygtygtygtatgaagaggttttttyggtygtygttygygtatttttagttyggtaaggggtttttyggggtyggaggygtygtaggygggtgyggygtggygggygtyggggtygayggttayggttatttggygttttttaagtatttgtagtttggtttttttaataattygtggtygttatygtagttttttttatttatgttttatgttttttgttagatggyggtagtygtagyggttgtagtagttgyg

SEQ ID NO: 1795 - DNA, 77 bp, synthetic construct
  misc_feature 1..77: note = Description of Artificial Sequence: Synthetic oligonucleotide
  source 1..77: mol_type = other DNA
ygtttygtygtgttygatgggtgygtttttagygttgtygtygyggygttyggtttygggttttygtygttgygtyg

SEQ ID NO: 1796 - DNA, 158 bp, synthetic construct
  misc_feature 1..158: note = Description of Artificial Sequence: Synthetic polynucleotide
  source 1..158: mol_type = other DNA
ygtttttatttyggtatagatagtttttaaagttgttygtattttttagatttygttttttgtttagttttyggatttygtttaggggttgagttgaygttygygggtggatttttttggttygttgygtagggaattgatttygggaatttagggyg

SEQ ID NO: 1797 - DNA, 79 bp, synthetic construct
  misc_feature 1..79: note = Description of Artificial Sequence: Synthetic oligonucleotide
  source 1..79: mol_type = other DNA
ygygygtttygygtttttggyggtygtagygttgtttattaattgatttttttattgatttatttaatttttaggagyg

SEQ ID NO: 1798 - DNA, 137 bp, synthetic construct
  misc_feature 1..137: note = Description of Artificial Sequence: Synthetic polynucleotide
  source 1..137: mol_type = other DNA
ygttttggagyggtgggaggaygyggagygtygttttttggttttygatattttgttygttttttttagtgggtttgtggttgygttttttygaaggaagtaataaatttttttgattttgggggttagaggagayg

SEQ ID NO: 1799 - DNA, 112 bp, synthetic construct
  misc_feature 1..112: note = Description of Artificial Sequence: Synthetic polynucleotide
  source 1..112: mol_type = other DNA
ygttgyggtatttagyggtttatyggggttgtattgttgtagyggttttttgtgttatttgtagtttaggaggttgagtatagtgagtattagtagtagtgtatagttygyg

SEQ ID NO: 1800-1801 - skipped (2 entries)

SEQ ID NO: 1802 - DNA, 282 bp, synthetic construct
  misc_feature 1..282: note = Description of Artificial Sequence: Synthetic polynucleotide
  source 1..282: mol_type = other DNA
yggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttayg

SEQ ID NO: 1803 - DNA, 81 bp, synthetic construct
  misc_feature 1..81: note = Description of Artificial Sequence: Synthetic oligonucleotide
  source 1..81: mol_type = other DNA
yggygyggyggyggggggygtttygtaagttygyggttttgagyggttattygygtagtaagttgggygagttggtagtyg

SEQ ID NO: 1804 - DNA, 53 bp, synthetic construct
  misc_feature 1..53: note = Description of Artificial Sequence: Synthetic oligonucleotide
  source 1..53: mol_type = other DNA
ygyggtttttgttttttgygttagygtgagttyggttagggtttttayggtyg

SEQ ID NO: 1805 - DNA, 40 bp, synthetic construct
  misc_feature 1..40: note = Description of Artificial Sequence: Synthetic oligonucleotide
  source 1..40: mol_type = other DNA
yggygttagtttaygttttygttggygttttttyggygyg

SEQ ID NO: 1806 - DNA, 206 bp, synthetic construct
  misc_feature 1..206: note = Description of Artificial Sequence: Synthetic polynucleotide
  source 1..206: mol_type = other DNA
yggtygatttatttggtgtygygtgygttggyggttygygyggtagttaagttaaaggtygaggtygaggtygagygyggygtttagtagtayggygggggttagtagggygggygtyggtygtagygygtttygttttagtagtagtygygygtygtttttgtaggtygtttygtygygggttattyggggygtttaggttgtyg

SEQ ID NO: 1807 - DNA, 38 bp, synthetic construct
  misc_feature 1..38: note = Description of Artificial Sequence: Synthetic oligonucleotide
  source 1..38: mol_type = other DNA
ygttgttgttgygyggggyggyggtygtygtgttttyg

SEQ ID NO: 1808 - skipped

SEQ ID NO: 1809 - DNA, 25 bp, synthetic construct
  misc_feature 1..25: note = Description of Artificial Sequence: Synthetic oligonucleotide
  source 1..25: mol_type = other DNA
ygtgtgtaygygttgtattygttyg

SEQ ID NO: 1810 - DNA, 79 bp, synthetic construct
  misc_feature 1..79: note = Description of Artificial Sequence: Synthetic oligonucleotide
  source 1..79: mol_type = other DNA
ygttttttttttttttttttttttattaaatattatttgggaattgtttaaattttttttttaaaaaaagagagaggyg

SEQ ID NO: 1811 - DNA, 33 bp, synthetic construct
  misc_feature 1..33: note = Description of Artificial Sequence: Synthetic oligonucleotide
  source 1..33: mol_type = other DNA
yggtttygygtggygtttyggtygttgttttyg

SEQ ID NO: 1812 - DNA, 132 bp, synthetic construct
  misc_feature 1..132: note = Description of Artificial Sequence: Synthetic polynucleotide
  source 1..132: mol_type = other DNA
yggygggyggyggyggygyggagttgtatayggagaagayggagtgygggygttayggagagtattygtttaagtaggaygttygyggggaggtggttatggttagttyggtttaygatygtttggtttgyg

SEQ ID NO: 1813 - DNA, 32 bp, synthetic construct
  misc_feature 1..32: note = Description of Artificial Sequence: Synthetic oligonucleotide
  source 1..32: mol_type = other DNA
ygtttggtatttttttttttgtttygagggyg

SEQ ID NO: 1814-1815 - skipped (2 entries)

SEQ ID NO: 1816 - DNA, 20 bp, synthetic construct
  misc_feature 1..20: note = Description of Artificial Sequence: Synthetic oligonucleotide
  source 1..20: mol_type = other DNA
ygagtatgttagyggygtyg

SEQ ID NO: 1817 - DNA, 85 bp, synthetic construct
  misc_feature 1..85: note = Description of Artificial Sequence: Synthetic oligonucleotide
  source 1..85: mol_type = other DNA
yggtaygttttttttttyggtygtttttttttatataagygtaggtagagggygygttagttatgttttgtttttgygttygtyg

SEQ ID NO: 1818 - DNA, 230 bp, synthetic construct
  misc_feature 1..230: note = Description of Artificial Sequence: Synthetic polynucleotide
  source 1..230: mol_type = other DNA
yggtttygygaaattyggttttttagttygygggaygygttgtttgttaggygggttyggyggtatttygggggygggaggggtyggtygtagggtttttagtttggygttygyggggygttygtagygaaggggtgggtgtygttygtgaaygtagtagggattagtttagttygygttygtttttgggtttyggttatygttttttygttattttttyggtttttgyg

SEQ ID NO: 1819 - DNA, 84 bp, synthetic construct
  misc_feature 1..84: note = Description of Artificial Sequence: Synthetic oligonucleotide
  source 1..84: mol_type = other DNA
ygggtygttagttttagggtgtygggttttaattaaggtttygaagtttttaygtatttgagggtattttgattagtttttgyg

SEQ ID NO: 1820 - DNA, 42 bp, synthetic construct
  misc_feature 1..42: note = Description of Artificial Sequence: Synthetic oligonucleotide
  source 1..42: mol_type = other DNA
ygygatttttttttgatttagttaaayggaaaagttygygyg

SEQ ID NO: 1821 - DNA, 45 bp, synthetic construct
  misc_feature 1..45: note = Description of Artificial Sequence: Synthetic oligonucleotide
  source 1..45: mol_type = other DNA
ygtygtgttttttttygttttygaaagggtagaaagagtygttyg

SEQ ID NO: 1822 - DNA, 26 bp, synthetic construct
  misc_feature 1..26: note = Description of Artificial Sequence: Synthetic oligonucleotide
  source 1..26: mol_type = other DNA
ygttygttagtattttttgtttygyg

SEQ ID NO: 1823 - DNA, 50 bp, synthetic construct
  misc_feature 1..50: note = Description of Artificial Sequence: Synthetic oligonucleotide
  source 1..50: mol_type = other DNA
ygaggtttaggtggaggttgaggttgtygygygtygygggaggagtttyg

SEQ ID NO: 1824 - DNA, 56 bp, synthetic construct
  misc_feature 1..56: note = Description of Artificial Sequence: Synthetic oligonucleotide
  source 1..56: mol_type = other DNA
ygtttttgagttagggaygygygtggggggtgggygtgtaygygggtgggttagyg

SEQ ID NO: 1825 - DNA, 44 bp, synthetic construct
  misc_feature 1..44: note = Description of Artificial Sequence: Synthetic oligonucleotide
  source 1..44: mol_type = other DNA
ygtttttatygygtaygygtttttttygygygygtataygttyg

SEQ ID NO: 1826-1827 - skipped (2 entries)

SEQ ID NO: 1828 - DNA, 58 bp, synthetic construct
  misc_feature 1..58: note = Description of Artificial Sequence: Synthetic oligonucleotide
  source 1..58: mol_type = other DNA
ygyggggtagttgtttaagtggatygatattatygtttgtttggygggtaggygggyg

SEQ ID NO: 1829 - DNA, 151 bp, synthetic construct
  misc_feature 1..151: note = Description of Artificial Sequence: Synthetic polynucleotide
  source 1..151: mol_type = other DNA
yggtagaagatagygtttttaggattagygattttgtggtttattyggttattgggtttyggygtaaattttttttaggtagtgygggygatgttgattgtagaygtygggtagggttttygtgygggygggagygggggaagttagtgyg

SEQ ID NO: 1830 - DNA, 17 bp, synthetic construct
  misc_feature 1..17: note = Description of Artificial Sequence: Synthetic oligonucleotide
  source 1..17: mol_type = other DNA
yggattttttaggatyg

SEQ ID NO: 1831 - DNA, 70 bp, synthetic construct
  misc_feature 1..70: note = Description of Artificial Sequence: Synthetic oligonucleotide
  source 1..70: mol_type = other DNA
ygttygttgtttttygttgygtttagggatggagggttttattatttatggaattgttggtttttttgyg

SEQ ID NO: 1832 - DNA, 59 bp, synthetic construct
  misc_feature 1..59: note = Description of Artificial Sequence: Synthetic oligonucleotide
  source 1..59: mol_type = other DNA
ygtttttgagatttygttgagaaatttttagygggttagygtttgggygttgggygtyg

SEQ ID NO: 1833 - DNA, 25 bp, synthetic construct
  misc_feature 1..25: note = Description of Artificial Sequence: Synthetic oligonucleotide
  source 1..25: mol_type = other DNA
ygttgggtaatttttattygagtyg

SEQ ID NO: 1834 - DNA, 57 bp, synthetic construct
  misc_feature 1..57: note = Description of Artificial Sequence: Synthetic oligonucleotide
  source 1..57: mol_type = other DNA
yggygttgaygttttggttttgggggttgtttggttggtgttaggtagyggaagayg

SEQ ID NO: 1835 - DNA, 111 bp, synthetic construct
  misc_feature 1..111: note = Description of Artificial Sequence: Synthetic polynucleotide
  source 1..111: mol_type = other DNA
ygagtagttttaygttttgttaaggayggtaggtgtaagggtygggggattttttgayggggtygttttttygggtayggggaggtttttatygagttttaattttgaayg

SEQ ID NO: 1836 - DNA, 211 bp, synthetic construct
  misc_feature 1..211: note = Description of Artificial Sequence: Synthetic polynucleotide
  source 1..211: mol_type = other DNA
ygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyg

SEQ ID NO: 1837 - DNA, 75 bp, synthetic construct
  misc_feature 1..75: note = Description of Artificial Sequence: Synthetic oligonucleotide
  source 1..75: mol_type = other DNA
ygtttttaygygygttgtyggtatttgttygttttgttgtaatttgttgtagtgtttgaaagagtagtaggagyg

SEQ ID NO: 1838 - skipped

SEQ ID NO: 1839 - DNA, 66 bp, synthetic construct
  misc_feature 1..66: note = Description of Artificial Sequence: Synthetic oligonucleotide
  source 1..66: mol_type = other DNA
ygggygttggagaaggygtttggygygaagttgggyggygtttygagggyggaggataggtggtyg

SEQ ID NO: 1840 - skipped

SEQ ID NO: 1841 - DNA, 163 bp, synthetic construct
  misc_feature 1..163: note = Description of Artificial Sequence: Synthetic polynucleotide
  source 1..163: mol_type = other DNA
yggggyggygggygtatgygygtgygyggtgyggttttagttttggttgtygtygtttgtygtygtygtygygatgtttattttagttaaagyggttgygggtttggggattyggttygggtagyggagttttyggattygtygattygtygaggagygygyg

SEQ ID NO: 1842 - DNA, 99 bp, synthetic construct
  misc_feature 1..99: note = Description of Artificial Sequence: Synthetic oligonucleotide
  source 1..99: mol_type = other DNA
yggagtaaagttagygygtttygyggttyggaatttagttggttygttatttttttatttttgygattttattttygatygygttttagggtagaagyg

SEQ ID NO: 1843 - DNA, 96 bp, synthetic construct
  misc_feature 1..96: note = Description of Artificial Sequence: Synthetic oligonucleotide
  source 1..96: mol_type = other DNA
yggyggyggyggtagttttagtygygttygttatatatatttttattygttyggtgtataygtygygtygygggtagtgtygtttgyggaggygyg

SEQ ID NO: 1844 - skipped

SEQ ID NO: 1845 - DNA, 16 bp, synthetic construct
  misc_feature 1..16: note = Description of Artificial Sequence: Synthetic oligonucleotide
  source 1..16: mol_type = other DNA
ygtgttaatttygtyg

SEQ ID NO: 1846 - skipped

SEQ ID NO: 1847 - DNA, 141 bp, synthetic construct
  misc_feature 1..141: note = Description of Artificial Sequence: Synthetic polynucleotide
  source 1..141: mol_type = other DNA
ygtttattttgtagtygagtatataaggttygtygaagttatygagtaggttttgtagttgtaggtagttttygtygtygygttttattaygtygtggaaggtaggtaygtagtygygtagygygttagttattagtygyg

SEQ ID NO: 1848 - skipped

SEQ ID NO: 1849 - DNA, 37 bp, synthetic construct
  misc_feature 1..37: note = Description of Artificial Sequence: Synthetic oligonucleotide
  source 1..37: mol_type = other DNA
ygaggtgttgygggttttgtgyggttggttgggaayg

SEQ ID NO: 1850 - DNA, 52 bp, synthetic construct
  misc_feature 1..52: note = Description of Artificial Sequence: Synthetic oligonucleotide
  source 1..52: mol_type = other DNA
ygaggygttttygttttygttatttatatagggygttaagtgtttygattyg

SEQ ID NO: 1851-1854 - skipped (4 entries)

SEQ ID NO: 1855 - DNA, 17 bp, synthetic construct
  misc_feature 1..17: note = Description of Artificial Sequence: Synthetic oligonucleotide
  source 1..17: mol_type = other DNA
ygtttygttttaattyg

SEQ ID NO: 1856 - DNA, 136 bp, synthetic construct
  misc_feature 1..136: note = Description of Artificial Sequence: Synthetic polynucleotide
  source 1..136: mol_type = other DNA
ygyggggggaggtttttggttygtygttttygttgtygtttgatygtatttttggagggtttygtattttgttaggtttttggaggtaaatatatattttygatttataattggttttygygttaggggattygyg

SEQ ID NO: 1857 - DNA, 31 bp, synthetic construct
  misc_feature 1..31: note = Description of Artificial Sequence: Synthetic oligonucleotide
  source 1..31: mol_type = other DNA
yggttagggagtgagyggggygttgggygyg

SEQ ID NO: 1858 - DNA, 25 bp, synthetic construct
  misc_feature 1..25: note = Description of Artificial Sequence: Synthetic oligonucleotide
  source 1..25: mol_type = other DNA
ygttaattagattttagggtgtayg

SEQ ID NO: 1859 - DNA, 12 bp, synthetic construct
  misc_feature 1..12: note = Description of Artificial Sequence: Synthetic oligonucleotide
  source 1..12: mol_type = other DNA
ygttygttaayg

SEQ ID NO: 1860 - skipped

SEQ ID NO: 1861 - DNA, 199 bp, synthetic construct
  misc_feature 1..199: note = Description of Artificial Sequence: Synthetic polynucleotide
  source 1..199: mol_type = other DNA
ygtagygtgtagtygyggaatagygtttttagttttgggtaagygaatttttygtygtaygttyggagttygygtyggyggtttgtttyggtygttygttyggygttttygggttygttygygtygttttygtygtygttttygtygygyggygttttygttattttagygttatgtagyggtygyggtygygggygyg

SEQ ID NO: 1862 - DNA, 91 bp, synthetic construct
  misc_feature 1..91: note = Description of Artificial Sequence: Synthetic oligonucleotide
  source 1..91: mol_type = other DNA
ygtgggggygyggygygggygataygtgygggtygttaggagggggagggggaygygygtygtygggttygttattttgtattyggggtyg

SEQ ID NO: 1863 - DNA, 108 bp, synthetic construct
  misc_feature 1..108: note = Description of Artificial Sequence: Synthetic polynucleotide
  source 1..108: mol_type = other DNA
ygttttttttatggattttttagtatttgtaggttataggataatagaagttatagtagagttatygaggaattttaggaayggaggagatggaatagtggagaygyg

SEQ ID NO: 1864 - DNA, 13 bp, synthetic construct
  misc_feature 1..13: note = Description of Artificial Sequence: Synthetic oligonucleotide
  source 1..13: mol_type = other DNA
ygaaatyggtgyg

SEQ ID NO: 1865 - DNA, 176 bp, synthetic construct
  misc_feature 1..176: note = Description of Artificial Sequence: Synthetic polynucleotide
  source 1..176: mol_type = other DNA
ygggggyggyggggtgatagttttygtgtatgaattagttattttttaggtttygtttyggygggggtyggtyggaygttygtttygtataaagygggtattygggtygtttggagtagaaagtygygtattttttttygttaggygttttttyggaygttttgtttagygggtyg

SEQ ID NO: 1866 - skipped

SEQ ID NO: 1867 - DNA, 157 bp, synthetic construct
  misc_feature 1..157: note = Description of Artificial Sequence: Synthetic polynucleotide
  source 1..157: mol_type = other DNA
ygggygtttttttaggtttggtygaggggygtygygtagaggyggyggyggygtayggaggyggtagaygaygygttttyggygttygtagtttyggtttygygttttygyggtttaaagtaattttgggagtygtygtttttygyggaatttttyg

SEQ ID NO: 1868 - DNA, 66 bp, synthetic construct
  misc_feature 1..66: note = Description of Artificial Sequence: Synthetic oligonucleotide
  source 1..66: mol_type = other DNA
yggtygyggygggagggatagggggtttgggtgggaagggagygygagggtttttagyggttygyg

SEQ ID NO: 1869 - DNA, 498 bp, synthetic construct
  misc_feature 1..498: note = Description of Artificial Sequence: Synthetic polynucleotide
  source 1..498: mol_type = other DNA
ygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggyg

SEQ ID NO: 1870 - DNA, 27 bp, synthetic construct
  misc_feature 1..27: note = Description of Artificial Sequence: Synthetic oligonucleotide
  source 1..27: mol_type = other DNA
ygagygygaagggygttyggattygyg

SEQ ID NO: 1871-1872 - skipped (2 entries)

SEQ ID NO: 1873 - DNA, 16 bp, synthetic construct
  misc_feature 1..16: note = Description of Artificial Sequence: Synthetic oligonucleotide
  source 1..16: mol_type = other DNA
ygygaggtaggygayg

SEQ ID NO: 1874 - DNA, 53 bp, synthetic construct
  misc_feature 1..53: note = Description of Artificial Sequence: Synthetic oligonucleotide
  source 1..53: mol_type = other DNA
ygtygtaagagaagttgttaagtttygtaggttttgattyggygtttttygyg

SEQ ID NO: 1875-1878 - skipped (4 entries)

SEQ ID NO: 1879 - DNA, 14 bp, synthetic construct
  misc_feature 1..14: note = Description of Artificial Sequence: Synthetic oligonucleotide
  source 1..14: mol_type = other DNA
ygtaggtggatayg

SEQ ID NO: 1880 - DNA, 186 bp, synthetic construct
  misc_feature 1..186: note = Description of Artificial Sequence: Synthetic polynucleotide
  source 1..186: mol_type = other DNA
ygttatggagaaaattaatggaggaaaaattatagagttattygaaatagttgygttgtttattattyggtgtttgagtttgttttttttgtaattagattatatgtgaggtagttttagttaattgtttgtgttatttatyggggaattttagttttatttgtgaatatttaggttttttygtyg

SEQ ID NO: 1881 - DNA, 79 bp, synthetic construct
  misc_feature 1..79: note = Description of Artificial Sequence: Synthetic oligonucleotide
  source 1..79: mol_type = other DNA
ygygtattttttttatttygatatttattgttatttttatagyggagygaggggtttygtygagggygagygtatttyg

SEQ ID NO: 1882 - DNA, 49 bp, synthetic construct
  misc_feature 1..49: note = Description of Artificial Sequence: Synthetic oligonucleotide
  source 1..49: mol_type = other DNA
ygygggggygtttttygttgtttgtagggagygyggygyggaygyggyg

SEQ ID NO: 1883 - DNA, 17 bp, synthetic construct
  misc_feature 1..17: note = Description of Artificial Sequence: Synthetic oligonucleotide
  source 1..17: mol_type = other DNA
ygygaayggtttattyg

SEQ ID NO: 1884-1886 - skipped (3 entries)

SEQ ID NO: 1887 - DNA, 165 bp, synthetic construct
  misc_feature 1..165: note = Description of Artificial Sequence: Synthetic polynucleotide
  source 1..165: mol_type = other DNA
yggggtttggtaggaagtgtagtgtattttttagttttagggtaattaggatagtatgaattttttattttgtggtagaataaayggttagygtttygatgtggygygttygatttttttttatagagtttaaaagttaygtttaattaaattgtagygttttyg

SEQ ID NO: 1888 - DNA, 14 bp, synthetic construct
  misc_feature 1..14: note = Description of Artificial Sequence: Synthetic oligonucleotide
  source 1..14: mol_type = other DNA
ygttgattygygyg

SEQ ID NO: 1889-1890 - skipped (2 entries)

SEQ ID NO: 1891 - DNA, 97 bp, synthetic construct
  misc_feature 1..97: note = Description of Artificial Sequence: Synthetic oligonucleotide
  source 1..97: mol_type = other DNA
ygtttygtaygttygtaygtttagyggggttygtattgagtatgggygyggyggtygtgygttggtatttgtgygtgttgttggttttgggtatayg

SEQ ID NO: 1892 - skipped

SEQ ID NO: 1893 - DNA, 98 bp, synthetic construct
  misc_feature 1..98: note = Description of Artificial Sequence: Synthetic oligonucleotide
  source 1..98: mol_type = other DNA
ygaggtttagtttttggttttaaggaataaattygttggtttgaaagggagttayggtagaagtttaggggtagagyggygggagygygygattygyg

SEQ ID NO: 1894 - DNA, 69 bp, synthetic construct
  misc_feature 1..69: note = Description of Artificial Sequence: Synthetic oligonucleotide
  source 1..69: mol_type = other DNA
ygyggaaggttygygygttttgygtygtygtygtttagtgtygtygttagtatttttttygttttttyg

SEQ ID NO: 1895-1898 - skipped (4 entries)

SEQ ID NO: 1899 - DNA, 103 bp, synthetic construct
  misc_feature 1..103: note = Description of Artificial Sequence: Synthetic polynucleotide
  source 1..103: mol_type = other DNA
ygygttygtygttttyggaggagygggttggtygatygttatygygtygtttttyggtygttttygaagtygttttatygyggtttttgtygttttggggtyg

SEQ ID NO: 1900 - skipped

SEQ ID NO: 1901 - DNA, 21 bp, synthetic construct
  misc_feature 1..21: note = Description of Artificial Sequence: Synthetic oligonucleotide
  source 1..21: mol_type = other DNA
ygtygtygtygttgagagtyg

SEQ ID NO: 1902 - DNA, 148 bp, synthetic construct
  misc_feature 1..148: note = Description of Artificial Sequence: Synthetic polynucleotide
  source 1..148: mol_type = other DNA
ygygygggygygaggggttgggaygygggagttttttgagtgyggagygyggagttttggtgtttyggygtattgtagttatattttygggtygygygttttygtygttttttattygygtygtagggtttttttttttgaggygtyg

SEQ ID NO: 1903-1904 - skipped (2 entries)

SEQ ID NO: 1905 - DNA, 26 bp, synthetic construct
  misc_feature 1..26: note = Description of Artificial Sequence: Synthetic oligonucleotide
  source 1..26: mol_type = other DNA
yggttattaygygttgtttttyggyg

SEQ ID NO: 1906 - DNA, 119 bp, synthetic construct
  misc_feature 1..119: note = Description of Artificial Sequence: Synthetic polynucleotide
  source 1..119: mol_type = other DNA
ygttygatgatgaggatgtatttttygtaggtgtagtttttgaagyggtagtaaygtttgtggtttttgagttaggataggaygttatggttgyggtagygygygtatttgggygtgyg

SEQ ID NO: 1907 - DNA, 66 bp, synthetic construct
  misc_feature 1..66: note = Description of Artificial Sequence: Synthetic oligonucleotide
  source 1..66: mol_type = other DNA
ygttttattttgttgaggtygttttyggttttttttgatttaggttgggygggaaaggtygggtyg

SEQ ID NO: 1908 - DNA, 60 bp, synthetic construct
  misc_feature 1..60: note = Description of Artificial Sequence: Synthetic oligonucleotide
  source 1..60: mol_type = other DNA
ygyggttggggtttygygttttttggagygttttttgtttagataygaygatttygttyg

SEQ ID NO: 1909 - skipped

SEQ ID NO: 1910 - DNA, 124 bp, synthetic construct
  misc_feature 1..124: note = Description of Artificial Sequence: Synthetic polynucleotide
  source 1..124: mol_type = other DNA
yggyggtaggagaagtttaaggttygagyggttygtagtttttaygtttgtatttttttattttygttagttygatggttygtttygyggygtgtattggagtaagtaggtttygtttygagyg

SEQ ID NO: 1911 - skipped

SEQ ID NO: 1912 - DNA, 156 bp, synthetic construct
  misc_feature 1..156: note = Description of Artificial Sequence: Synthetic polynucleotide
  source 1..156: mol_type = other DNA
ygtttyggtttttatygtygygtttttataggttattaggtgtygttygtttagaatgttaattatggygtagataygtagttatttgagattygaggatatttgtaggaggatgattatttgyggggaggyggyggygagygtygyggtgtttyg

SEQ ID NO: 1913 - skipped

SEQ ID NO: 1914 - DNA, 91 bp, synthetic construct
  misc_feature 1..91: note = Description of Artificial Sequence: Synthetic oligonucleotide
  source 1..91: mol_type = other DNA
ygttttaggaatgattyggtgatatyggtygatgattttttttatagtttgtyggtgagyggyggyggaggtaaggtttyggyggygygyg

SEQ ID NO: 1915-1916 - skipped (2 entries)

SEQ ID NO: 1917 - DNA, 89 bp, synthetic construct
  misc_feature 1..89: note = Description of Artificial Sequence: Synthetic oligonucleotide
  source 1..89: mol_type = other DNA
ygtygagttgtaggygygygtttaatygttttgttgggtttaygyggtttgagaggtyggagygtttaattgttggtaygygagtaayg

SEQ ID NO: 1918 - DNA, 13 bp, synthetic construct
  misc_feature 1..13: note = Description of Artificial Sequence: Synthetic oligonucleotide
  source 1..13: mol_type = other DNA
yggattaaagayg

SEQ ID NO: 1919 - skipped

SEQ ID NO: 1920 - DNA, 47 bp, synthetic construct
  misc_feature 1..47: note = Description of Artificial Sequence: Synthetic oligonucleotide
  source 1..47: mol_type = other DNA
ygygatgtggtttygtttggttttttgttgttggggtttggygttyg

SEQ ID NO: 1921-1922 - skipped (2 entries)

SEQ ID NO: 1923 - DNA, 159 bp, synthetic construct
  misc_feature 1..159: note = Description of Artificial Sequence: Synthetic polynucleotide
  source 1..159: mol_type = other DNA
ygtttttygtygaggygtaggggtagttatattgyggggygtttgggygayggygttaaagttagggttataagggtaygggataagyggggyggggggagtaggagattaggatagaggtyggygttygtygygggygtttttaygtygygggtatyg

SEQ ID NO: 1924-1926 - skipped (3 entries)

SEQ ID NO: 1927 - DNA, 78 bp, synthetic construct
  misc_feature 1..78: note = Description of Artificial Sequence: Synthetic oligonucleotide
  source 1..78: mol_type = other DNA
yggtygttttttygaygttygyggttttttattgygtygaggygagygttayggttaaagtttaagtttyggygttyg

SEQ ID NO: 1928 - skipped

SEQ ID NO: 1929 - DNA, 48 bp, synthetic construct
  misc_feature 1..48: note = Description of Artificial Sequence: Synthetic oligonucleotide
  source 1..48: mol_type = other DNA
ygygttaattyggtygttgtgtayggtygggtgygaaattttttygyg

SEQ ID NO: 1930-1932 - skipped (3 entries)

SEQ ID NO: 1933 - DNA, 157 bp, synthetic construct
  misc_feature 1..157: note = Description of Artificial Sequence: Synthetic polynucleotide
  source 1..157: mol_type = other DNA
ygtgtttaattggtatttgttattaatatgtttgtttttatttaaatggtttagagtaaggttttgattaaattagtatttttaygttaatatttagtagygtttttggtttttggtagattttttttttagttgttaaagtaaaattatagaagyg

SEQ ID NO: 1934 - skipped

SEQ ID NO: 1935 - DNA, 82 bp, synthetic construct
  misc_feature 1..82: note = Description of Artificial Sequence: Synthetic oligonucleotide
  source 1..82: mol_type = other DNA
ygtattygyggggagggyggygagyggggattagtygaagtygggagaggggygtttttayggggygggaaattggygygyg

SEQ ID NO: 1936 - DNA, 23 bp, synthetic construct
  misc_feature 1..23: note = Description of Artificial Sequence: Synthetic oligonucleotide
  source 1..23: mol_type = other DNA
yggttaggtgaggyggttaggyg

SEQ ID NO: 1937 - DNA, 38 bp, synthetic construct
  misc_feature 1..38: note = Description of Artificial Sequence: Synthetic oligonucleotide
  source 1..38: mol_type = other DNA
ygaattygtaaagttgttygtagaygygygggaattyg

SEQ ID NO: 1938 - skipped

SEQ ID NO: 1939 - DNA, 165 bp, synthetic construct
  misc_feature 1..165: note = Description of Artificial Sequence: Synthetic polynucleotide
  source 1..165: mol_type = other DNA
ygygggttgtttagygtgttagattttttttttttggaygtgygtaagttgttggtggtyggtaatygtatttagyggattttygaggatttttttattttttayggygatttggtttatttggattttaggaataattygttgygttygttggaggagggtayg

SEQ ID NO: 1940-1942 - skipped (3 entries)

SEQ ID NO: 1943 - DNA, 23 bp, synthetic construct
  misc_feature 1..23: note = Description of Artificial Sequence: Synthetic oligonucleotide
  source 1..23: mol_type = other DNA
ygataggyggttttyggatatyg

SEQ ID NO: 1944 - skipped

SEQ ID NO: 1945 - DNA, 66 bp, synthetic construct
  misc_feature 1..66: note = Description of Artificial Sequence: Synthetic oligonucleotide
  source 1..66: mol_type = other DNA
yggygttttyggggttgttgygygttygygtttagagttgtygttttagggagttygttayggtyg

SEQ ID NO: 1946 - DNA, 43 bp, synthetic construct
  misc_feature 1..43: note = Description of Artificial Sequence: Synthetic oligonucleotide
  source 1..43: mol_type = other DNA
ygggygygtagttygttygygyggtttggattttttttgttyg

SEQ ID NO: 1947 - skipped

SEQ ID NO: 1948 - DNA, 62 bp, synthetic construct
  misc_feature 1..62: note = Description of Artificial Sequence: Synthetic oligonucleotide
  source 1..62: mol_type = other DNA
ygygttgtaygaggatggttaygaggygtagttggagtygtygtygtygtygtatttgggyg

SEQ ID NO: 1949 - skipped

SEQ ID NO: 1950 - DNA, 138 bp, synthetic construct
  misc_feature 1..138: note = Description of Artificial Sequence: Synthetic polynucleotide
  source 1..138: mol_type = other DNA
ygttttygggygtayggaaattatttgttaggaaatttttaaygttttttttygtttatttttttttattttttttttggygygttttttttttttttagaggtaygtagtggagtttttggagtttygaatttttyg

SEQ ID NO: 1951-1954 - skipped (4 entries)

SEQ ID NO: 1955 - DNA, 187 bp, synthetic construct
  misc_feature 1..187: note = Description of Artificial Sequence: Synthetic polynucleotide
  source 1..187: mol_type = other DNA
ygagyggttttaatttygtttygtttgttgttgttgttgttggtgttgtttyggttgtagttgttgtygttttaygatttyggggygttgaggtaatagggttttttttttttattttttatttttttyggtttttttatagaagygtygtttttagtaatttttygtgtattttttatttttgtyg

SEQ ID NO: 1956-1957 - skipped (2 entries)

SEQ ID NO: 1958 - DNA, 110 bp, synthetic construct
  misc_feature 1..110: note = Description of Artificial Sequence: Synthetic polynucleotide
  source 1..110: mol_type = other DNA
ygtaggttaagatttggttttagaattatygttataagttgaagygygttygygttttaggggyggyggagtygtttgatttggtagtattygtygagttgtaygtygyg

SEQ ID NO: 1959 - skipped

SEQ ID NO: 1960 - DNA, 189 bp, synthetic construct
  misc_feature 1..189: note = Description of Artificial Sequence: Synthetic polynucleotide
  source 1..189: mol_type = other DNA
ygtgttttygttygygtttgggtttygtygtattttagtagaagttattatagagaataaattatttttttgttttygagatgggttttyggggaggaaggtaaattgtttgtttygtgtataataagttaggygtggagagtagygyggaggaggtygyggtagttatygagygggtagagtttttyg

SEQ ID NO: 1961 - DNA, 42 bp, synthetic construct
  misc_feature 1..42: note = Description of Artificial Sequence: Synthetic oligonucleotide
  source 1..42: mol_type = other DNA
ygygagtgtatttaagygttttygttttatttatttttagyg

SEQ ID NO: 1962 - DNA, 33 bp, synthetic construct
  misc_feature 1..33: note = Description of Artificial Sequence: Synthetic oligonucleotide
  source 1..33: mol_type = other DNA
ygtggagygtaaagtgtttgaagttttygygyg

SEQ ID NO: 1963 - DNA, 15 bp, synthetic construct
  misc_feature 1..15: note = Description of Artificial Sequence: Synthetic oligonucleotide
  source 1..15: mol_type = other DNA
ygttyggttggygyg

SEQ ID NO: 1964 - DNA, 51 bp, synthetic construct
  misc_feature 1..51: note = Description of Artificial Sequence: Synthetic oligonucleotide
  source 1..51: mol_type = other DNA
ygtttattayggygatttgyggtagttttagtaggtagttttgttttagyg

SEQ ID NO: 1965 - skipped

SEQ ID NO: 1966 - DNA, 268 bp, synthetic construct
  misc_feature 1..268: note = Description of Artificial Sequence: Synthetic polynucleotide
  source 1..268: mol_type = other DNA
ygaagatgggaaayggtygtttgttgagagggggtatttgtagtttttttagaaaaggttggggtaggagagygtgyggttagaggggtgggggtatyggagggggggttttattttttgttttatagtygggtttttttygygaggygttgggaagtatgaggtatgtagtatttaaaatgttttttgaaaaagayggatttgaagtttttttttataaataygttattgtatttattttttatttagagaygggttgygygtttyg

SEQ ID NO: 1967 - skipped

SEQ ID NO: 1968 - DNA, 33 bp, synthetic construct
  misc_feature 1..33: note = Description of Artificial Sequence: Synthetic oligonucleotide
  source 1..33: mol_type = other DNA
yggtgatyggtttgattgtttttgggggtttyg

SEQ ID NO: 1969 - DNA, 23 bp, synthetic construct
  misc_feature 1..23: note = Description of Artificial Sequence: Synthetic oligonucleotide
  source 1..23: mol_type = other DNA
ygaaagtttygggttagtgggyg

SEQ ID NO: 1970 - DNA, 40 bp, synthetic construct
  misc_feature 1..40: note = Description of Artificial Sequence: Synthetic oligonucleotide
  source 1..40: mol_type = other DNA
ygaggtatttggtygggyggggaggygtygggtyggggyg

SEQ ID NO: 1971 - DNA, 10 bp, synthetic construct
  misc_feature 1..10: note = Description of Artificial Sequence: Synthetic oligonucleotide
  source 1..10: mol_type = other DNA
yggagtygyg

SEQ ID NO: 1972 - DNA, 181 bp, synthetic construct
  misc_feature 1..181: note = Description of Artificial Sequence: Synthetic polynucleotide
  source 1..181: mol_type = other DNA
ygaaaaygaaatttatttttttgygtttatttttgttagaggtttgtaggaygtgttttaatttggtatttygagtttagaataaaagttaygggggttgyggtatgggtagggggaaggygygyggtggttgaygyggggtaggggttttggygagygygggaggggyggttagtagtyg

SEQ ID NO: 1973 - DNA, 195 bp, synthetic construct
  misc_feature 1..195: note = Description of Artificial Sequence: Synthetic polynucleotide
  source 1..195: mol_type = other DNA
ygttaagtagtaggattatagygttagygtttggtttyggaggaaagataagttggagtaygtaagggygattygttttygggggtttyggttaggtatttgtygtatgtatttttttygtggtggtggtatgagygygygyggggygyggggggtaggygaggggattttggtaggygtygaygttttaggtyg

SEQ ID NO: 1974 - skipped

SEQ ID NO: 1975 - DNA, 358 bp, synthetic construct
  misc_feature 1..358: note = Description of Artificial Sequence: Synthetic polynucleotide
  source 1..358: mol_type = other DNA
ygygagttygggtgagagttatyggaatgygggaaygtagtttagtygggaatagggttttygataggggtygttygtggttaggaygyggtygttgaatagaggtygygyggyggtttttgttygagggatttygtgggygggggttatayggaggtygygtayggttttyggggttggygggggtaggtgggaggatttttttygggttygygaatttgatttggtagyggttaggtgtttggaagygtttttaaatgatagggttataaagatatgttggttaggtttgtagttagygtagtaaygtggtttgtaggagygtagaaygaggttagatagggttattyggaygtyg

SEQ ID NO: 1976 - DNA, 13 bp, synthetic construct
  misc_feature 1..13: note = Description of Artificial Sequence: Synthetic oligonucleotide
  source 1..13: mol_type = other DNA
ygttataattgyg

SEQ ID NO: 1977-1978 - skipped (2 entries)

SEQ ID NO: 1979 - DNA, 95 bp, synthetic construct
  misc_feature 1..95: note = Description of Artificial Sequence: Synthetic oligonucleotide
  source 1..95: mol_type = other DNA
ygggtattygggaygaggygagggygtagaaaatttggagtttaattagtayggagttgagttttygygttttaatttttaggtgatttygtgyg

SEQ ID NO: 1980 - DNA, 45 bp, synthetic construct
  misc_feature 1..45: note = Description of Artificial Sequence: Synthetic oligonucleotide
  source 1..45: mol_type = other DNA
ygtygagagggtaggaygygtayggtgygttttaatttgttgtyg

SEQ ID NO: 1981 - DNA, 104 bp, synthetic construct
  misc_feature 1..104: note = Description of Artificial Sequence: Synthetic polynucleotide
  source 1..104: mol_type = other DNA
ygygagttagggggaggygygtyggaaagygagagtgataagtagtttataagtygaaaagtttttygygggaggygygygtygygtgggtttygatttagtyg

SEQ ID NO: 1982 - DNA, 87 bp, synthetic construct
  misc_feature 1..87: note = Description of Artificial Sequence: Synthetic oligonucleotide
  source 1..87: mol_type = other DNA
ygggagggtggyggaaggtggtgtatygtagygtggttttygtygttgtygtygyggttttgtaaagtgttagygggggygaaagyg

SEQ ID NO: 1983 - DNA, 62 bp, synthetic construct
  misc_feature 1..62: note = Description of Artificial Sequence: Synthetic oligonucleotide
  source 1..62: mol_type = other DNA
ygatattgaataataatygyggggaggagaggttatttgtagtygaggttygtaaattgtyg

SEQ ID NO: 1984-1991 - skipped (8 entries)

SEQ ID NO: 1992 - DNA, 145 bp, synthetic construct
  misc_feature 1..145: note = Description of Artificial Sequence: Synthetic polynucleotide
  source 1..145: mol_type = other DNA
ygggaatygtaggagaggattggggttttaggtggayggtgttgattgtattggttttgaagattggaagtgggtgtaggaggaatttgygatagttgagattagggygygygggtagatgygttaggtygttagtaaatyggyg

SEQ ID NO: 1993 - skipped

SEQ ID NO: 1994 - DNA, 19 bp, synthetic construct
  misc_feature 1..19: note = Description of Artificial Sequence: Synthetic oligonucleotide
  source 1..19: mol_type = other DNA
yggtttttggyggtgggyg

SEQ ID NO: 1995 - DNA, 35 bp, synthetic construct
  misc_feature 1..35: note = Description of Artificial Sequence: Synthetic oligonucleotide
  source 1..35: mol_type = other DNA
yggaggtttygttaatggggtygtygtygtygtyg

SEQ ID NO: 1996-1997 - skipped (2 entries)

SEQ ID NO: 1998 - DNA, 36 bp, synthetic construct
  misc_feature 1..36: note = Description of Artificial Sequence: Synthetic oligonucleotide
  source 1..36: mol_type = other DNA
yggtttttttgtagttagyggattagygttagttyg

SEQ ID NO: 1999 - skipped

SEQ ID NO: 2000 - DNA, 42 bp, synthetic construct
  misc_feature 1..42: note = Description of Artificial Sequence: Synthetic oligonucleotide
  source 1..42: mol_type = other DNA
ygtataatggtaaatgggattaggtaggygaaggtttagtyg

SEQ ID NO: 2001-2002 - skipped (2 entries)

SEQ ID NO: 2003 - DNA, 18 bp, synthetic construct
  misc_feature 1..18: note = Description of Artificial Sequence: Synthetic oligonucleotide
  source 1..18: mol_type = other DNA
yggygygggygttgygyg

SEQ ID NO: 2004-2006 - skipped (3 entries)

SEQ ID NO: 2007 - DNA, 118 bp, synthetic construct
  misc_feature 1..118: note = Description of Artificial Sequence: Synthetic polynucleotide
  source 1..118: mol_type = other DNA
ygygtygttgttttgttttaggtttyggtgyggttttaagttttagtttagggtttttaggtttttttaggyggyggtggyggtatttatttgggtygyggagtyggggtttggtayg

SEQ ID NO: 2008 - DNA, 22 bp, synthetic construct
  misc_feature 1..22: note = Description of Artificial Sequence: Synthetic oligonucleotide
  source 1..22: mol_type = other DNA
ygttygygtygttygyggttyg

SEQ ID NO: 2009-2012 - skipped (4 entries)

SEQ ID NO: 2013 - DNA, 31 bp, synthetic construct
  misc_feature 1..31: note = Description of Artificial Sequence: Synthetic oligonucleotide
  source 1..31: mol_type = other DNA
ygtaatatattttagtatygagtttttgtyg

SEQ ID NO: 2014-2022 - skipped (9 entries)

SEQ ID NO: 2023 - DNA, 69 bp, synthetic construct
  misc_feature 1..69: note = Description of Artificial Sequence: Synthetic oligonucleotide
  source 1..69: mol_type = other DNA
ygtttttyggttygtttttttygagygtygtygataygttagttaaayggtygttggtygtttttagyg

SEQ ID NO: 2024 - DNA, 415 bp, synthetic construct
  misc_feature 1..415: note = Description of Artificial Sequence: Synthetic polynucleotide
  source 1..415: mol_type = other DNA
ygtaygggttgggtttgggaatggggatygygaggttttagtatttygatgttttgaaagttttttygtttyggggatttgtttttgtgttgtagttggtaggggtygtttgaagtgggagtagygtttggagaaggygggaggagttyggttygggggaygggyggygggatagygggatttyggyggygyggtgygttttagggygtagyggyggtygtagatygagtttygggygyggtaagaggyggygggagtyggtggyggttyggtattatgygtygagggygtttgttggagatygttttgggatttatygtgtttttagygttttataygagttatggggyggaygttaatttggaggttgggaaygtgaaggaaattagagttagtygggttaagagaagaggyg

SEQ ID NO: 2025-2029 - skipped (5 entries)

SEQ ID NO: 2030 - DNA, 62 bp, synthetic construct
  misc_feature 1..62: note = Description of Artificial Sequence: Synthetic oligonucleotide
  source 1..62: mol_type = other DNA
ygtgygtattttaagygygtgygggagtgtgygaggygttgtgygagttagyggygggygyg

SEQ ID NO: 2031-2034 - skipped (4 entries)

SEQ ID NO: 2035 - DNA, 20 bp, synthetic construct
  misc_feature 1..20: note = Description of Artificial Sequence: Synthetic oligonucleotide
  source 1..20: mol_type = other DNA
yggaggtttttgygtttgyg

SEQ ID NO: 2036 - DNA, 69 bp, synthetic construct
  misc_feature 1..69: note = Description of Artificial Sequence: Synthetic oligonucleotide
  source 1..69: mol_type = other DNA
ygttgygttttttygtttgttggygtttttgttttagygggattyggtagttaggggttttagggggyg

SEQ ID NO: 2037 - skipped

SEQ ID NO: 2038 - DNA, 318 bp, synthetic construct
  misc_feature 1..318: note = Description of Artificial Sequence: Synthetic polynucleotide
  source 1..318: mol_type = other DNA
ygagaygyggtagatttttagagyggtttatttatttatygaagyggattttgggyggtttygggttgattygygttgttagggygyggattttatttygggygtattgttaggagaaggggtttttyggggyggygygtttygattttgggttttyggtgttygtagagggyggagattygyggygttttaggttatttattygtattttttygagttaaatttttagygtttattyggattygayggtttaagtattgatttttaggtaagagtygttttttttggtttttagggaattgatattatygygggayg

SEQ ID NO: 2039 - DNA, 27 bp, synthetic construct
  misc_feature 1..27: note = Description of Artificial Sequence: Synthetic oligonucleotide
  source 1..27: mol_type = other DNA
ygygttttygttyggggagttattayg

SEQ ID NO: 2040 - skipped

SEQ ID NO: 2041 - DNA, 13 bp, synthetic construct
  misc_feature 1..13: note = Description of Artificial Sequence: Synthetic oligonucleotide
  source 1..13: mol_type = other DNA
ygyggggagttyg

SEQ ID NO: 2042 - DNA, 189 bp, synthetic construct
  misc_feature 1..189: note = Description of Artificial Sequence: Synthetic polynucleotide
  source 1..189: mol_type = other DNA
ygtaatttttagttaaagttatygygggyggattatggtttagggygttagaggggttagaggtaygggaagaggaaaagayggttaattgggaaaaaaagagaaaaygaaagaaaagttaaaygatgagtttttataaggaggayggagtgaatagtttgtgttagaaggttttgtatatygttatyg

SEQ ID NO: 2043-2044 - skipped (2 entries)

SEQ ID NO: 2045 - DNA, 13 bp, synthetic construct
  misc_feature 1..13: note = Description of Artificial Sequence: Synthetic oligonucleotide
  source 1..13: mol_type = other DNA
ygtttagttttyg

SEQ ID NO: 2046 - DNA, 51 bp, synthetic construct
  misc_feature 1..51: note = Description of Artificial Sequence: Synthetic oligonucleotide
  source 1..51: mol_type = other DNA
ygaaggygaggtygtttagttygtattttattttaygtayggtataygtyg

SEQ ID NO: 2047 - DNA, 289 bp, synthetic construct
  misc_feature 1..289: note = Description of Artificial Sequence: Synthetic polynucleotide
  source 1..289: mol_type = other DNA
yggtagtgtttttttaagaaggggtaaaaaaatttgtttatggttatttttttttygttttattttttttttttttgatagtttyggttttggttgttygagtygggggtgtgttttyggttttttttagatttgggyggggggygggaggagtgagygatttgggaagtttygggggtggagagggggygtttyggggtttgggggygaygtggatattttttttggagtayggyggtgygtttgggatttgaaggaagggtygaaggaagyggggtgygggygggyg

SEQ ID NO: 2048 - skipped

SEQ ID NO: 2049 - DNA, 165 bp, synthetic construct
  misc_feature 1..165: note = Description of Artificial Sequence: Synthetic polynucleotide
  source 1..165: mol_type = other DNA
ygttttgggaagygtagaggygggggtgttgttygygttggggagtaygtgaggggatatttagggattgttygygygaatggtttttaaygtatgygttttattttatattttatagtygttatgaygatygggaggttygtaayggttgyggggataagttyg

SEQ ID NO: 2050 - DNA, 21 bp, synthetic construct
  misc_feature 1..21: note = Description of Artificial Sequence: Synthetic oligonucleotide
  source 1..21: mol_type = other DNA
ygaagtggtgtaggggyggyg

SEQ ID NO: 2051-2053 - skipped (3 entries)

SEQ ID NO: 2054 - DNA, 159 bp, synthetic construct
  misc_feature 1..159: note = Description of Artificial Sequence: Synthetic polynucleotide
  source 1..159: mol_type = other DNA
ygtgttygtggatgygtagygttaygyggttgtttattatttagygatataygyggtttayggagaaggtgaggtygtagygggtygatttgtygyggtttaggyggtygtygtyggygttgtttatgttgtagagggatagtgyggttagygtagtyg

SEQ ID NO: 2055 - skipped

SEQ ID NO: 2056 - DNA, 129 bp, synthetic construct
  misc_feature 1..129: note = Description of Artificial Sequence: Synthetic polynucleotide
  source 1..129: mol_type = other DNA
ygtgygttygagtggggtatttgttygaggtyggggattgtgaatygaaagattttatttagttttgttgtttttttggtattgygatttgggggygggttattttatttttttgaatttygtttttyg

SEQ ID NO: 2057 - skipped

SEQ ID NO: 2058 - DNA, 120 bp, synthetic construct
  misc_feature 1..120: note = Description of Artificial Sequence: Synthetic polynucleotide
  source 1..120: mol_type = other DNA
ygttttttttttttttttttttttttttttttttttttttttttttttttttttttggtattatagagttgttttgaaaatagaagatagagggagtttyggagttygttatttttagyg

SEQ ID NO: 2059 - skipped

SEQ ID NO: 2060 - DNA, 171 bp, synthetic construct
  misc_feature 1..171: note = Description of Artificial Sequence: Synthetic polynucleotide
  source 1..171: mol_type = other DNA
ygttyggttgttgtatttgttagtgttgggtttaggttgagaggygatttttagtttttataataatgtttygggttttttggtttgggttttygtagygttygattgatygttagygataygaygagaaygaggatttgtyggaygtggaggagatygttagygttygyg

SEQ ID NO: 2061-2063 - skipped (3 entries)

SEQ ID NO: 2064 - DNA, 64 bp, synthetic construct
  misc_feature 1..64: note = Description of Artificial Sequence: Synthetic oligonucleotide
  source 1..64: mol_type = other DNA
yggggaaagttgggygygygagtygaggttgttgtttatttgtagtygygtygtttatttgtyg

SEQ ID NO: 2065-2068 - skipped (4 entries)

SEQ ID NO: 2069 - DNA, 16 bp, synthetic construct
  misc_feature 1..16: note = Description of Artificial Sequence: Synthetic oligonucleotide
  source 1..16: mol_type = other DNA
ygagttttgyggagyg

SEQ ID NO: 2070-2072 - skipped (3 entries)

SEQ ID NO: 2073 - DNA, 18 bp, synthetic construct
  misc_feature 1..18: note = Description of Artificial Sequence: Synthetic oligonucleotide
  source 1..18: mol_type = other DNA
ygyggtygagggaatgyg

SEQ ID NO: 2074 - DNA, 118 bp, synthetic construct
  misc_feature 1..118: note = Description of Artificial Sequence: Synthetic polynucleotide
  source 1..118: mol_type = other DNA
ygygtttttgtttttgggtagatttttttatttgtgtattttggtttttttatttagtaaagagatgtgygaagtgtgygtttggagaygagtygtttyggtgatttttattygttyg

SEQ ID NO: 2075-2079 - skipped (5 entries)

SEQ ID NO: 2080 - DNA, 22 bp, synthetic construct
  misc_feature 1..22: note = Description of Artificial Sequence: Synthetic oligonucleotide
  source 1..22: mol_type = other DNA
yggatttttttggggyggygyg

SEQ ID NO: 2081 - DNA, 112 bp, synthetic construct
  misc_feature 1..112: note = Description of Artificial Sequence: Synthetic polynucleotide
  source 1..112: mol_type = other DNA
ygaggtagggaggygttttygtagtttttgattttataattygygygygtgtgtatygagtygygggtatatygygaatatatatatatatatatatattygtgygttttyg

SEQ ID NO: 2082 - DNA, 109 bp, synthetic construct
  misc_feature 1..109: note = Description of Artificial Sequence: Synthetic polynucleotide
  source 1..109: mol_type = other DNA
ygtggaggagtggggttaggtggttattattagtatgtttattygttaygttygtaygtagtttttgagttttatttagaaygtaagtgggtttagtttaggtagagyg

SEQ ID NO: 2083-2085 - skipped (3 entries)

SEQ ID NO: 2086 - DNA, 431 bp, synthetic construct
  misc_feature 1..431: note = Description of Artificial Sequence: Synthetic polynucleotide
  source 1..431: mol_type = other DNA
ygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttyg

SEQ ID NO: 2087 - skipped

SEQ ID NO: 2088 - DNA, 40 bp, synthetic construct
  misc_feature 1..40: note = Description of Artificial Sequence: Synthetic oligonucleotide
  source 1..40: mol_type = other DNA
ygtttttatttttttagyggagttatagyggggygyggyg

SEQ ID NO: 2089 - skipped

SEQ ID NO: 2090 - DNA, 22 bp, synthetic construct
  misc_feature 1..22: note = Description of Artificial Sequence: Synthetic oligonucleotide
  source 1..22: mol_type = other DNA
ygtggttttgaatttgttggyg

SEQ ID NO: 2091 - skipped

SEQ ID NO: 2092 - DNA, 47 bp, synthetic construct
  misc_feature 1..47: note = Description of Artificial Sequence: Synthetic oligonucleotide
  source 1..47: mol_type = other DNA
ygagttggagaattatagtatgtattgygtgtaatgtaagatgttyg

SEQ ID NO: 2093 - DNA, 24 bp, synthetic construct
  misc_feature 1..24: note = Description of Artificial Sequence: Synthetic oligonucleotide
  source 1..24: mol_type = other DNA
ygtgttagaagttttttaayggyg

SEQ ID NO: 2094 - skipped

SEQ ID NO: 2095 - DNA, 45 bp, synthetic construct
  misc_feature 1..45: note = Description of Artificial Sequence: Synthetic oligonucleotide
  source 1..45: mol_type = other DNA
ygagggttttagttaattagtttgttgggtgggtttggagtttyg

SEQ ID NO: 2096 - skipped

SEQ ID NO: 2097 - DNA, 258 bp, synthetic construct
  misc_feature 1..258: note = Description of Artificial Sequence: Synthetic polynucleotide
  source 1..258: mol_type = other DNA
ygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttyg

SEQ ID NO: 2098 - DNA, 45 bp, synthetic construct
  misc_feature 1..45: note = Description of Artificial Sequence: Synthetic oligonucleotide
  source 1..45: mol_type = other DNA
ygygatygtaagttygagtttaggtttttyggagtygttagggyg

SEQ ID NO: 2099-2100 - skipped (2 entries)

SEQ ID NO: 2101 - DNA, 67 bp, synthetic construct
  misc_feature 1..67: note = Description of Artificial Sequence: Synthetic oligonucleotide
  source 1..67: mol_type = other DNA
ygaggtygtttygttggttggtgtaagaattagtttgtaatttaagttttgagttgttggygtttyg

SEQ ID NO: 2102 - DNA, 43 bp, synthetic construct
  misc_feature 1..43: note = Description of Artificial Sequence: Synthetic oligonucleotide
  source 1..43: mol_type = other DNA
ygttygagttttygttgttgtygttgtygttgygggttagtyg

SEQ ID NO: 2103-2104 - skipped (2 entries)

SEQ ID NO: 2105 - DNA, 113 bp, synthetic construct
  misc_feature 1..113: note = Description of Artificial Sequence: Synthetic polynucleotide
  source 1..113: mol_type = other DNA
ygttygagattygggagagattaggggttygtaaagtagaagagtagatttagaaagaaaaaaaaaaaagygagaagtgygagaaaaatatattgaatttagttaaatatayg

SEQ ID NO: 2106-2107 - skipped (2 entries)

SEQ ID NO: 2108 - DNA, 84 bp, synthetic construct
  misc_feature 1..84: note = Description of Artificial Sequence: Synthetic oligonucleotide
  source 1..84: mol_type = other DNA
ygggttttggggygttggtgttygygtagttttagtygttttygtagttatygtygttyggtttygyggaggyggygygtagyg

SEQ ID NO: 2109 - skipped

SEQ ID NO: 2110 - DNA, 48 bp, synthetic construct
  misc_feature 1..48: note = Description of Artificial Sequence: Synthetic oligonucleotide
  source 1..48: mol_type = other DNA
ygtaggttaagatttggttttagaattatygttataagatgaagygyg

SEQ ID NO: 2111 - DNA, 228 bp, synthetic construct
  misc_feature 1..228: note = Description of Artificial Sequence: Synthetic polynucleotide
  source 1..228: mol_type = other DNA
ygtygttattaygtygygygtygtatttygygttaagaatggggyggttaagttgtttaagtygttygtygtygtygtygtygtygyggtygaggygttyggygtyggygygggtatggagygttygtagagtygttttagtttgttygtttttttygaggygttygttatttatttttygtgtatgaattttttygaygaygaggaygtaggtaagygygyggttyg

SEQ ID NO: 2112 - DNA, 47 bp, synthetic construct
  misc_feature 1..47: note = Description of Artificial Sequence: Synthetic oligonucleotide
  source 1..47: mol_type = other DNA
ygttggtgygtggyggygtggagygygtttgttayggttaaggtgyg

SEQ ID NO: 2113 - DNA, 185 bp, synthetic construct
  misc_feature 1..185: note = Description of Artificial Sequence: Synthetic polynucleotide
  source 1..185: mol_type = other DNA
ygtygtttttyggtttagagtttttattttyggtttgtgagtttgyggygttggtggagttyggttttaggaagaggagtttattyggttttttttgattggatagtagygaggttttatygggygttttygyggtttaaaatygaagygggggygagggggaggtagagttygttttttgygyg

SEQ ID NO: 2114 - DNA, 216 bp, synthetic construct
  misc_feature 1..216: note = Description of Artificial Sequence: Synthetic polynucleotide
  source 1..216: mol_type = other DNA
yggygttttatttattggygtttayggttygtaggtaaagygtggaaggagttgaaygyggyggagaagyggtttttygtggaggaagtygaayggttgygygtgtagtatttgygygattattttaattataagtatyggtygygtygtaagaagtaggygygtaaggttyggyggttggagttyggttttttgttttygggattagygttttyg

SEQ ID NO: 2115 - DNA, 344 bp, synthetic construct
  misc_feature 1..344: note = Description of Artificial Sequence: Synthetic polynucleotide
  source 1..344: mol_type = other DNA
ygaataatagaaattgttaattttaataatttagagtaggttaaygaggttttgttttttygattygaattaaaggtttttygtttygtgygttgttaygagyggtgttttttggggttttaatgtagygagttgtgttygaggggttyggaaggygtaagttgggtagygatatggggaaygyggagygggtttyggggtttyggagttttgggttagtatttaygttgttgttgttygtygyggygttattggtygtgtyggaygtattygggygttttttygaggaggaygaggagttagtggtgtyggagttggagygygtttygggataygggattayg

SEQ ID NO: 2116 - DNA, 28 bp, synthetic construct
  misc_feature 1..28: note = Description of Artificial Sequence: Synthetic oligonucleotide
  source 1..28: mol_type = other DNA
ygtttyggtttggttgttaaatagaayg

SEQ ID NO: 2117 - DNA, 124 bp, synthetic construct
  misc_feature 1..124: note = Description of Artificial Sequence: Synthetic polynucleotide
  source 1..124: mol_type = other DNA
yggygygtayggttaaggtaygygygttggtataygygggygyggataygygyggatatataygtgygggataygttttttttygayggyggygttaatttttyggtaagtttagygttttayg

SEQ ID NO: 2118 - DNA, 80 bp, synthetic construct
  misc_feature 1..80: note = Description of Artificial Sequence: Synthetic oligonucleotide
  source 1..80: mol_type = other DNA
ygaggtgtaggyggygygggygtttatygtgagygtygtgttgttggygttygttgygtttttygtgattttggygggyg

SEQ ID NO: 2119 - DNA, 62 bp, synthetic construct
  misc_feature 1..62: note = Description of Artificial Sequence: Synthetic oligonucleotide
  source 1..62: mol_type = other DNA
ygaggygtggaggggtagtygyggyggggygatttttatttgtttattgyggggtttgttyg

SEQ ID NO: 2120 - DNA, 165 bp, synthetic construct
  misc_feature 1..165: note = Description of Artificial Sequence: Synthetic polynucleotide
  source 1..165: mol_type = other DNA
ygttatttgatttygttattaagtttaaggtgttttggatttayggtaagtatagygtygttgtagttggtygtgygtttttattatygtygttaggtttygaggtygygtttagttttagtaagaggaaayggaygtttagygataaatyggygtatayggtyg

SEQ ID NO: 2121 - DNA, 43 bp, synthetic construct
  misc_feature 1..43: note = Description of Artificial Sequence: Synthetic oligonucleotide
  source 1..43: mol_type = other DNA
ygygtttygaggaagygtyggaattattagaagtatagggayg

SEQ ID NO: 2122 - DNA, 86 bp, synthetic construct
  misc_feature 1..86: note = Description of Artificial Sequence: Synthetic oligonucleotide
  source 1..86: mol_type = other DNA
ygttatttttaattagttgtaagtygagttgtttatttgggatygggtyggttyggygggtttggttttyggygaaggyggyggyg

SEQ ID NO: 2123 - DNA, 23 bp, synthetic construct
  misc_feature 1..23: note = Description of Artificial Sequence: Synthetic oligonucleotide
  source 1..23: mol_type = other DNA
ygtttttttattttaygggttyg

SEQ ID NO: 2124 - skipped

SEQ ID NO: 2125 - DNA, 99 bp, synthetic construct
  misc_feature 1..99: note = Description of Artificial Sequence: Synthetic oligonucleotide
  source 1..99: mol_type = other DNA
yggtaggagtagtttatagttaggagygttttttygtttttaaygtygygtttttttttttaaaayggtttaaaaaaatttattaattgtatggtygyg

SEQ ID NO: 2126 - DNA, 73 bp, synthetic construct
  misc_feature 1..73: note = Description of Artificial Sequence: Synthetic oligonucleotide
  source 1..73: mol_type = other DNA
ygattatttttgtgtttttaggagtttattttgggyggtagggaggygttgygtggggtttaygagttttayg

SEQ ID NO: 2127 - skipped

SEQ ID NO: 2128 - DNA, 52 bp, synthetic construct
  misc_feature 1..52: note = Description of Artificial Sequence: Synthetic oligonucleotide
  source 1..52: mol_type = other DNA
ygtttttaggattttygttygtttttttttgattyggtttttgttygtttyg

SEQ ID NO: 2129 - DNA, 50 bp, synthetic construct
  misc_feature 1..50: note = Description of Artificial Sequence: Synthetic oligonucleotide
  source 1..50: mol_type = other DNA
ygtagtygtygygttygtatttgattatggagtgygtttttttgttygyg

SEQ ID NO: 2130 - DNA, 50 bp, synthetic construct
  misc_feature 1..50: note = Description of Artificial Sequence: Synthetic oligonucleotide
  source 1..50: mol_type = other DNA
ygaaygtagagtttataygtggattttygygtttgtgatgtttygattyg

SEQ ID NO: 2131-2132 - skipped (2 entries)

SEQ ID NO: 2133 - DNA, 52 bp, synthetic construct
  misc_feature 1..52: note = Description of Artificial Sequence: Synthetic oligonucleotide
  source 1..52: mol_type = other DNA
ygtttggggtttaygygagtygygagtttttgtttgtttttgygttatttyg

SEQ ID NO: 2134-2136 - skipped (3 entries)

SEQ ID NO: 2137 - DNA, 138 bp, synthetic construct
  misc_feature 1..138: note = Description of Artificial Sequence: Synthetic polynucleotide
  source 1..138: mol_type = other DNA
ygyggygtttttagttgttttttattygtttygttygttagtttttttttygygygatggtttyggygttgagttatgtttttaagtttaagtttttygtgattttgttygttatttygtttttgttgttgttattyg

SEQ ID NO: 2138-2140 - skipped (3 entries)

SEQ ID NO: 2141 - DNA, 1017 bp, synthetic construct
  misc_feature 1..1017: note = Description of Artificial Sequence: Synthetic polynucleotide
  source 1..1017: mol_type = other DNA
cgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcg

SEQ ID NO: 2142 - DNA, 166 bp, synthetic construct
  misc_feature 1..166: note = Description of Artificial Sequence: Synthetic polynucleotide
  source 1..166: mol_type = other DNA
cgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcg

SEQ ID NO: 2143-2148 - skipped (6 entries)

SEQ ID NO: 2149 - DNA, 14 bp, synthetic construct
  misc_feature 1..14: note = Description of Artificial Sequence: Synthetic oligonucleotide
  source 1..14: mol_type = other DNA
cgcgttgagacgcg

SEQ ID NO: 2150-2152 - skipped (3 entries)

SEQ ID NO: 2153 - DNA, 125 bp, synthetic construct
  misc_feature 1..125: note = Description of Artificial Sequence: Synthetic polynucleotide
  source 1..125: mol_type = other DNA
cgtttcgcgttttcgtttcgttatgtttttgttgttggggttgtgtttggggttgtttttgtgtgtggggtcgtaggaagaggcgtagagttggggttatttttcggagtaggtaagtggagtcg

SEQ ID NO: 2154 - skipped

SEQ ID NO: 2155 - DNA, 131 bp, synthetic construct
  misc_feature 1..131: note = Description of Artificial Sequence: Synthetic polynucleotide
  source 1..131: mol_type = other DNA
cgtgcgtagtttagtttttttcggacgttttcgttttcgttcgggtatatcgtgtttcgtatcgaggtagagaggggtacgcggattttagtttttgcgagtttttttgttcgtcgttattttatatttcg

SEQ ID NO: 2156 - DNA, 94 bp, synthetic construct
  misc_feature 1..94: note = Description of Artificial Sequence: Synthetic oligonucleotide
  source 1..94: mol_type = other DNA
cgggtcgcgtgggtttgggcgcgtcgtggtgggtaagcggggttagcggagcgggaattcgtatatttttcgagcggagtcgaggataggttcg

SEQ ID NO: 2157-2158 - skipped (2 entries)

SEQ ID NO: 2159 - DNA, 27 bp, synthetic construct
  misc_feature 1..27: note = Description of Artificial Sequence: Synthetic oligonucleotide
  source 1..27: mol_type = other DNA
cgcgtaagtatttttttttttatcgcg

SEQ ID NO: 2160 - DNA, 164 bp, synthetic construct
  misc_feature 1..164: note = Description of Artificial Sequence: Synthetic polynucleotide
  source 1..164: mol_type = other DNA
cgcgatttttttcgggaggtgtttgcgaaggcggttttgtcgcggtgggggtggggaggttagggtttcggatcgttggagttggggtcgtagttagtttttggcgagtgttttttggttgttgtcgtaggggtttgttttttcggattttttttttaatttcg

SEQ ID NO: 2161-2162 - skipped (2 entries)

SEQ ID NO: 2163 - DNA, 68 bp, synthetic construct
  misc_feature 1..68: note = Description of Artificial Sequence: Synthetic oligonucleotide
  source 1..68: mol_type = other DNA
cgtatttgaaaatttcgtcgtagttattttttttttatgggaaagtttcgatttcggcgggtttagcg

SEQ ID NO: 2164 - DNA, 508 bp, synthetic construct
  misc_feature 1..508: note = Description of Artificial Sequence: Synthetic polynucleotide
  source 1..508: mol_type = other DNA
cgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcg

SEQ ID NO: 2165-2174 - skipped (10 entries)

SEQ ID NO: 2175 - DNA, 396 bp, synthetic construct
  misc_feature 1..396: note = Description of Artificial Sequence: Synthetic polynucleotide
  source 1..396: mol_type = other DNA
cgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttg

SEQ ID NO: 2176 - skipped

SEQ ID NO: 2177 - DNA, 70 bp, synthetic construct
  misc_feature 1..70: note = Description of Artificial Sequence: Synthetic oligonucleotide
  source 1..70: mol_type = other DNA
cgtgatttttttatttagagattatttagggagatgttttggatgggataagtagataaatggcggttcg

SEQ ID NO: 2178 - skipped

SEQ ID NO: 2179 - DNA, 68 bp, synthetic construct
  misc_feature 1..68: note = Description of Artificial Sequence: Synthetic oligonucleotide
  source 1..68: mol_type = other DNA
cgggagttcggtcgcgttttttagtttcggtattcgcgtttagcgcgtcgcgtttcgcgtttttcgcg

SEQ ID NO: 2180 - DNA, 88 bp, synthetic construct
  misc_feature 1..88: note = Description of Artificial Sequence: Synthetic oligonucleotide
  source 1..88: mol_type = other DNA
cgtttcgcgtatcgttttcgttttagtttttagtggcgcggcgttttttcgcgatattcgcgggtttttaggagcgagtcgattttcg

SEQ ID NO: 2181-2182 - skipped (2 entries)

SEQ ID NO: 2183 - DNA, 87 bp, synthetic construct
  misc_feature 1..87: note = Description of Artificial Sequence: Synthetic oligonucleotide
  source 1..87: mol_type = other DNA
cgggggttttttaggtcgcggcgtttttcgtttttttttatttttcgattttttttcgtttttaaaatgaggaaacggagtaattcg

SEQ ID NO: 2184 - DNA, 45 bp, synthetic construct
  misc_feature 1..45: note = Description of Artificial Sequence: Synthetic oligonucleotide
  source 1..45: mol_type = other DNA
cgtggtaaattcgggtttcgacgatagaggtagcgtagaagttcg

SEQ ID NO: 2185 - skipped

SEQ ID NO: 2186 - DNA, 173 bp, synthetic construct
  misc_feature 1..173: note = Description of Artificial Sequence: Synthetic polynucleotide
  source 1..173: mol_type = other DNA
cgggtcgtggttgatatcgcggagaagttaggatttttatagtttttgttagatttgaaagtaagttggaaatcgatagttgttttagttgttttagattttaatttggtttgggttttttttttttttatttgaaaatagatttagggtaatgtttaagagaattttaatcg

SEQ ID NO: 2187 - skipped

SEQ ID NO: 2188 - DNA, 48 bp, synthetic construct
  misc_feature 1..48: note = Description of Artificial Sequence: Synthetic oligonucleotide
  source 1..48: mol_type = other DNA
cggggtttttgtttttggttgtagttggagttttgcgtttcgttttcg

SEQ ID NO: 2189-2190 - skipped (2 entries)

SEQ ID NO: 2191 - DNA, 36 bp, synthetic construct
  misc_feature 1..36: note = Description of Artificial Sequence: Synthetic oligonucleotide
  source 1..36: mol_type = other DNA
cggggtagagggggcgggaagttggcgttacggtcg

SEQ ID NO: 2192-2196 - skipped (5 entries)

SEQ ID NO: 2197 - DNA, 97 bp, synthetic construct
  misc_feature 1..97: note = Description of Artificial Sequence: Synthetic oligonucleotide
  source 1..97: mol_type = other DNA
cgattcgggagggaaaatttttgttttttttcggggtttgttttgttcgttttttaaattcgttttatatttttttcgattttcgtttttgtaagcg

SEQ ID NO: 2198-2199 - skipped (2 entries)

SEQ ID NO: 2200 - DNA, 67 bp, synthetic construct
  misc_feature 1..67: note = Description of Artificial Sequence: Synthetic oligonucleotide
  source 1..67: mol_type = other DNA
cgatgtttgtgtttgtggttttttgaggtagtgggagtggcgtgtgaaggattgtgagagtttggcg

SEQ ID NO: 2201 - skipped

SEQ ID NO: 2202 - DNA, 29 bp, synthetic construct
  misc_feature 1..29: note = Description of Artificial Sequence: Synthetic oligonucleotide
  source 1..29: mol_type = other DNA
cgggtgattgttgattttttgttttgtcg

SEQ ID NO: 2203 - DNA, 49 bp, synthetic construct
  misc_feature 1..49: note = Description of Artificial Sequence: Synthetic oligonucleotide
  source 1..49: mol_type = other DNA
cgaggtttcgcgtattttcgttcgcgttttagttatttaggttcggtcg

SEQ ID NO: 2204 - DNA, 188 bp, synthetic construct
  misc_feature 1..188: note = Description of Artificial Sequence: Synthetic polynucleotide
  source 1..188: mol_type = other DNA
cgtttattgaaaatttttagttggtgttggagcggcggcgtgtggttaacgttaaggagcgtgagcgggtgagggatttttagggtcgacgttcgttttttttttttttgttttattattaaatatttggttaatattcgggggttcgtttatcgtttattttcgttcgaggcgatttcgagttttcg

SEQ ID NO: 2205-2206 - skipped (2 entries)

SEQ ID NO: 2207 - DNA, 113 bp, synthetic construct
  misc_feature 1..113: note = Description of Artificial Sequence: Synthetic polynucleotide
  source 1..113: mol_type = other DNA
cgcgggtgaaggcggagtcgtagggttggtttttaaagggatgttttcgttcgagcggcgagattagtttcgttcgtttttcgtcgcggtcgcgtcgtagtcgtttacggtcg

SEQ ID NO: 2208 - DNA, 208 bp, synthetic construct
  misc_feature 1..208: note = Description of Artificial Sequence: Synthetic polynucleotide
  source 1..208: mol_type = other DNA
cgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcg

SEQ ID NO: 2209 - DNA, 96 bp, synthetic construct
  misc_feature 1..96: note = Description of Artificial Sequence: Synthetic oligonucleotide
  source 1..96: mol_type = other DNA
cgtattttttcgtattcggcgtcgtcgtttcgtcgttttttttcgtttgtagggtcgtttcgggtattttagggttgttgaggggcgggcgggtcg

SEQ ID NO: 2210 - DNA, 236 bp, synthetic construct
  misc_feature 1..236: note = Description of Artificial Sequence: Synthetic polynucleotide
  source 1..236: mol_type = other DNA
cgcgtggaggttgcgcgtaggggttcgggacgcgggatagggatttcgcgtagtttaggcgtcggggaatcggggttggagtcggggatttgagtttagcggacgtttttttcgtttggaggttcggtacggatcgggatattagggcgttcgtggtcgtggttcggtttttggttgttgcgggtcgcggtttttagtgggtttttaggatttttttttacggcgggtatttatcg

SEQ ID NO: 2211 - DNA, 211 bp, synthetic construct
  misc_feature 1..211: note = Description of Artificial Sequence: Synthetic polynucleotide
  source 1..211: mol_type = other DNA
cgtcgttcgcgttttttgttttttattttttaatttttgcgtggttttagggtttatatttttggagtttttttttttagtaaatagtgttgttttttatttaatagtagaggcgtttaggagtttaggcgatgtgtttaaggtcgaatagagggatagtagtgagttgtttaatttttttagttgcgtagttaggatacggttgggggcg

SEQ ID NO: 2212 - DNA, 193 bp, synthetic construct
  misc_feature 1..193: note = Description of Artificial Sequence: Synthetic polynucleotide
  source 1..193: mol_type = other DNA
cgcgggggattttaggtcgggacggagttttttttggttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcg

SEQ ID NO: 2213 - skipped

SEQ ID NO: 2214 - DNA, 199 bp, synthetic construct
  misc_feature 1..199: note = Description of Artificial Sequence: Synthetic polynucleotide
  source 1..199: mol_type = other DNA
cgtaataaattttcgtagatatcgtatttttaatgcggtgtttttttgtgttagtgtttcggcggtttttgtagggtgttaatgttacggttgtatatcgttttttttttttattatttttatttgaatagatttggaggaggcggaaatggaaattagggtatgtttataagttggattcgttagatttttttgttcg

SEQ ID NO: 2215 - DNA, 87 bp, synthetic construct
  misc_feature 1..87: note = Description of Artificial Sequence: Synthetic oligonucleotide
  source 1..87: mol_type = other DNA
cgcggtcgttacgtttcgttttttgtatttagtttttttggcgttttcgttgtagtatttaagattaggcgtcgtttttgttagtcg

SEQ ID NO: 2216 - DNA, 68 bp, synthetic construct
  misc_feature 1..68: note = Description of Artificial Sequence: Synthetic oligonucleotide
  source 1..68: mol_type = other DNA
cgtaaattgattatgaaatatacgatgttaattcggagttgtattttttagttgggtattttcgcgcg

SEQ ID NO: 2217 - DNA, 61 bp, synthetic construct
  misc_feature 1..61: note = Description of Artificial Sequence: Synthetic oligonucleotide
  source 1..61: mol_type = other DNA
cggtgaaaattagtttgtggtgtattgagatttgtaaattattttttgaatgttaggggcg

SEQ ID NO: 2218 - DNA, 40 bp, synthetic construct
  misc_feature 1..40: note = Description of Artificial Sequence: Synthetic oligonucleotide
  source 1..40: mol_type = other DNA
cggatcggcggtagtagaagcggtagcggtaaagtattcg

SEQ ID NO: 2219 - DNA, 647 bp, synthetic construct
  misc_feature 1..647: note = Description of Artificial Sequence: Synthetic polynucleotide
  source 1..647: mol_type = other DNA
cggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcg

SEQ ID NO: 2220 - DNA, 327 bp, synthetic construct
  misc_feature 1..327: note = Description of Artificial Sequence: Synthetic polynucleotide
  source 1..327: mol_type = other DNA
cgaggcgcgggttgagtttttagtatttggtttgagcggcgtgggtagtagtttgtatcgcggatatttttaattttgtcgcgtttgcgtcgtattttggtcgtggtagcgatttttcgggtatttttgaggtcgtttttagttttataagtatttagtcgtttattttagagtagcggcgtcgatcgttttaagaggagttagttttcgatatcgttttttatttatttttttatatttttatcgttggagggggtgagtgtcgtggataggcgttttcgttcggggatagtttagcggcggtagttagttcgattttttttcgcg

SEQ ID NO: 2221 - skipped

SEQ ID NO: 2222 - DNA, 324 bp, synthetic construct
  misc_feature 1..324: note = Description of Artificial Sequence: Synthetic polynucleotide
  source 1..324: mol_type = other DNA
cgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcg

SEQ ID NO: 2223 - DNA, 77 bp, synthetic construct
  misc_feature 1..77: note = Description of Artificial Sequence: Synthetic oligonucleotide
  source 1..77: mol_type = other DNA
cgtttcgtcgtgttcgatgggtgcgtttttagcgttgtcgtcgcggcgttcggtttcgggttttcgtcgttgcgtcg

SEQ ID NO: 2224 - DNA, 158 bp, synthetic construct
  misc_feature 1..158: note = Description of Artificial Sequence: Synthetic polynucleotide
  source 1..158: mol_type = other DNA
cgtttttatttcggtatagatagtttttaaagttgttcgtattttttagatttcgttttttgtttagttttcggatttcgtttaggggttgagttgacgttcgcgggtggatttttttggttcgttgcgtagggaattgatttcgggaatttagggcg

SEQ ID NO: 2225 - DNA, 79 bp, synthetic construct
  misc_feature 1..79: note = Description of Artificial Sequence: Synthetic oligonucleotide
  source 1..79: mol_type = other DNA
cgcgcgtttcgcgtttttggcggtcgtagcgttgtttattaattgatttttttattgatttatttaatttttaggagcg

SEQ ID NO: 2226 - DNA, 137 bp, synthetic construct
  misc_feature 1..137: note = Description of Artificial Sequence: Synthetic polynucleotide
  source 1..137: mol_type = other DNA
cgttttggagcggtgggaggacgcggagcgtcgttttttggttttcgatattttgttcgttttttttagtgggtttgtggttgcgttttttcgaaggaagtaataaatttttttgattttgggggttagaggagacg

SEQ ID NO: 2227 - DNA, 112 bp, synthetic construct
  misc_feature 1..112: note = Description of Artificial Sequence: Synthetic polynucleotide
  source 1..112: mol_type = other DNA
cgttgcggtatttagcggtttatcggggttgtattgttgtagcggttttttgtgttatttgtagtttaggaggttgagtatagtgagtattagtagtagtgtatagttcgcg

SEQ ID NO: 2228-2229 - skipped (2 entries)

SEQ ID NO: 2230 - DNA, 282 bp, synthetic construct
  misc_feature 1..282: note = Description of Artificial Sequence: Synthetic polynucleotide
  source 1..282: mol_type = other DNA
cggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacg

SEQ ID NO: 2231 - DNA, 81 bp, synthetic construct
  misc_feature 1..81: note = Description of Artificial Sequence: Synthetic oligonucleotide
  source 1..81: mol_type = other DNA
cggcgcggcggcggggggcgtttcgtaagttcgcggttttgagcggttattcgcgtagtaagttgggcgagttggtagtcg

SEQ ID NO: 2232 - DNA, 53 bp, synthetic construct
  misc_feature 1..53: note = Description of Artificial Sequence: Synthetic oligonucleotide
  source 1..53: mol_type = other DNA
cgcggtttttgttttttgcgttagcgtgagttcggttagggtttttacggtcg

SEQ ID NO: 2233 - DNA, 40 bp, synthetic construct
  misc_feature 1..40: note = Description of Artificial Sequence: Synthetic oligonucleotide
  source 1..40: mol_type = other DNA
cggcgttagtttacgttttcgttggcgttttttcggcgcg

SEQ ID NO: 2234 - DNA, 206 bp, synthetic construct
  misc_feature 1..206: note = Description of Artificial Sequence: Synthetic polynucleotide
  source 1..206: mol_type = other DNA
cggtcgatttatttggtgtcgcgtgcgttggcggttcgcgcggtagttaagttaaaggtcgaggtcgaggtcgagcgcggcgtttagtagtacggcgggggttagtagggcgggcgtcggtcgtagcgcgtttcgttttagtagtagtcgcgcgtcgtttttgtaggtcgtttcgtcgcgggttattcggggcgtttaggttgtcg

SEQ ID NO: 2235 - DNA, 38 bp, synthetic construct
  misc_feature 1..38: note = Description of Artificial Sequence: Synthetic oligonucleotide
  source 1..38: mol_type = other DNA
cgttgttgttgcgcggggcggcggtcgtcgtgttttcg

SEQ ID NO: 2236 - skipped

SEQ ID NO: 2237 - DNA, 25 bp, synthetic construct
  misc_feature 1..25: note = Description of Artificial Sequence: Synthetic oligonucleotide
  source 1..25: mol_type = other DNA
cgtgtgtacgcgttgtattcgttcg

SEQ ID NO: 2238 - DNA, 79 bp, synthetic construct
  misc_feature 1..79: note = Description of Artificial Sequence: Synthetic oligonucleotide
  source 1..79: mol_type = other DNA
cgttttttttttttttttttttttattaaatattatttgggaattgtttaaattttttttttaaaaaaagagagaggcg

SEQ ID NO: 2239 - DNA, 33 bp, synthetic construct
  misc_feature 1..33: note = Description of Artificial Sequence: Synthetic oligonucleotide
  source 1..33: mol_type = other DNA
cggtttcgcgtggcgtttcggtcgttgttttcg

SEQ ID NO: 2240 - DNA, 132 bp, synthetic construct
  misc_feature 1..132: note = Description of Artificial Sequence: Synthetic polynucleotide
  source 1..132: mol_type = other DNA
cggcgggcggcggcggcgcggagttgtatacggagaagacggagtgcgggcgttacggagagtattcgtttaagtaggacgttcgcggggaggtggttatggttagttcggtttacgatcgtttggtttgcg

SEQ ID NO: 2241 - DNA, 32 bp, synthetic construct
  misc_feature 1..32: note = Description of Artificial Sequence: Synthetic oligonucleotide
  source 1..32: mol_type = other DNA
cgtttggtatttttttttttgtttcgagggcg

SEQ ID NO: 2242-2243 - skipped (2 entries)

SEQ ID NO: 2244 - DNA, 20 bp, synthetic construct
  misc_feature 1..20: note = Description of Artificial Sequence: Synthetic oligonucleotide
  source 1..20: mol_type = other DNA
cgagtatgttagcggcgtcg

SEQ ID NO: 2245 - DNA, 85 bp, synthetic construct
  misc_feature 1..85: note = Description of Artificial Sequence: Synthetic oligonucleotide
  source 1..85: mol_type = other DNA
cggtacgttttttttttcggtcgtttttttttatataagcgtaggtagagggcgcgttagttatgttttgtttttgcgttcgtcg

SEQ ID NO: 2246 - DNA, 230 bp, synthetic construct
  misc_feature 1..230: note = Description of Artificial Sequence: Synthetic polynucleotide
  source 1..230: mol_type = other DNA
cggtttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcg

SEQ ID NO: 2247 - DNA, 84 bp, synthetic construct
  misc_feature 1..84: note = Description of Artificial Sequence: Synthetic oligonucleotide
  source 1..84: mol_type = other DNA
cgggtcgttagttttagggtgtcgggttttaattaaggtttcgaagtttttacgtatttgagggtattttgattagtttttgcg

SEQ ID NO: 2248 - DNA, 42 bp, synthetic construct
  misc_feature 1..42: note = Description of Artificial Sequence: Synthetic oligonucleotide
  source 1..42: mol_type = other DNA
cgcgatttttttttgatttagttaaacggaaaagttcgcgcg

SEQ ID NO: 2249 - DNA, 45 bp, synthetic construct
  misc_feature 1..45: note = Description of Artificial Sequence: Synthetic oligonucleotide
  source 1..45: mol_type = other DNA
cgtcgtgttttttttcgttttcgaaagggtagaaagagtcgttcg

SEQ ID NO: 2250 - DNA, 26 bp, synthetic construct
  misc_feature 1..26: note = Description of Artificial Sequence: Synthetic oligonucleotide
  source 1..26: mol_type = other DNA
cgttcgttagtattttttgtttcgcg

SEQ ID NO: 2251 - DNA, 50 bp, synthetic construct
  misc_feature 1..50: note = Description of Artificial Sequence: Synthetic oligonucleotide
  source 1..50: mol_type = other DNA
cgaggtttaggtggaggttgaggttgtcgcgcgtcgcgggaggagtttcg

SEQ ID NO: 2252 - DNA, 56 bp, synthetic construct
  misc_feature 1..56: note = Description of Artificial Sequence: Synthetic oligonucleotide
  source 1..56: mol_type = other DNA
cgtttttgagttagggacgcgcgtggggggtgggcgtgtacgcgggtgggttagcg

SEQ ID NO: 2253 - DNA, 44 bp, synthetic construct
  misc_feature 1..44: note = Description of Artificial Sequence: Synthetic oligonucleotide
  source 1..44: mol_type = other DNA
cgtttttatcgcgtacgcgtttttttcgcgcgcgtatacgttcg

SEQ ID NO: 2254-2255 - skipped (2 entries)

SEQ ID NO: 2256 - DNA, 58 bp, synthetic construct
  misc_feature 1..58: note = Description of Artificial Sequence: Synthetic oligonucleotide
  source 1..58: mol_type = other DNA
cgcggggtagttgtttaagtggatcgatattatcgtttgtttggcgggtaggcgggcg

SEQ ID NO: 2257 - DNA, 151 bp, synthetic construct
  misc_feature 1..151: note = Description of Artificial Sequence: Synthetic polynucleotide
  source 1..151: mol_type = other DNA
cggtagaagatagcgtttttaggattagcgattttgtggtttattcggttattgggtttcggcgtaaattttttttaggtagtgcgggcgatgttgattgtagacgtcgggtagggttttcgtgcgggcgggagcgggggaagttagtgcg

SEQ ID NO: 2258 - DNA, 17 bp, synthetic construct
  misc_feature 1..17: note = Description of Artificial Sequence: Synthetic oligonucleotide
  source 1..17: mol_type = other DNA
cggattttttaggatcg

SEQ ID NO: 2259 - DNA, 70 bp, synthetic construct
  misc_feature 1..70: note = Description of Artificial Sequence: Synthetic oligonucleotide
  source 1..70: mol_type = other DNA
cgttcgttgtttttcgttgcgtttagggatggagggttttattatttatggaattgttggtttttttgcg

SEQ ID NO: 2260 - DNA, 59 bp, synthetic construct
  misc_feature 1..59: note = Description of Artificial Sequence: Synthetic oligonucleotide
  source 1..59: mol_type = other DNA
cgtttttgagatttcgttgagaaatttttagcgggttagcgtttgggcgttgggcgtcg

SEQ ID NO: 2261 - DNA, 25 bp, synthetic construct
  misc_feature 1..25: note = Description of Artificial Sequence: Synthetic oligonucleotide
  source 1..25: mol_type = other DNA
cgttgggtaatttttattcgagtcg

SEQ ID NO: 2262 - DNA, 57 bp, synthetic construct
  misc_feature 1..57: note = Description of Artificial Sequence: Synthetic oligonucleotide
  source 1..57: mol_type = other DNA
cggcgttgacgttttggttttgggggttgtttggttggtgttaggtagcggaagacg

SEQ ID NO: 2263 - DNA, 111 bp, synthetic construct
  misc_feature 1..111: note = Description of Artificial Sequence: Synthetic polynucleotide
  source 1..111: mol_type = other DNA
cgagtagttttacgttttgttaaggacggtaggtgtaagggtcgggggattttttgacggggtcgttttttcgggtacggggaggtttttatcgagttttaattttgaacg

SEQ ID NO: 2264 - DNA, 211 bp, synthetic construct
  misc_feature 1..211: note = Description of Artificial Sequence: Synthetic polynucleotide
  source 1..211: mol_type = other DNA
cgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcg

SEQ ID NO: 2265 - DNA, 75 bp, synthetic construct
  misc_feature 1..75: note = Description of Artificial Sequence: Synthetic oligonucleotide
  source 1..75: mol_type = other DNA
cgtttttacgcgcgttgtcggtatttgttcgttttgttgtaatttgttgtagtgtttgaaagagtagtaggagcg

SEQ ID NO: 2266 - skipped

SEQ ID NO: 2267 - DNA, 66 bp, synthetic construct
  misc_feature 1..66: note = Description of Artificial Sequence: Synthetic oligonucleotide
  source 1..66: mol_type = other DNA
cgggcgttggagaaggcgtttggcgcgaagttgggcggcgtttcgagggcggaggataggtggtcg

SEQ ID NO: 2268 - skipped

SEQ ID NO: 2269 - DNA, 163 bp, synthetic construct
  misc_feature 1..163: note = Description of Artificial Sequence: Synthetic polynucleotide
  source 1..163: mol_type = other DNA
cggggcggcgggcgtatgcgcgtgcgcggtgcggttttagttttggttgtcgtcgtttgtcgtcgtcgtcgcgatgtttattttagttaaagcggttgcgggtttggggattcggttcgggtagcggagttttcggattcgtcgattcgtcgaggagcgcgcg

SEQ ID NO: 2270 - DNA, 99 bp, synthetic construct
  misc_feature 1..99: note = Description of Artificial Sequence: Synthetic oligonucleotide
  source 1..99: mol_type = other DNA
cggagtaaagttagcgcgtttcgcggttcggaatttagttggttcgttatttttttatttttgcgattttattttcgatcgcgttttagggtagaagcg

SEQ ID NO: 2271 - DNA, 96 bp, synthetic construct
  misc_feature 1..96: note = Description of Artificial Sequence: Synthetic oligonucleotide
  source 1..96: mol_type = other DNA
cggcggcggcggtagttttagtcgcgttcgttatatatatttttattcgttcggtgtatacgtcgcgtcgcgggtagtgtcgtttgcggaggcgcg

SEQ ID NO: 2272 - skipped

SEQ ID NO: 2273 - DNA, 16 bp, synthetic construct
  misc_feature 1..16: note = Description of Artificial Sequence: Synthetic oligonucleotide
  source 1..16: mol_type = other DNA
cgtgttaatttcgtcg

SEQ ID NO: 2274 - skipped

SEQ ID NO: 2275 - DNA, 141 bp, synthetic construct
  misc_feature 1..141: note = Description of Artificial Sequence: Synthetic polynucleotide
  source 1..141: mol_type = other DNA
cgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcg

SEQ ID NO: 2276 - skipped

SEQ ID NO: 2277 - DNA, 37 bp, synthetic construct; identical to SEQ ID NO: 565
  misc_feature 1..37: note = Description of Artificial Sequence: Synthetic oligonucleotide
  source 1..37: mol_type = other DNA

SEQ ID NO: 2278 - DNA, 52 bp, synthetic construct
  misc_feature 1..52: note = Description of Artificial Sequence: Synthetic oligonucleotide
  source 1..52: mol_type = other DNA
cgaggcgttttcgttttcgttatttatatagggcgttaagtgtttcgattcg

SEQ ID NO: 2279-2282 - skipped (4 entries)

SEQ ID NO: 2283 - DNA, 17 bp, synthetic construct
  misc_feature 1..17: note = Description of Artificial Sequence: Synthetic oligonucleotide
  source 1..17: mol_type = other DNA
cgtttcgttttaattcg

SEQ ID NO: 2284 - DNA, 136 bp, synthetic construct
  misc_feature 1..136: note = Description of Artificial Sequence: Synthetic polynucleotide
  source 1..136: mol_type = other DNA
cgcggggggaggtttttggttcgtcgttttcgttgtcgtttgatcgtatttttggagggtttcgtattttgttaggtttttggaggtaaatatatattttcgatttataattggttttcgcgttaggggattcgcg

SEQ ID NO: 2285 - DNA, 31 bp, synthetic construct
  misc_feature 1..31: note = Description of Artificial Sequence: Synthetic oligonucleotide
  source 1..31: mol_type = other DNA
cggttagggagtgagcggggcgttgggcgcg

SEQ ID NO: 2286 - DNA, 25 bp, synthetic construct
  misc_feature 1..25: note = Description of Artificial Sequence: Synthetic oligonucleotide
  source 1..25: mol_type = other DNA
cgttaattagattttagggtgtacg

SEQ ID NO: 2287 - DNA, 12 bp, synthetic construct
  misc_feature 1..12: note = Description of Artificial Sequence: Synthetic oligonucleotide
  source 1..12: mol_type = other DNA
cgttcgttaacg

SEQ ID NO: 2288 - skipped

SEQ ID NO: 2289 - DNA, 199 bp, synthetic construct
  misc_feature 1..199: note = Description of Artificial Sequence: Synthetic polynucleotide
  source 1..199: mol_type = other DNA
cgtagcgtgtagtcgcggaatagcgtttttagttttgggtaagcgaatttttcgtcgtacgttcggagttcgcgtcggcggtttgtttcggtcgttcgttcggcgttttcgggttcgttcgcgtcgttttcgtcgtcgttttcgtcgcgcggcgttttcgttattttagcgttatgtagcggtcgcggtcgcgggcgcg

SEQ ID NO: 2290 - DNA, 91 bp, synthetic construct
  misc_feature 1..91: note = Description of Artificial Sequence: Synthetic oligonucleotide
  source 1..91: mol_type = other DNA
cgtgggggcgcggcgcgggcgatacgtgcgggtcgttaggagggggagggggacgcgcgtcgtcgggttcgttattttgtattcggggtcg

SEQ ID NO: 2291 - DNA, 108 bp, synthetic construct
  misc_feature 1..108: note = Description of Artificial Sequence: Synthetic polynucleotide
  source 1..108: mol_type = other DNA
cgttttttttatggattttttagtatttgtaggttataggataatagaagttatagtagagttatcgaggaattttaggaacggaggagatggaatagtggagacgcg

SEQ ID NO: 2292 - DNA, 13 bp, synthetic construct
  misc_feature 1..13: note = Description of Artificial Sequence: Synthetic oligonucleotide
  source 1..13: mol_type = other DNA
cgaaatcggtgcg

SEQ ID NO: 2293 - DNA, 176 bp, synthetic construct
  misc_feature 1..176: note = Description of Artificial Sequence: Synthetic polynucleotide
  source 1..176: mol_type = other DNA
cgggggcggcggggtgatagttttcgtgtatgaattagttattttttaggtttcgtttcggcgggggtcggtcggacgttcgtttcgtataaagcgggtattcgggtcgtttggagtagaaagtcgcgtattttttttcgttaggcgttttttcggacgttttgtttagcgggtcg

SEQ ID NO: 2294 - skipped

SEQ ID NO: 2295 - DNA, 157 bp, synthetic construct
  misc_feature 1..157: note = Description of Artificial Sequence: Synthetic polynucleotide
  source 1..157: mol_type = other DNA
cgggcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcg

SEQ ID NO: 2296 - DNA, 66 bp, synthetic construct
  misc_feature 1..66: note = Description of Artificial Sequence: Synthetic oligonucleotide
  source 1..66: mol_type = other DNA
cggtcgcggcgggagggatagggggtttgggtgggaagggagcgcgagggtttttagcggttcgcg

SEQ ID NO: 2297 - DNA, 498 bp, synthetic construct
  misc_feature 1..498: note = Description of Artificial Sequence: Synthetic polynucleotide
  source 1..498: mol_type = other DNA
cgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcg

SEQ ID NO: 2298 - DNA, 27 bp, synthetic construct
  misc_feature 1..27: note = Description of Artificial Sequence: Synthetic oligonucleotide
  source 1..27: mol_type = other DNA
cgagcgcgaagggcgttcggattcgcg

SEQ ID NO: 2299-2300 - skipped (2 entries)

SEQ ID NO: 2301 - DNA, 16 bp, synthetic construct
  misc_feature 1..16: note = Description of Artificial Sequence: Synthetic oligonucleotide
  source 1..16: mol_type = other DNA
cgcgaggtaggcgacg

SEQ ID NO: 2302 - DNA, 53 bp, synthetic construct
  misc_feature 1..53: note = Description of Artificial Sequence: Synthetic oligonucleotide
  source 1..53: mol_type = other DNA
cgtcgtaagagaagttgttaagtttcgtaggttttgattcggcgtttttcgcg

SEQ ID NO: 2303-2306 - skipped (4 entries)

SEQ ID NO: 2307 - DNA, 14 bp, synthetic construct
  misc_feature 1..14: note = Description of Artificial Sequence: Synthetic oligonucleotide
  source 1..14: mol_type = other DNA
cgtaggtggatacg

SEQ ID NO: 2308 - DNA, 186 bp, synthetic construct
  misc_feature 1..186: note = Description of Artificial Sequence: Synthetic polynucleotide
  source 1..186: mol_type = other DNA
cgttatggagaaaattaatggaggaaaaattatagagttattcgaaatagttgcgttgtttattattcggtgtttgagtttgttttttttgtaattagattatatgtgaggtagttttagttaattgtttgtgttatttatcggggaattttagttttatttgtgaatatttaggttttttcgtcg

SEQ ID NO: 2309 - DNA, 79 bp, synthetic construct
  misc_feature 1..79: note = Description of Artificial Sequence: Synthetic oligonucleotide
  source 1..79: mol_type = other DNA
cgcgtattttttttatttcgatatttattgttatttttatagcggagcgaggggtttcgtcgagggcgagcgtatttcg

SEQ ID NO: 2310 - DNA, 49 bp, synthetic construct
  misc_feature 1..49: note = Description of Artificial Sequence: Synthetic oligonucleotide
  source 1..49: mol_type = other DNA
cgcgggggcgtttttcgttgtttgtagggagcgcggcgcggacgcggcg

SEQ ID NO: 2311 - DNA, 17 bp, synthetic construct
  misc_feature 1..17: note = Description of Artificial Sequence: Synthetic oligonucleotide
  source 1..17: mol_type = other DNA
cgcgaacggtttattcg

SEQ ID NO: 2312-2314 - skipped (3 entries)

SEQ ID NO: 2315 - DNA, 165 bp, synthetic construct
  misc_feature 1..165: note = Description of Artificial Sequence: Synthetic polynucleotide
  source 1..165: mol_type = other DNA
cggggtttggtaggaagtgtagtgtattttttagttttagggtaattaggatagtatgaattttttattttgtggtagaataaacggttagcgtttcgatgtggcgcgttcgatttttttttatagagtttaaaagttacgtttaattaaattgtagcgttttcg

SEQ ID NO: 2316 - DNA, 14 bp, synthetic construct
  misc_feature 1..14: note = Description of Artificial Sequence: Synthetic oligonucleotide
  source 1..14: mol_type = other DNA
cgttgattcgcgcg

SEQ ID NO: 2317-2318 - skipped (2 entries)

SEQ ID NO: 2319 - DNA, 97 bp, synthetic construct
  misc_feature 1..97: note = Description of Artificial Sequence: Synthetic oligonucleotide
  source 1..97: mol_type = other DNA
cgtttcgtacgttcgtacgtttagcggggttcgtattgagtatgggcgcggcggtcgtgcgttggtatttgtgcgtgttgttggttttgggtatacg

SEQ ID NO: 2320 - skipped

SEQ ID NO: 2321 - DNA, 98 bp, synthetic construct
  misc_feature 1..98: note = Description of Artificial Sequence: Synthetic oligonucleotide
  source 1..98: mol_type = other DNA
cgaggtttagtttttggttttaaggaataaattcgttggtttgaaagggagttacggtagaagtttaggggtagagcggcgggagcgcgcgattcgcg

SEQ ID NO: 2322 - DNA, 69 bp, synthetic construct
  misc_feature 1..69: note = Description of Artificial Sequence: Synthetic oligonucleotide
  source 1..69: mol_type = other DNA
cgcggaaggttcgcgcgttttgcgtcgtcgtcgtttagtgtcgtcgttagtatttttttcgttttttcg

SEQ ID NO: 2323-2326 - skipped (4 entries)

SEQ ID NO: 2327 - DNA, 103 bp, synthetic construct
  misc_feature 1..103: note = Description of Artificial Sequence: Synthetic polynucleotide
  source 1..103: mol_type = other DNA
cgcgttcgtcgttttcggaggagcgggttggtcgatcgttatcgcgtcgtttttcggtcgttttcgaagtcgttttatcgcggtttttgtcgttttggggtcg

SEQ ID NO: 2328 - skipped

SEQ ID NO: 2329 - DNA, 21 bp, synthetic construct
  misc_feature 1..21: note = Description of Artificial Sequence: Synthetic oligonucleotide
  source 1..21: mol_type = other DNA
cgtcgtcgtcgttgagagtcg

SEQ ID NO: 2330 - DNA, 148 bp, synthetic construct
  misc_feature 1..148: note = Description of Artificial Sequence: Synthetic polynucleotide
  source 1..148: mol_type = other DNA
cgcgcgggcgcgaggggttgggacgcgggagttttttgagtgcggagcgcggagttttggtgtttcggcgtattgtagttatattttcgggtcgcgcgttttcgtcgttttttattcgcgtcgtagggtttttttttttgaggcgtcg

SEQ ID NO: 2331-2332 - skipped (2 entries)

SEQ ID NO: 2333 - DNA, 26 bp, synthetic construct
  misc_feature 1..26: note = Description of Artificial Sequence: Synthetic oligonucleotide
  source 1..26: mol_type = other DNA
cggttattacgcgttgtttttcggcg

SEQ ID NO: 2334 - DNA, 119 bp, synthetic construct
  misc_feature 1..119: note = Description of Artificial Sequence: Synthetic polynucleotide
  source 1..119: mol_type = other DNA
cgttcgatgatgaggatgtatttttcgtaggtgtagtttttgaagcggtagtaacgtttgtggtttttgagttaggataggacgttatggttgcggtagcgcgcgtatttgggcgtgcg

SEQ ID NO: 2335 - DNA, 66 bp, synthetic construct
  misc_feature 1..66: note = Description of Artificial Sequence: Synthetic oligonucleotide
  source 1..66: mol_type = other DNA
cgttttattttgttgaggtcgttttcggttttttttgatttaggttgggcgggaaaggtcgggtcg

SEQ ID NO: 2336 - DNA, 60 bp, synthetic construct
  misc_feature 1..60: note = Description of Artificial Sequence: Synthetic oligonucleotide
  source 1..60: mol_type = other DNA
cgcggttggggtttcgcgttttttggagcgttttttgtttagatacgacgatttcgttcg

SEQ ID NO: 2337 - skipped

SEQ ID NO: 2338 - DNA, 124 bp, synthetic construct
  misc_feature 1..124: note = Description of Artificial Sequence: Synthetic polynucleotide
  source 1..124: mol_type = other DNA
cggcggtaggagaagtttaaggttcgagcggttcgtagtttttacgtttgtatttttttattttcgttagttcgatggttcgtttcgcggcgtgtattggagtaagtaggtttcgtttcgagcg

SEQ ID NO: 2339 - skipped

SEQ ID NO: 2340 - DNA, 156 bp, synthetic construct
  misc_feature 1..156: note = Description of Artificial Sequence: Synthetic polynucleotide
  source 1..156: mol_type = other DNA
cgtttcggtttttatcgtcgcgtttttataggttattaggtgtcgttcgtttagaatgttaattatggcgtagatacgtagttatttgagattcgaggatatttgtaggaggatgattatttgcggggaggcggcggcgagcgtcgcggtgtttcg

SEQ ID NO: 2341 - skipped

SEQ ID NO: 2342 - DNA, 91 bp, synthetic construct
  misc_feature 1..91: note = Description of Artificial Sequence: Synthetic oligonucleotide
  source 1..91: mol_type = other DNA
cgttttaggaatgattcggtgatatcggtcgatgattttttttatagtttgtcggtgagcggcggcggaggtaaggtttcggcggcgcgcg

SEQ ID NO: 2343-2344 - skipped (2 entries)

SEQ ID NO: 2345 - DNA, 89 bp, synthetic construct
  misc_feature 1..89: note = Description of Artificial Sequence: Synthetic oligonucleotide
  source 1..89: mol_type = other DNA
cgtcgagttgtaggcgcgcgtttaatcgttttgttgggtttacgcggtttgagaggtcggagcgtttaattgttggtacgcgagtaacg

SEQ ID NO: 2346 - DNA, 13 bp, synthetic construct
  misc_feature 1..13: note = Description of Artificial Sequence: Synthetic oligonucleotide
  source 1..13: mol_type = other DNA
cggattaaagacg

SEQ ID NO: 2347 - skipped

SEQ ID NO: 2348 - DNA, 47 bp, synthetic construct
  misc_feature 1..47: note = Description of Artificial Sequence: Synthetic oligonucleotide
  source 1..47: mol_type = other DNA
cgcgatgtggtttcgtttggttttttgttgttggggtttggcgttcg

SEQ ID NO: 2349-2350 - skipped (2 entries)

SEQ ID NO: 2351 - DNA, 159 bp, synthetic construct
  misc_feature 1..159: note = Description of Artificial Sequence: Synthetic polynucleotide
  source 1..159: mol_type = other DNA
cgtttttcgtcgaggcgtaggggtagttatattgcggggcgtttgggcgacggcgttaaagttagggttataagggtacgggataagcggggcggggggagtaggagattaggatagaggtcggcgttcgtcgcgggcgtttttacgtcgcgggtatcg

SEQ ID NO: 2352-2354 - skipped (3 entries)

SEQ ID NO: 2355 - DNA, 78 bp, synthetic construct
  misc_feature 1..78: note = Description of Artificial Sequence: Synthetic oligonucleotide
  source 1..78: mol_type = other DNA
cggtcgttttttcgacgttcgcggttttttattgcgtcgaggcgagcgttacggttaaagtttaagtttcggcgttcg

SEQ ID NO: 2356 - skipped

SEQ ID NO: 2357 - DNA, 48 bp, synthetic construct
  misc_feature 1..48: note = Description of Artificial Sequence: Synthetic oligonucleotide
  source 1..48: mol_type = other DNA
cgcgttaattcggtcgttgtgtacggtcgggtgcgaaattttttcgcg

SEQ ID NO: 2358-2360 - skipped (3 entries)

SEQ ID NO: 2361 - DNA, 157 bp, synthetic construct
  misc_feature 1..157: note = Description of Artificial Sequence: Synthetic polynucleotide
  source 1..157: mol_type = other DNA
cgtgtttaattggtatttgttattaatatgtttgtttttatttaaatggtttagagtaaggttttgattaaattagtatttttacgttaatatttagtagcgtttttggtttttggtagattttttttttagttgttaaagtaaaattatagaagcg

SEQ ID NO: 2362 - skipped

SEQ ID NO: 2363 - DNA, 82 bp, synthetic construct
  misc_feature 1..82: note = Description of Artificial Sequence: Synthetic oligonucleotide
  source 1..82: mol_type = other DNA
cgtattcgcggggagggcggcgagcggggattagtcgaagtcgggagaggggcgtttttacggggcgggaaattggcgcgcg

SEQ ID NO: 2364 - DNA, 23 bp, synthetic construct
  misc_feature 1..23: note = Description of Artificial Sequence: Synthetic oligonucleotide
  source 1..23: mol_type = other DNA
cggttaggtgaggcggttaggcg

SEQ ID NO: 2365 - DNA, 38 bp, synthetic construct
  misc_feature 1..38: note = Description of Artificial Sequence: Synthetic oligonucleotide
  source 1..38: mol_type = other DNA
cgaattcgtaaagttgttcgtagacgcgcgggaattcg

SEQ ID NO: 2366 - skipped

SEQ ID NO: 2367 - DNA, 165 bp, synthetic construct
  misc_feature 1..165: note = Description of Artificial Sequence: Synthetic polynucleotide
  source 1..165: mol_type = other DNA
cgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacg

SEQ ID NO: 2368-2370 - skipped (3 entries)

SEQ ID NO: 2371 - DNA, 23 bp, synthetic construct
  misc_feature 1..23: note = Description of Artificial Sequence: Synthetic oligonucleotide
  source 1..23: mol_type = other DNA
cgataggcggttttcggatatcg

SEQ ID NO: 2372 - skipped

SEQ ID NO: 2373 - DNA, 66 bp, synthetic construct
  misc_feature 1..66: note = Description of Artificial Sequence: Synthetic oligonucleotide
  source 1..66: mol_type = other DNA
cggcgttttcggggttgttgcgcgttcgcgtttagagttgtcgttttagggagttcgttacggtcg

SEQ ID NO: 2374 - DNA, 43 bp, synthetic construct
  misc_feature 1..43: note = Description of Artificial Sequence: Synthetic oligonucleotide
  source 1..43: mol_type = other DNA
cgggcgcgtagttcgttcgcgcggtttggattttttttgttcg

SEQ ID NO: 2375 - skipped

SEQ ID NO: 2376 - DNA, 62 bp, synthetic construct
  misc_feature 1..62: note = Description of Artificial Sequence: Synthetic oligonucleotide
  source 1..62: mol_type = other DNA
cgcgttgtacgaggatggttacgaggcgtagttggagtcgtcgtcgtcgtcgtatttgggcg

SEQ ID NO: 2377 - skipped

SEQ ID NO: 2378 - DNA, 138 bp, synthetic construct
  misc_feature 1..138: note = Description of Artificial Sequence: Synthetic polynucleotide
  source 1..138: mol_type = other DNA
cgttttcgggcgtacggaaattatttgttaggaaatttttaacgttttttttcgtttatttttttttattttttttttggcgcgttttttttttttttagaggtacgtagtggagtttttggagtttcgaatttttcg

SEQ ID NO: 2379-2382 - skipped (4 entries)

SEQ ID NO: 2383 - DNA, 187 bp, synthetic construct
  misc_feature 1..187: note = Description of Artificial Sequence: Synthetic polynucleotide
  source 1..187: mol_type = other DNA
cgagcggttttaatttcgtttcgtttgttgttgttgttgttggtgttgtttcggttgtagttgttgtcgttttacgatttcggggcgttgaggtaatagggttttttttttttattttttatttttttcggtttttttatagaagcgtcgtttttagtaatttttcgtgtattttttatttttgtcg

SEQ ID NO: 2384-2385 - skipped (2 entries)

SEQ ID NO: 2386 - DNA, 110 bp, synthetic construct
  misc_feature 1..110: note = Description of Artificial Sequence: Synthetic polynucleotide
  source 1..110: mol_type = other DNA
cgtaggttaagatttggttttagaattatcgttataagttgaagcgcgttcgcgttttaggggcggcggagtcgtttgatttggtagtattcgtcgagttgtacgtcgcg

SEQ ID NO: 2387 - skipped

SEQ ID NO: 2388 - DNA, 189 bp, synthetic construct
  misc_feature 1..189: note = Description of Artificial Sequence: Synthetic polynucleotide
  source 1..189: mol_type = other DNA
cgtgttttcgttcgcgtttgggtttcgtcgtattttagtagaagttattatagagaataaattatttttttgttttcgagatgggttttcggggaggaaggtaaattgtttgtttcgtgtataataagttaggcgtggagagtagcgcggaggaggtcgcggtagttatcgagcgggtagagtttttcg

SEQ ID NO: 2389 - DNA, 42 bp, synthetic construct
  misc_feature 1..42: note = Description of Artificial Sequence: Synthetic oligonucleotide
  source 1..42: mol_type = other DNA
cgcgagtgtatttaagcgttttcgttttatttatttttagcg

SEQ ID NO: 2390 - DNA, 33 bp, synthetic construct
  misc_feature 1..33: note = Description of Artificial Sequence: Synthetic oligonucleotide
  source 1..33: mol_type = other DNA
cgtggagcgtaaagtgtttgaagttttcgcgcg

SEQ ID NO: 2391 - DNA, 15 bp, synthetic construct
  misc_feature 1..15: note = Description of Artificial Sequence: Synthetic oligonucleotide
  source 1..15: mol_type = other DNA
cgttcggttggcgcg

SEQ ID NO: 2392 - DNA, 51 bp, synthetic construct
  misc_feature 1..51: note = Description of Artificial Sequence: Synthetic oligonucleotide
  source 1..51: mol_type = other DNA
cgtttattacggcgatttgcggtagttttagtaggtagttttgttttagcg

SEQ ID NO: 2393 - skipped

SEQ ID NO: 2394 - DNA, 268 bp, synthetic construct
  misc_feature 1..268: note = Description of Artificial Sequence: Synthetic polynucleotide
  source 1..268: mol_type = other DNA
cgaagatgggaaacggtcgtttgttgagagggggtatttgtagtttttttagaaaaggttggggtaggagagcgtgcggttagaggggtgggggtatcggagggggggttttattttttgttttatagtcgggtttttttcgcgaggcgttgggaagtatgaggtatgtagtatttaaaatgttttttgaaaaagacggatttgaagtttttttttataaatacgttattgtatttattttttatttagagacgggttgcgcgtttcg

SEQ ID NO: 2395 - skipped

SEQ ID NO: 2396 - DNA, 33 bp, synthetic construct
  misc_feature 1..33: note = Description of Artificial Sequence: Synthetic oligonucleotide
  source 1..33: mol_type = other DNA
cggtgatcggtttgattgtttttgggggtttcg

SEQ ID NO: 2397 - DNA, 23 bp, synthetic construct
  misc_feature 1..23: note = Description of Artificial Sequence: Synthetic oligonucleotide
  source 1..23: mol_type = other DNA
cgaaagtttcgggttagtgggcg

SEQ ID NO: 2398 - DNA, 40 bp, synthetic construct
  misc_feature 1..40: note = Description of Artificial Sequence: Synthetic oligonucleotide
  source 1..40: mol_type = other DNA
cgaggtatttggtcgggcggggaggcgtcgggtcggggcg

SEQ ID NO: 2399 - DNA, 10 bp, synthetic construct
  misc_feature 1..10: note = Description of Artificial Sequence: Synthetic oligonucleotide
  source 1..10: mol_type = other DNA
cggagtcgcg

SEQ ID NO: 2400 - DNA, 181 bp, synthetic construct
  misc_feature 1..181: note = Description of Artificial Sequence: Synthetic polynucleotide
  source 1..181: mol_type = other DNA
cgaaaacgaaatttatttttttgcgtttatttttgttagaggtttgtaggacgtgttttaatttggtatttcgagtttagaataaaagttacgggggttgcggtatgggtagggggaaggcgcgcggtggttgacgcggggtaggggttttggcgagcgcgggaggggcggttagtagtcg

SEQ ID NO: 2401 - DNA, 195 bp, synthetic construct
  misc_feature 1..195: note = Description of Artificial Sequence: Synthetic polynucleotide
  source 1..195: mol_type = other DNA
cgttaagtagtaggattatagcgttagcgtttggtttcggaggaaagataagttggagtacgtaagggcgattcgttttcgggggtttcggttaggtatttgtcgtatgtatttttttcgtggtggtggtatgagcgcgcgcggggcgcggggggtaggcgaggggattttggtaggcgtcgacgttttaggtcg

SEQ ID NO: 2402 - skipped

SEQ ID NO: 2403 - DNA, 358 bp, synthetic construct
  misc_feature 1..358: note = Description of Artificial Sequence: Synthetic polynucleotide
  source 1..358: mol_type = other DNA
cgcgagttcgggtgagagttatcggaatgcgggaacgtagtttagtcgggaatagggttttcgataggggtcgttcgtggttaggacgcggtcgttgaatagaggtcgcgcggcggtttttgttcgagggatttcgtgggcgggggttatacggaggtcgcgtacggttttcggggttggcgggggtaggtgggaggatttttttcgggttcgcgaatttgatttggtagcggttaggtgtttggaagcgtttttaaatgatagggttataaagatatgttggttaggtttgtagttagcgtagtaacgtggtttgtaggagcgtagaacgaggttagatagggttattcggacgtcg

SEQ ID NO: 2404 - DNA, 13 bp, synthetic construct
  misc_feature 1..13: note = Description of Artificial Sequence: Synthetic oligonucleotide
  source 1..13: mol_type = other DNA
cgttataattgcg

SEQ ID NO: 2405-2406 - skipped (2 entries)

SEQ ID NO: 2407 - DNA, 95 bp, synthetic construct
  misc_feature 1..95: note = Description of Artificial Sequence: Synthetic oligonucleotide
  source 1..95: mol_type = other DNA
cgggtattcgggacgaggcgagggcgtagaaaatttggagtttaattagtacggagttgagttttcgcgttttaatttttaggtgatttcgtgcg

SEQ ID NO: 2408 - DNA, 45 bp, synthetic construct
  misc_feature 1..45: note = Description of Artificial Sequence: Synthetic oligonucleotide
  source 1..45: mol_type = other DNA
cgtcgagagggtaggacgcgtacggtgcgttttaatttgttgtcg

SEQ ID NO: 2409 - DNA, 104 bp, synthetic construct
  misc_feature 1..104: note = Description of Artificial Sequence: Synthetic polynucleotide
  source 1..104: mol_type = other DNA
cgcgagttagggggaggcgcgtcggaaagcgagagtgataagtagtttataagtcgaaaagtttttcgcgggaggcgcgcgtcgcgtgggtttcgatttagtcg

SEQ ID NO: 2410 - DNA, 87 bp, synthetic construct
  misc_feature 1..87: note = Description of Artificial Sequence: Synthetic oligonucleotide
  source 1..87: mol_type = other DNA
cgggagggtggcggaaggtggtgtatcgtagcgtggttttcgtcgttgtcgtcgcggttttgtaaagtgttagcgggggcgaaagcg

SEQ ID NO: 2411 - DNA, 62 bp, synthetic construct
  misc_feature 1..62: note = Description of Artificial Sequence: Synthetic oligonucleotide
  source 1..62: mol_type = other DNA
cgatattgaataataatcgcggggaggagaggttatttgtagtcgaggttcgtaaattgtcg

SEQ ID NO: 2412-2419 - skipped (8 entries)

SEQ ID NO: 2420 - DNA, 145 bp, synthetic construct
  misc_feature 1..145: note = Description of Artificial Sequence: Synthetic polynucleotide
  source 1..145: mol_type = other DNA
cgggaatcgtaggagaggattggggttttaggtggacggtgttgattgtattggttttgaagattggaagtgggtgtaggaggaatttgcgatagttgagattagggcgcgcgggtagatgcgttaggtcgttagtaaatcggcg

SEQ ID NO: 2421 - skipped

SEQ ID NO: 2422 - DNA, 19 bp, synthetic construct
  misc_feature 1..19: note = Description of Artificial Sequence: Synthetic oligonucleotide
  source 1..19: mol_type = other DNA
cggtttttggcggtgggcg

SEQ ID NO: 2423 - DNA, 35 bp, synthetic construct
  misc_feature 1..35: note = Description of Artificial Sequence: Synthetic oligonucleotide
  source 1..35: mol_type = other DNA
cggaggtttcgttaatggggtcgtcgtcgtcgtcg

SEQ ID NO: 2424-2425 - skipped (2 entries)

SEQ ID NO: 2426 - DNA, 36 bp, synthetic construct
  misc_feature 1..36: note = Description of Artificial Sequence: Synthetic oligonucleotide
  source 1..36: mol_type = other DNA
cggtttttttgtagttagcggattagcgttagttcg

SEQ ID NO: 2427 - skipped

SEQ ID NO: 2428 - DNA, 42 bp, synthetic construct
  misc_feature 1..42: note = Description of Artificial Sequence: Synthetic oligonucleotide
  source 1..42: mol_type = other DNA
cgtataatggtaaatgggattaggtaggcgaaggtttagtcg

SEQ ID NO: 2429-2430 - skipped (2 entries)

SEQ ID NO: 2431 - DNA, 18 bp, synthetic construct
  misc_feature 1..18: note = Description of Artificial Sequence: Synthetic oligonucleotide
  source 1..18: mol_type = other DNA
cggcgcgggcgttgcgcg

SEQ ID NO: 2432-2434 - skipped (3 entries)

SEQ ID NO: 2435 - DNA, 118 bp, synthetic construct
  misc_feature 1..118: note = Description of Artificial Sequence: Synthetic polynucleotide
  source 1..118: mol_type = other DNA
cgcgtcgttgttttgttttaggtttcggtgcggttttaagttttagtttagggtttttaggtttttttaggcggcggtggcggtatttatttgggtcgcggagtcggggtttggtacg

SEQ ID NO: 2436 - DNA, 22 bp, synthetic construct
  misc_feature 1..22: note = Description of Artificial Sequence: Synthetic oligonucleotide
  source 1..22: mol_type = other DNA
cgttcgcgtcgttcgcggttcg

SEQ ID NO: 2437-2440 - skipped (4 entries)

SEQ ID NO: 2441 - DNA, 31 bp, synthetic construct
  misc_feature 1..31: note = Description of Artificial Sequence: Synthetic oligonucleotide
  source 1..31: mol_type = other DNA
cgtaatatattttagtatcgagtttttgtcg

SEQ ID NO: 2442-2450 - skipped (9 entries)

SEQ ID NO: 2451 - DNA, 69 bp, synthetic construct
  misc_feature 1..69: note = Description of Artificial Sequence: Synthetic oligonucleotide
  source 1..69: mol_type = other DNA
cgtttttcggttcgtttttttcgagcgtcgtcgatacgttagttaaacggtcgttggtcgtttttagcg

SEQ ID NO: 2452 - DNA, 415 bp, synthetic construct
  misc_feature 1..415: note = Description of Artificial Sequence: Synthetic polynucleotide
  source 1..415: mol_type = other DNA
cgtacgggttgggtttgggaatggggatcgcgaggttttagtatttcgatgttttgaaagttttttcgtttcggggatttgtttttgtgttgtagttggtaggggtcgtttgaagtgggagtagcgtttggagaaggcgggaggagttcggttcgggggacgggcggcgggatagcgggatttcggcggcgcggtgcgttttagggcgtagcggcggtcgtagatcgagtttcgggcgcggtaagaggcggcgggagtcggtggcggttcggtattatgcgtcgagggcgtttgttggagatcgttttgggatttatcgtgtttttagcgttttatacgagttatggggcggacgttaatttggaggttgggaacgtgaaggaaattagagttagtcgggttaagagaagaggcg

SEQ ID NO: 2453-2457 - skipped (5 entries)

SEQ ID NO: 2458 - DNA, 62 bp, synthetic construct
  misc_feature 1..62: note = Description of Artificial Sequence: Synthetic oligonucleotide
  source 1..62: mol_type = other DNA
cgtgcgtattttaagcgcgtgcgggagtgtgcgaggcgttgtgcgagttagcggcgggcgcg

SEQ ID NO: 2459-2462 - skipped (4 entries)

SEQ ID NO: 2463 - DNA, 20 bp, synthetic construct
  misc_feature 1..20: note = Description of Artificial Sequence: Synthetic oligonucleotide
  source 1..20: mol_type = other DNA
cggaggtttttgcgtttgcg

SEQ ID NO: 2464 - DNA, 69 bp, synthetic construct
  misc_feature 1..69: note = Description of Artificial Sequence: Synthetic oligonucleotide
  source 1..69: mol_type = other DNA
cgttgcgttttttcgtttgttggcgtttttgttttagcgggattcggtagttaggggttttagggggcg

SEQ ID NO: 2465 - skipped

SEQ ID NO: 2466 - DNA, 318 bp, synthetic construct
  misc_feature 1..318: note = Description of Artificial Sequence: Synthetic polynucleotide
  source 1..318: mol_type = other DNA
cgagacgcggtagatttttagagcggtttatttatttatcgaagcggattttgggcggtttcgggttgattcgcgttgttagggcgcggattttatttcgggcgtattgttaggagaaggggtttttcggggcggcgcgtttcgattttgggttttcggtgttcgtagagggcggagattcgcggcgttttaggttatttattcgtattttttcgagttaaatttttagcgtttattcggattcgacggtttaagtattgatttttaggtaagagtcgttttttttggtttttagggaattgatattatcgcgggacg

SEQ ID NO: 2467 - DNA, 27 bp, synthetic construct
  misc_feature 1..27: note = Description of Artificial Sequence: Synthetic oligonucleotide
  source 1..27: mol_type = other DNA
cgcgttttcgttcggggagttattacg

SEQ ID NO: 2468 - skipped

SEQ ID NO: 2469 - DNA, 13 bp, synthetic construct
  misc_feature 1..13: note = Description of Artificial Sequence: Synthetic oligonucleotide
  source 1..13: mol_type = other DNA
cgcggggagttcg

SEQ ID NO: 2470 - DNA, 189 bp, synthetic construct
  misc_feature 1..189: note = Description of Artificial Sequence: Synthetic polynucleotide
  source 1..189: mol_type = other DNA
cgtaatttttagttaaagttatcgcgggcggattatggtttagggcgttagaggggttagaggtacgggaagaggaaaagacggttaattgggaaaaaaagagaaaacgaaagaaaagttaaacgatgagtttttataaggaggacggagtgaatagtttgtgttagaaggttttgtatatcgttatcg

SEQ ID NO: 2471-2472 - skipped (2 entries)

SEQ ID NO: 2473 - DNA, 13 bp, synthetic construct
  misc_feature 1..13: note = Description of Artificial Sequence: Synthetic oligonucleotide
  source 1..13: mol_type = other DNA
cgtttagttttcg

SEQ ID NO: 2474 - DNA, 51 bp, synthetic construct
  misc_feature 1..51: note = Description of Artificial Sequence: Synthetic oligonucleotide
  source 1..51: mol_type = other DNA
cgaaggcgaggtcgtttagttcgtattttattttacgtacggtatacgtcg

SEQ ID NO: 2475 - DNA, 289 bp, synthetic construct
  misc_feature 1..289: note = Description of Artificial Sequence: Synthetic polynucleotide
  source 1..289: mol_type = other DNA
cggtagtgtttttttaagaaggggtaaaaaaatttgtttatggttatttttttttcgttttattttttttttttttgatagtttcggttttggttgttcgagtcgggggtgtgttttcggttttttttagatttgggcggggggcgggaggagtgagcgatttgggaagtttcgggggtggagagggggcgtttcggggtttgggggcgacgtggatattttttttggagtacggcggtgcgtttgggatttgaaggaagggtcgaaggaagcggggtgcgggcgggcg

SEQ ID NO: 2476 - skipped

SEQ ID NO: 2477 - DNA, 165 bp, synthetic construct
  misc_feature 1..165: note = Description of Artificial Sequence: Synthetic polynucleotide
  source 1..165: mol_type = other DNA
cgttttgggaagcgtagaggcgggggtgttgttcgcgttggggagtacgtgaggggatatttagggattgttcgcgcgaatggtttttaacgtatgcgttttattttatattttatagtcgttatgacgatcgggaggttcgtaacggttgcggggataagttcg

SEQ ID NO: 2478 - DNA, 21 bp, synthetic construct
  misc_feature 1..21: note = Description of Artificial Sequence: Synthetic oligonucleotide
  source 1..21: mol_type = other DNA
cgaagtggtgtaggggcggcg

SEQ ID NO: 2479-2481 - skipped (3 entries)

SEQ ID NO: 2482 - DNA, 159 bp, synthetic construct
  misc_feature 1..159: note = Description of Artificial Sequence: Synthetic polynucleotide
  source 1..159: mol_type = other DNA
cgtgttcgtggatgcgtagcgttacgcggttgtttattatttagcgatatacgcggtttacggagaaggtgaggtcgtagcgggtcgatttgtcgcggtttaggcggtcgtcgtcggcgttgtttatgttgtagagggatagtgcggttagcgtagtcg

SEQ ID NO: 2483 - skipped

SEQ ID NO: 2484 - DNA, 129 bp, synthetic construct
  misc_feature 1..129: note = Description of Artificial Sequence: Synthetic polynucleotide
  source 1..129: mol_type = other DNA
cgtgcgttcgagtggggtatttgttcgaggtcggggattgtgaatcgaaagattttatttagttttgttgtttttttggtattgcgatttgggggcgggttattttatttttttgaatttcgtttttcg

SEQ ID NO: 2485 - skipped

SEQ ID NO: 2486 - DNA, 120 bp, synthetic construct
  misc_feature 1..120: note = Description of Artificial Sequence: Synthetic polynucleotide
  source 1..120: mol_type = other DNA
cgttttttttttttttttttttttttttttttttttttttttttttttttttttttggtattatagagttgttttgaaaatagaagatagagggagtttcggagttcgttatttttagcg

SEQ ID NO: 2487 - skipped

SEQ ID NO: 2488 - DNA, 171 bp, synthetic construct
  misc_feature 1..171: note = Description of Artificial Sequence: Synthetic polynucleotide
  source 1..171: mol_type = other DNA
cgttcggttgttgtatttgttagtgttgggtttaggttgagaggcgatttttagtttttataataatgtttcgggttttttggtttgggttttcgtagcgttcgattgatcgttagcgatacgacgagaacgaggatttgtcggacgtggaggagatcgttagcgttcgcg

SEQ ID NO: 2489-2491 - skipped (3 entries)

SEQ ID NO: 2492 - DNA, 64 bp, synthetic construct
  misc_feature 1..64: note = Description of Artificial Sequence: Synthetic oligonucleotide
  source 1..64: mol_type = other DNA
cggggaaagttgggcgcgcgagtcgaggttgttgtttatttgtagtcgcgtcgtttatttgtcg

SEQ ID NO: 2493-2496 - skipped (4 entries)

SEQ ID NO: 2497 - DNA, 16 bp, synthetic construct
  misc_feature 1..16: note = Description of Artificial Sequence: Synthetic oligonucleotide
  source 1..16: mol_type = other DNA
cgagttttgcggagcg

SEQ ID NO: 2498-2500 - skipped (3 entries)

SEQ ID NO: 2501 - DNA, 18 bp, synthetic construct
  misc_feature 1..18: note = Description of Artificial Sequence: Synthetic oligonucleotide
  source 1..18: mol_type = other DNA
cgcggtcgagggaatgcg

SEQ ID NO: 2502 - DNA, 118 bp, synthetic construct
  misc_feature 1..118: note = Description of Artificial Sequence: Synthetic polynucleotide
  source 1..118: mol_type = other DNA
cgcgtttttgtttttgggtagatttttttatttgtgtattttggtttttttatttagtaaagagatgtgcgaagtgtgcgtttggagacgagtcgtttcggtgatttttattcgttcg

SEQ ID NO: 2503-2507 - skipped (5 entries)

SEQ ID NO: 2508 - DNA, 22 bp, synthetic construct
  misc_feature 1..22: note = Description of Artificial Sequence: Synthetic oligonucleotide
  source 1..22: mol_type = other DNA
cggatttttttggggcggcgcg

SEQ ID NO: 2509 - DNA, 112 bp, synthetic construct
  misc_feature 1..112: note = Description of Artificial Sequence: Synthetic polynucleotide
  source 1..112: mol_type = other DNA
cgaggtagggaggcgttttcgtagtttttgattttataattcgcgcgcgtgtgtatcgagtcgcgggtatatcgcgaatatatatatatatatatatattcgtgcgttttcg

SEQ ID NO: 2510 - DNA, 109 bp, synthetic construct
  misc_feature 1..109: note = Description of Artificial Sequence: Synthetic polynucleotide
  source 1..109: mol_type = other DNA
cgtggaggagtggggttaggtggttattattagtatgtttattcgttacgttcgtacgtagtttttgagttttatttagaacgtaagtgggtttagtttaggtagagcg

SEQ ID NO: 2511-2513 - skipped (3 entries)

SEQ ID NO: 2514 - DNA, 431 bp, synthetic construct
  misc_feature 1..431: note = Description of Artificial Sequence: Synthetic polynucleotide
  source 1..431: mol_type = other DNA
cgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcg

SEQ ID NO: 2515 - skipped

SEQ ID NO: 2516 - DNA, 40 bp, synthetic construct
  misc_feature 1..40: note = Description of Artificial Sequence: Synthetic oligonucleotide
  source 1..40: mol_type = other DNA
cgtttttatttttttagcggagttatagcggggcgcggcg

SEQ ID NO: 2517 - skipped

SEQ ID NO: 2518 - DNA, 22 bp, synthetic construct
  misc_feature 1..22: note = Description of Artificial Sequence: Synthetic oligonucleotide
  source 1..22: mol_type = other DNA
cgtggttttgaatttgttggcg

SEQ ID NO: 2519 - skipped

SEQ ID NO: 2520 - DNA, 47 bp, synthetic construct
  misc_feature 1..47: note = Description of Artificial Sequence: Synthetic oligonucleotide
  source 1..47: mol_type = other DNA
cgagttggagaattatagtatgtattgcgtgtaatgtaagatgttcg

SEQ ID NO: 2521 - DNA, 24 bp, synthetic construct
  misc_feature 1..24: note = Description of Artificial Sequence: Synthetic oligonucleotide
  source 1..24: mol_type = other DNA
cgtgttagaagttttttaacggcg

SEQ ID NO: 2522 - skipped

SEQ ID NO: 2523 - DNA, 45 bp, synthetic construct
  misc_feature 1..45: note = Description of Artificial Sequence: Synthetic oligonucleotide
  source 1..45: mol_type = other DNA
cgagggttttagttaattagtttgttgggtgggtttggagtttcg

SEQ ID NO: 2524 - skipped

SEQ ID NO: 2525 - DNA, 258 bp, synthetic construct
  misc_feature 1..258: note = Description of Artificial Sequence: Synthetic polynucleotide
  source 1..258: mol_type = other DNA
cgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcg

SEQ ID NO: 2526 - DNA, 45 bp, synthetic construct
  misc_feature 1..45: note = Description of Artificial Sequence: Synthetic oligonucleotide
  source 1..45: mol_type = other DNA
cgcgatcgtaagttcgagtttaggtttttcggagtcgttagggcg

SEQ ID NO: 2527-2528 - skipped (2 entries)

SEQ ID NO: 2529 - DNA, 67 bp, synthetic construct
  misc_feature 1..67: note = Description of Artificial Sequence: Synthetic oligonucleotide
  source 1..67: mol_type = other DNA
cgaggtcgtttcgttggttggtgtaagaattagtttgtaatttaagttttgagttgttggcgtttcg

SEQ ID NO: 2530 - DNA, 43 bp, synthetic construct
  misc_feature 1..43: note = Description of Artificial Sequence: Synthetic oligonucleotide
  source 1..43: mol_type = other DNA
cgttcgagttttcgttgttgtcgttgtcgttgcgggttagtcg

SEQ ID NO: 2531-2532 - skipped (2 entries)

SEQ ID NO: 2533 - DNA, 113 bp, synthetic construct
  misc_feature 1..113: note = Description of Artificial Sequence: Synthetic polynucleotide
  source 1..113: mol_type = other DNA
cgttcgagattcgggagagattaggggttcgtaaagtagaagagtagatttagaaagaaaaaaaaaaaagcgagaagtgcgagaaaaatatattgaatttagttaaatatacg

SEQ ID NO: 2534-2535 - skipped (2 entries)

SEQ ID NO: 2536 - DNA, 84 bp, synthetic construct
  misc_feature 1..84: note = Description of Artificial Sequence: Synthetic oligonucleotide
  source 1..84: mol_type = other DNA
cgggttttggggcgttggtgttcgcgtagttttagtcgttttcgtagttatcgtcgttcggtttcgcggaggcggcgcgtagcg

SEQ ID NO: 2537 - skipped

SEQ ID NO: 2538 - DNA, 48 bp, synthetic construct
  misc_feature 1..48: note = Description of Artificial Sequence: Synthetic oligonucleotide
  source 1..48: mol_type = other DNA
cgtaggttaagatttggttttagaattatcgttataagatgaagcgcg

SEQ ID NO: 2539 - DNA, 228 bp, synthetic construct
  misc_feature 1..228: note = Description of Artificial Sequence: Synthetic polynucleotide
  source 1..228: mol_type = other DNA
cgtcgttattacgtcgcgcgtcgtatttcgcgttaagaatggggcggttaagttgtttaagtcgttcgtcgtcgtcgtcgtcgtcgcggtcgaggcgttcggcgtcggcgcgggtatggagcgttcgtagagtcgttttagtttgttcgtttttttcgaggcgttcgttatttatttttcgtgtatgaattttttcgacgacgaggacgtaggtaagcgcgcggttcg

SEQ ID NO: 2540 - DNA, 47 bp, synthetic construct
  misc_feature 1..47: note = Description of Artificial Sequence: Synthetic oligonucleotide
  source 1..47: mol_type = other DNA
cgttggtgcgtggcggcgtggagcgcgtttgttacggttaaggtgcg

SEQ ID NO: 2541 - DNA, 185 bp, synthetic construct
  misc_feature 1..185: note = Description of Artificial Sequence: Synthetic polynucleotide
  source 1..185: mol_type = other DNA
cgtcgtttttcggtttagagtttttattttcggtttgtgagtttgcggcgttggtggagttcggttttaggaagaggagtttattcggttttttttgattggatagtagcgaggttttatcgggcgttttcgcggtttaaaatcgaagcgggggcgagggggaggtagagttcgttttttgcgcg

SEQ ID NO: 2542 - DNA, 216 bp, synthetic construct
  misc_feature 1..216: note = Description of Artificial Sequence: Synthetic polynucleotide
  source 1..216: mol_type = other DNA
cggcgttttatttattggcgtttacggttcgtaggtaaagcgtggaaggagttgaacgcggcggagaagcggtttttcgtggaggaagtcgaacggttgcgcgtgtagtatttgcgcgattattttaattataagtatcggtcgcgtcgtaagaagtaggcgcgtaaggttcggcggttggagttcggttttttgttttcgggattagcgttttcg

SEQ ID NO: 2543 - DNA, 344 bp, synthetic construct
  misc_feature 1..344: note = Description of Artificial Sequence: Synthetic polynucleotide
  source 1..344: mol_type = other DNA
cgaataatagaaattgttaattttaataatttagagtaggttaacgaggttttgttttttcgattcgaattaaaggtttttcgtttcgtgcgttgttacgagcggtgttttttggggttttaatgtagcgagttgtgttcgaggggttcggaaggcgtaagttgggtagcgatatggggaacgcggagcgggtttcggggtttcggagttttgggttagtatttacgttgttgttgttcgtcgcggcgttattggtcgtgtcggacgtattcgggcgttttttcgaggaggacgaggagttagtggtgtcggagttggagcgcgtttcgggatacgggattacg

SEQ ID NO: 2544 - DNA, 28 bp, synthetic construct
  misc_feature 1..28: note = Description of Artificial Sequence: Synthetic oligonucleotide
  source 1..28: mol_type = other DNA
cgtttcggtttggttgttaaatagaacg

SEQ ID NO: 2545 - DNA, 124 bp, synthetic construct
  misc_feature 1..124: note = Description of Artificial Sequence: Synthetic polynucleotide
  source 1..124: mol_type = other DNA
cggcgcgtacggttaaggtacgcgcgttggtatacgcgggcgcggatacgcgcggatatatacgtgcgggatacgttttttttcgacggcggcgttaatttttcggtaagtttagcgttttacg

SEQ ID NO: 2546 - DNA, 80 bp, synthetic construct
  misc_feature 1..80: note = Description of Artificial Sequence: Synthetic oligonucleotide
  source 1..80: mol_type = other DNA
cgaggtgtaggcggcgcgggcgtttatcgtgagcgtcgtgttgttggcgttcgttgcgtttttcgtgattttggcgggcg

SEQ ID NO: 2547 - DNA, 62 bp, synthetic construct
  misc_feature 1..62: note = Description of Artificial Sequence: Synthetic oligonucleotide
  source 1..62: mol_type = other DNA
cgaggcgtggaggggtagtcgcggcggggcgatttttatttgtttattgcggggtttgttcg

SEQ ID NO: 2548 - DNA, 165 bp, synthetic construct
  misc_feature 1..165: note = Description of Artificial Sequence: Synthetic polynucleotide
  source 1..165: mol_type = other DNA
cgttatttgatttcgttattaagtttaaggtgttttggatttacggtaagtatagcgtcgttgtagttggtcgtgcgtttttattatcgtcgttaggtttcgaggtcgcgtttagttttagtaagaggaaacggacgtttagcgataaatcggcgtatacggtcg

SEQ ID NO: 2549 - DNA, 43 bp, synthetic construct
  misc_feature 1..43: note = Description of Artificial Sequence: Synthetic oligonucleotide
  source 1..43: mol_type = other DNA
cgcgtttcgaggaagcgtcggaattattagaagtatagggacg

SEQ ID NO: 2550 - DNA, 86 bp, synthetic construct
  misc_feature 1..86: note = Description of Artificial Sequence: Synthetic oligonucleotide
  source 1..86: mol_type = other DNA
cgttatttttaattagttgtaagtcgagttgtttatttgggatcgggtcggttcggcgggtttggttttcggcgaaggcggcggcg

SEQ ID NO: 2551 - DNA, 23 bp, synthetic construct
  misc_feature 1..23: note = Description of Artificial Sequence: Synthetic oligonucleotide
  source 1..23: mol_type = other DNA
cgtttttttattttacgggttcg

SEQ ID NO: 2552 - skipped

SEQ ID NO: 2553 - DNA, 99 bp, synthetic construct
  misc_feature 1..99: note = Description of Artificial Sequence: Synthetic oligonucleotide
  source 1..99: mol_type = other DNA
cggtaggagtagtttatagttaggagcgttttttcgtttttaacgtcgcgtttttttttttaaaacggtttaaaaaaatttattaattgtatggtcgcg

SEQ ID NO: 2554 - DNA, 73 bp, synthetic construct
  misc_feature 1..73: note = Description of Artificial Sequence: Synthetic oligonucleotide
  source 1..73: mol_type = other DNA
cgattatttttgtgtttttaggagtttattttgggcggtagggaggcgttgcgtggggtttacgagttttacg

SEQ ID NO: 2555 - skipped

SEQ ID NO: 2556 - DNA, 52 bp, synthetic construct
  misc_feature 1..52: note = Description of Artificial Sequence: Synthetic oligonucleotide
  source 1..52: mol_type = other DNA
cgtttttaggattttcgttcgtttttttttgattcggtttttgttcgtttcg

SEQ ID NO: 2557 - DNA, 50 bp, synthetic construct
  misc_feature 1..50: note = Description of Artificial Sequence: Synthetic oligonucleotide
  source 1..50: mol_type = other DNA
cgtagtcgtcgcgttcgtatttgattatggagtgcgtttttttgttcgcg

SEQ ID NO: 2558 - DNA, 50 bp, synthetic construct
  misc_feature 1..50: note = Description of Artificial Sequence: Synthetic oligonucleotide
  source 1..50: mol_type = other DNA
cgaacgtagagtttatacgtggattttcgcgtttgtgatgtttcgattcg

SEQ ID NO: 2559-2560 - skipped (2 entries)

SEQ ID NO: 2561 - DNA, 52 bp, synthetic construct
  misc_feature 1..52: note = Description of Artificial Sequence: Synthetic oligonucleotide
  source 1..52: mol_type = other DNA
cgtttggggtttacgcgagtcgcgagtttttgtttgtttttgcgttatttcg

SEQ ID NO: 2562-2564 - skipped (3 entries)

SEQ ID NO: 2565 - DNA, 138 bp, synthetic construct
  misc_feature 1..138: note = Description of Artificial Sequence: Synthetic polynucleotide
  source 1..138: mol_type = other DNA
cgcggcgtttttagttgttttttattcgtttcgttcgttagtttttttttcgcgcgatggtttcggcgttgagttatgtttttaagtttaagtttttcgtgattttgttcgttatttcgtttttgttgttgttattcg

SEQ ID NO: 2566-2568 - skipped (3 entries)

SEQ ID NO: 2569 - DNA, 1216 bp, Homo sapiens
  source 1..1216: mol_type = unassigned DNA
caaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttc

SEQ ID NO: 2570 - DNA, 365 bp, Homo sapiens
  source 1..365: mol_type = unassigned DNA
ggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcc

SEQ ID NO: 2571 - DNA, 201 bp, Homo sapiens
  source 1..201: mol_type = unassigned DNA
tggcgtgacggcttgtggggcctgcggggtgcgctgcccccggacctgcggggggaggcggctgagctggcggcgctcgcgggcccagtggtgagtgcggcgtcctcacgcccagcccgacgcctccggagcggccgccgcgcaggggtgggcgcgggcttccaggagggagggcggctgtgaacgcgccttgctttccgc

SEQ ID NO: 2572 - DNA, 201 bp, Homo sapiens
  source 1..201: mol_type = unassigned DNA
atcacgtcgcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgc

SEQ ID NO: 2573 - DNA, 201 bp, Homo sapiens
  source 1..201: mol_type = unassigned DNA
gggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcga

SEQ ID NO: 2574 - DNA, 201 bp, Homo sapiens
  source 1..201: mol_type = unassigned DNA
ggcgctctcccctcgcccctggcccaggcccggctcgcgggtgtagctcttcctagggccccctcccctttccgggccgcgcgtccgccccgcatcgcggcggctcctcggcagtgtttgtttttattggacgcacagtgaccgtgacgggcacggggcgcgagctctcatcaccacaatgggtgtgcatggcgcggggcg

SEQ ID NO: 2575 - DNA, 201 bp, Homo sapiens
  source 1..201: mol_type = unassigned DNA
cccccccttaattgacctaactttctaaccctagctcttcgcttctggcaccggtcccctcccaagtctccagaccctaaccctggctcccgacccgccccgctacagcttgggaagcgggagaagcagcgcgcgcccttctgcggaccccctcccagggaagattgtggtgttagctgcctagggggaccagggggccac

SEQ ID NO: 2576 - DNA, 201 bp, Homo sapiens
  source 1..201: mol_type = unassigned DNA
agcccaggggtagggggctcagggcagccagacctccctaggctcaggaagagtagtcttcagcgctcggctgtcaggcaatccggtccccggttccccacggcggtctcctcggtgtgccccaccaagagcgacagggctggtgacccgaggggcgcgtgcgcggtcgtcagcctgggatttgcacggacccccttctcc

SEQ ID NO: 2577 - DNA, 213 bp, Homo sapiens
  source 1..213: mol_type = unassigned DNA
gcctcttgcctgaaccaaagtggccaggcactcagtttgtaagatgaacaaatgaaggaaagaaggaacgaatgaataagggctcatcttgcagagcgttcgcgtctcagcgcgcaccaggcacatcagtgccaaaggtgctgggggtcgggcccagcgcccggcgcggctggaatgggggcggcgaggagctcctcctagccagccgcaggg

SEQ ID NO: 2578 - DNA, 201 bp, Homo sapiens
  source 1..201: mol_type = unassigned DNA
gggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggc

SEQ ID NO: 2579 - DNA, 201 bp, Homo sapiens
  source 1..201: mol_type = unassigned DNA
cggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgc

SEQ ID NO: 2580 - DNA, 201 bp, Homo sapiens
  source 1..201: mol_type = unassigned DNA
aaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcgg

SEQ ID NO: 2581 - DNA, 324 bp, Homo sapiens
  source 1..324: mol_type = unassigned DNA
ggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatggcggggcgagggcgcgggacgctcggggacccggcgggacacgctttgcagcgcccagggctccagccactgcgggacgctctcggggccgcccaccccgcggtcccagcccggaccccg

SEQ ID NO: 2582 - DNA, 201 bp, Homo sapiens
  source 1..201: mol_type = unassigned DNA
ccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctc

SEQ ID NO: 2583 - DNA, 330 bp, Homo sapiens
  source 1..330: mol_type = unassigned DNA
ggactctggcgcccctccaggctgctgcgcgcgggctggggaccgtgcaccgctttgcgcgccagacgatgcatcttctggaacggcagctgaggcaatgcggggtgtgaagtggcggcgggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcgctgcagtccctgggaaatgggagcctccgtcctgttctctctgctgcttggctgggctgggct

SEQ ID NO: 2584 - DNA, 293 bp, Homo sapiens
  source 1..293: mol_type = unassigned DNA
ttcagcatctcagcttttaagcctccctgagccggggctgcgttctcgttgtctccttcggccgccgcttcctggcgccagagggaccccgcggcccgcacgggcctgtcctcggctccgctcggagggtgtgcgggttcccgctccgctggccccgcttgcccaccacggcgcgcccaaacccacgcggcccgcggccccttgcgtgctctgccgaccccgggccgcaggaggggttagcctcgccggtccccacgcggggtctgcgccggcagcgccacgggctggaacgc

SEQ ID NO: 2585 - DNA, 201 bp, Homo sapiens
  source 1..201: mol_type = unassigned DNA
cgtccccgccccggtcctccgtcggcctggcgggcggcgacgtggggaggggccgctcagaagccggggtcgcccgggccggggaacttcctcgcgccgacgcccactccccacgggccgcactcgccgaggggccgaaaggggctccagtggaggacgcggtgggagctgggtcccgctctagctgccgacgccggcggt

SEQ ID NO: 2586 - DNA, 201 bp, Homo sapiens
  source 1..201: mol_type = unassigned DNA
tatcccgctaaagccggacaaagcgtggccagagtgcggcccagcctctcagcctgcggcccggggaggagggcagcgcgggcgcgggctgggggtggcgcggggcggcgctcaggatttcggtgcaggcgagagtgcggcggatttgctccaagaggagagcgaggcggatttgctccaagaggagagcgtggggcgccg

SEQ ID NO: 2587 - DNA, 226 bp, Homo sapiens
  source 1..226: mol_type = unassigned DNA
atggcgatgcctccactctcctcggcaggttttttcaattaaaaagttggaaacgggaatccgtaaacaacgacttagggcttcaaactacttgcaaagacgcgatggggaggggaatacttgcgcgcttcaaaaccccaacctcgaggtctccagccgcgcctgacccgggagccgggtgcgcccccagtgtccgcgcacgaacccggcgccctggcagccccga

SEQ ID NO: 2588 - DNA, 363 bp, Homo sapiens
  source 1..363: mol_type = unassigned DNA
ttgcaagggaccacagttacaatttactaggtaaccacacccaccgcattgcagaagccatgaacttggcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtg

SEQ ID NO: 2589 - DNA, 201 bp, Homo sapiens
  source 1..201: mol_type = unassigned DNA
cggcccggtgggggtcccggcgagcgggagggcggttggggaccccggccgcgccgggcgcggggctcgggattcgggagaccgcgcggcgccgaagccacgcgtcagccccactgtcccgcgcgcctcgccccaggcctcgggctcttcctccgcacctcgtaaagccgagaccccctcgcagtcccccactccgagagg

SEQ ID NO: 2590 - DNA, 201 bp, Homo sapiens
  source 1..201: mol_type = unassigned DNA
ccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgag

SEQ ID NO: 2591 - DNA, 267 bp, Homo sapiens
  source 1..267: mol_type = unassigned DNA
cgcggggtgggggcgcgggagccgccccctgcccgccccgcgcgcatgctcccgccgcacctgcctcgctcagtgttccacaccccggggagccgggtggcgctgggcccgccgaggtcggggctttcccatgggagggaggtggctgcggcggaattttcagatgcgtccttctctgtattcgttccctgggaaggattcccccaaatcttggctacttcctgcctgccagcttgctccctggcagcgaagtcccagtagctcacc

SEQ ID NO: 2592 - DNA, 707 bp, Homo sapiens
  source 1..707: mol_type = unassigned DNA
gcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcgtgaccctccccattccct

SEQ ID NO: 2593 - DNA, 201 bp, Homo sapiens
  source 1..201: mol_type = unassigned DNA
ggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcacca

SEQ ID NO: 2594 - DNA, 201 bp, Homo sapiens
  source 1..201: mol_type = unassigned DNA
caggctccgcgcctgaccctccagcctgcgcagcgggcactcggccgggaagaacctctccagcaggcggctcagcactacgttcacgcgcccgcgcccgcgcccgcgcccgtggccgcgcgggccccagctccacgcagcgctcacagaccgtgagcccgcagggcagtgtcaccggcttgtgcagcagccccgggcagc

SEQ ID NO: 2595 - DNA, 201 bp, Homo sapiens
  source 1..201: mol_type = unassigned DNA
cactgggacccccacatacgagctggcacacactagtcacacacggctaattccagagggctggccctttgtcctgggacgctcccaggttttcgggccgcggtgcggagaactcaggtgggtgcccggcaagttacctaccaggggctgttcccccgcgaccctcgccataagcgcagggacccgggggccgcgctggct

SEQ ID NO: 2596 - DNA, 201 bp, Homo sapiens
  source 1..201: mol_type = unassigned DNA
gaaaactgcaaaacctgggagttatcctgcctcaccctcctgctgcctggggacaccccccgcgagcttgctcggccccgaagaaggagcagaggggacccgcaatccagcccctagagccccgccaggaaaggcgcgagagacctactggccccggcaaccctgccccggcgcccggacggagcccgatgcctgcgcagc

SEQ ID NO: 2597 - DNA, 203 bp, Homo sapiens
  source 1..203: mol_type = unassigned DNA
agcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagat

SEQ ID NO: 2598 - DNA, 201 bp, Homo sapiens
  source 1..201: mol_type = unassigned DNA
cgcgcgtttccccgcgcgtctcccggacccgcgcctgcccacccctccggctctgctgcggtcgaggccccaagtcggttatcccgtgtccaggcaaccgcgggggcggcggcggcggcgtgaggagcgggcggctgctgctccggggcctcctggctcgagcccttagcccccgactcccggcgtttcggcgcccgatca

SEQ ID NO: 2599 - DNA, 201 bp, Homo sapiens
  source 1..201: mol_type = unassigned DNA
gggcttccagcctggcctttaggcgcggtggcggcggtgggacacgcgccaggcgcccagagaaggacatgggacaatggcccagcccgaggacgccagacgccgccgcccgacccggggaaggaagctcctgcagccggtccgggaacccgaggcggggagggaggccagctctggaggtgcgctgccgctttaaaataa

SEQ ID NO: 2600 - DNA, 208 bp, Homo sapiens
  source 1..208: mol_type = unassigned DNA
gcgccgcgccgccgcccggcctcccgaagtcgccccctgtcggcgcgtcggccgcttgcgccacggcgggcgccacttaccccgggcagagtcttctgctcgtgcagcgcgctctgggccttcagcgctgactcacgctcgcagtaggtgaggaaggcgcagcctggggaggaaagcaagcgccaagaagggtcagtggggcgccccc

SEQ ID NO: 2601 - DNA, 201 bp, Homo sapiens
  source 1..201: mol_type = unassigned DNA
gtaggggggctttatccaccaagctatgctctattagggcgccaggcgggcgaagcaaaggcagggatggcgggcggggcggcggcggaggtggaatgggcgcttttttcttccatctggctttatttatttatttagactagaaaagcgagccggcttggagggagtccgcccggggatccgagcgcgcattcatcagtg

SEQ ID NO: 2602 - DNA, 201 bp, Homo sapiens
  source 1..201: mol_type = unassigned DNA
gcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagaggtatcgctttttcctttc

SEQ ID NO: 2603 - DNA, 595 bp, Homo sapiens
  source 1..595: mol_type = unassigned DNA
aggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagg

SEQ ID NO: 2604 - DNA, 201 bp, Homo sapiens
  source 1..201: mol_type = unassigned DNA
caccgccggcgccgaggcggcgttcatgtctaaccgccgccgccaccgccgccgcctgctcctgcgcccgctcccgcgcctgctgcctccccgccgccgccgccgccgccgccactacagatccgcagacacacagccaagatccctgactcttaacaccaactctcttctccggggaggggaggggacggagggaagggg

SEQ ID NO: 2605 - DNA, 269 bp, Homo sapiens
  source 1..269: mol_type = unassigned DNA
ggtgtgatgtttccggtggataatgtctcccgttccctgccccggggcccagacagttggtgcttaagcgtctacaatgtagagtttcctgcattttcctcgggccgccatttgtctacttgtcccatccaggacatctccctaaataatctctaagtggaaaaatcacggtcctctaggagatttatccgggaacgaacgtgcgtggggcagttcaaattcctgagctcagatttcgtttcccgcggtcagatggtgcggtcggtggg

SEQ ID NO: 2606 - DNA, 201 bp, Homo sapiens
  source 1..201: mol_type = unassigned DNA
tcagcttgtcaccgcacggcggccgggaccgcagcccctgggtgcgcagtgcgcctctcgctgcgccctcctagagcgcgggtcccgtgcctgtgcccggcgcgacgcgatctccctgctagtcgggctccgcgtgctccccgcgcttcccgcagcctccgcgcagcccgcagcgccctccagccccgcctcgcggccgcg

SEQ ID NO: 2607 - DNA, 267 bp, Homo sapiens
  source 1..267: mol_type = unassigned DNA
gcaggagccccggcggcctgcaggggcggtggcgcggcgctgggcgcgcggccgctagatggcagcgcagccccggcccggcccgcgggaggcggccacgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgcatttttattttcctctaaatttca

SEQ ID NO: 2608 - DNA, 287 bp, Homo sapiens
  source 1..287: mol_type = unassigned DNA
ggcggtgtgcagagtggggcctgggcctcctgcccccaagggcagctgggtgggctccgtgctccctccgagtggacttggccccggctccaaacccagccgagggtcggctcgctcctggggacccgcggatgtcgcgagggggcgccgcgccactgaaggctgggacgggggcggtgcgcggggcggcgccggagtccgggatgccggctccagagacgccgcgctccgccccgaggaggccgccggccgggtaagcggagcccggagctcgcggagtctggacc

SEQ ID NO: 2609 - DNA, 201 bp, Homo sapiens
  source 1..201: mol_type = unassigned DNA
ggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcg

SEQ ID NO: 2610 - DNA, 201 bp, Homo sapiens
  source 1..201: mol_type = unassigned DNA
gcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccg

SEQ ID NO: 2611 - DNA, 286 bp, Homo sapiens
  source 1..286: mol_type = unassigned DNA
ctcagggggcgcccccgagccgcgccccgcgcccgcccccaggagggcctccgcgagccggctgcacaccccgaggcggtcccggctgcacaacttggagcgagttgctccgtttcctcattttgggggcgaagaagggtcggggagtgggggaaagcgggaggcgccgcggcctgggaggcccccgcgggtcctagcgccggccgcactgcggtctcctccgcgcgccgccgccgccgccggcccctccccgccccgcctccgcggcccccggcgcctcccgcgc

SEQ ID NO: 2612 - DNA, 244 bp, Homo sapiens
  source 1..244: mol_type = unassigned DNA
tagtagaccctggcgtggggcacctgagatctccgccactgaaaaggcgctatagaaatgcaaggaattatgattttaataaaattgtctcatttaggagcgagcttctgcgctgcctctgtcgtcggagcccgggtttgccacggcaaagtctgtaatcagagaaaaataccagctttgttgagggttagaatatatcattggctaatgtgtgtggttttctttttaaataatgctaagcatt

SEQ ID NO: 2613 - DNA, 201 bp, Homo sapiens
  source 1..201: mol_type = unassigned DNA
gtgggccggggatctcgctgctctgccttcctagcgggaaactgactgcctgagctctggaggacaaacagagacactggggggtcaacgggggcggccgcgggcggggctccaggcctccacccaccgggttgctgagcgcgcacgcagccacccgagggaagatccccgccgcccggggtctcggagaggggttagaac

SEQ ID NO: 2614 - DNA, 372 bp, Homo sapiens
  source 1..372: mol_type = unassigned DNA
gtggcattagcgaatgtggtggactccggcaggcctggggcaggggaatctccggtaacatccctcagtaccgaaggcaggatttcccggccacttccgtcggttggaattctcttaagcattgccctgagtctattttcaaatgaaagggggaaaaacccaaaccagattagaatctgaaacagctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtcc

SEQ ID NO: 2615 - DNA, 201 bp, Homo sapiens
  source 1..201: mol_type = unassigned DNA
agtcagctccacaatctgcgaccgacttctccttgcccagttcggcctcagtccccttcagccataagatggcaacagcgccgacagccgggccccgcggcgtcctgtctcttccctgccctggcctggagccctctctgggcagctctgcacccacagcgctgcgtctctcccagattgtgcagggagcacgggagggtt

SEQ ID NO: 2616 - DNA, 247 bp, Homo sapiens
  source 1..247: mol_type = unassigned DNA
gcttccggggggtcctggcgtcttagctgtggatcccccaatacccgcaggtcacagagccacagaggctggacctctagcagcagaggacacagaagaacgaagacgagacgcagagctccaactgcagccagagacaaaggccccgccacatcccggaagccgccctgtcctctcctgccccgtgcctgattggacggtttccagcccagcgtccctgattggataacttctaaggtcctgcccc

SEQ ID NO: 2617 - DNA, 201 bp, Homo sapiens
  source 1..201: mol_type = unassigned DNA
gatttggcgcggcctttgtttctcgctgccgccgaagctccaattttcgtctgtctgctttgtgtcctctgcacgtagaagcccagcctgtgtggccctgcgacctgcgggtattgggagatccacagctaagacgccagggccccctggaagcctagaaatggtgagagtgccggtccgacatcccgagagagggaacgg

SEQ ID NO: 2618 - DNA, 201 bp, Homo sapiens
  source 1..201: mol_type = unassigned DNA
ggcgtcttagctgtggatctcccaatgcttgcaggtcagagggccacagaggctgggcctctaagagcaggggacacaaagcagggaagacgagaccaagcgctccagctgcagcgagagacaaaggccccgccaaatcccggaagccgccctgtccgctccagttgcgtgcctgattggacggtccccagctcagggtcc

SEQ ID NO: 2619 - DNA, 235 bp, Homo sapiens
  source 1..235: mol_type = unassigned DNA
cttggtcggactgcgcgcttagggcctctcgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggt

SEQ ID NO: 2620 - DNA, 201 bp, Homo sapiens
  source 1..201: mol_type = unassigned DNA
atcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgc

SEQ ID NO: 2621 - DNA, 201 bp, Homo sapiens
  source 1..201: mol_type = unassigned DNA
gggcgcggctctgggagcgggggaaggtgaggggaaatgggacatgatggcattaataatcgttaccaaagacggtgggagtaacaaaggaatgcgtctccgagacgccgcccagccccggggtgttttctggcgcggtcgcggtgcaggaacgcgagccccgccgccgagcctcccgccgcctgcgttcgttggcgcggc

SEQ ID NO: 2622 - DNA, 201 bp, Homo sapiens
  source 1..201: mol_type = unassigned DNA
gcccgggcgcgccggctggggctctggcgctctcgcaggccccgaggccgacagtcccggcgagggcgggcgccccgcgctccagcaccggctgcctgagcgctcctggagcagcaaaccccagacttcttcctccttctctccttccttccttccccctccccttatctttttctttttttagtctctttctccctcttt

SEQ ID NO: 2623 - DNA, 201 bp, Homo sapiens
  source 1..201: mol_type = unassigned DNA
tttgtttcaaaagttcacagcatgctttcttttcttttagaccgggagacagtgatctcacccacacggtaagatcaaaagtctccgctcgcccagcctgcgggcttgggctgggtccagacgtctcccaggatgcagatgcgccgccgctggcctccccggctataaagccgcctccagcgcctttccgcgcgcaggagc

SEQ ID NO: 2624 - DNA, 201 bp, Homo sapiens
  source 1..201: mol_type = unassigned DNA
gggcgaagcgacccagcgcgaggaccagtccccaaccaacccgctcctagttctgggcgccttccccagcagtcagatgggggcttcagaggccggtgcgcggccacatggccccgggccaggcagggggtcgtggggacgcatctgcgctaggcgcacagtattcctgggcgcgggacgggcgaagcgccgtgggttcca

SEQ ID NO: 2625 - DNA, 296 bp, Homo sapiens
  source 1..296: mol_type = unassigned DNA
tgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgg

SEQ ID NO: 2626 - DNA, 201 bp, Homo sapiens
  source 1..201: mol_type = unassigned DNA
agcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggc

SEQ ID NO: 2627 - DNA, 201 bp, Homo sapiens
  source 1..201: mol_type = unassigned DNA
atccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccccgcaggcgctgggtctgcagatggcgtccaggtacacagtggcgagt

SEQ ID NO: 2628 - DNA, 266 bp, Homo sapiens
  source 1..266: mol_type = unassigned DNA
gaaagataaaagggaaagcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcc

SEQ ID NO: 2629 - DNA, 201 bp, Homo sapiens
  source 1..201: mol_type = unassigned DNA
tcgcaggccatctgtgtgactccggtgcgagtggaggttggtaccgttcagtgcgaggctgtcaccccgtgtgcctgtccacgtcctgtgtgactgggtgcgaggaagtcaatggcaccgtggaatgtgaggctgtgagttgaggcgggagcgggcgactgttcgctgcaccttgttgggccgatacccgcggcttctttg

SEQ ID NO: 2630 - DNA, 228 bp, Homo sapiens
  source 1..228: mol_type = unassigned DNA
cagagttcaggacaccccaggcttttcttgactcgattggaacccaccctccacgcttccctggccccaactaaccgccacctgcatgcacaaatggaaacgacagggcagagggtcagcagtcacccgcgtctgggttcgcagctccgggtacgctgtagttccgcacccggttgcccacgcccgggaccacccactgtgtcttttcggaactgtccagcgtgtcct

SEQ ID NO: 2631 - DNA, 248 bp, Homo sapiens
  source 1..248: mol_type = unassigned DNA
agaccccagacacccaccccaaatctaggtcccagcgttttgcaggggaccttcatcctggggcgttcacctctgacttccctcttgggccttttcgctacggccgagcctaagtggctgaagcgcggacgaggatgcgcggggcctcggtctccaactgcaccacaggccgcacccacgaacctggtccggcacagttactaccgcccgggcctccaggcctcagggctgcagaagctcagtcccgg

SEQ ID NO: 2632 - DNA, 387 bp, Homo sapiens
  source 1..387: mol_type = unassigned DNA
gaggcggccaccgcagcggccgccaacgagcagctgcacggaggtgcagaagaaggaggccactgccattctcctgacaagctgggggcgtgggaggcctcgggagctcgaagtcgcctcgagcgggggtgggcggtgagcggacccccgggtgttgaccaggtgtttggtggtagagcagggaaggggggaacggacgtcgaccctagggatccctcacccgctcacgctccttggcgttggccacacgccgccgctccagcaccaactggaggttttcagtggacgagtagccgcccgagggcagccgcttgagccggcagacagcggccagctggggcagcggcccgaactgctcccgcaacacgtcctccagcacctcggctt

SEQ ID NO: 2633 - DNA, 203 bp, Homo sapiens
  source 1..203: mol_type = unassigned DNA
cgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacaggtactgcggtcccggcgcccgcacgcgggggactgggcgggggctggagagcctaggtcg

SEQ ID NO: 2634 - DNA, 203 bp, Homo sapiens
  source 1..203: mol_type = unassigned DNA
gctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgca

SEQ ID NO: 2635 - DNA, 312 bp, Homo sapiens
  source 1..312: mol_type = unassigned DNA
gccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggcc

SEQ ID NO: 2636 - DNA, 407 bp, Homo sapiens
  source 1..407: mol_type = unassigned DNA
cttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgaga

SEQ ID NO: 2637 - DNA, 295 bp, Homo sapiens
  source 1..295: mol_type = unassigned DNA
gcgcccgccccgcgcgcccctgtactccccgcgccgctcctcggggtcccgcggcgctcgcaggccgcgccgccctgccgcccctctctcgtggcttttacggcccgcccgcccctcagcagccctggggtgcccggggcggccctgcaagcgggagagagcggcgaggcggcggcgccgagtgcggggggatgcggagccgtgcccggccctgtcgcatccctcggccgcccgcccgcgcccggccccgcccggccttgcccgggctgcacgcacttctcccgcggcccagaat

SEQ ID NO: 2638 - DNA, 435 bp, Homo sapiens
  source 1..435: mol_type = unassigned DNA
cctggcccggcctggccagtccccgcggtctctgcccgggctgacgcccaggaatgtggtcgacgagaagccccaacagcacggcgtggcctctcagcctcggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccgctttctgtttctttgtgcggggcatgtgaaatgtgtggggccagaattgt

SEQ ID NO: 2639 - DNA, 410 bp, Homo sapiens
  source 1..410: mol_type = unassigned DNA
cccttggagggaagcccgccgggaagctgaagacagtggtcaccgccctcggtcattacttcccgggacccggaccctaaccctgcgccacatctccacccgcccccagccgtgtcctggctgcgcagctggaaaggttgagcagctcactgctgtccctctgttcggccttggacacatcgcctgaactcctgggcgcctctgctgttaagtgggggacagcactatttactggggaggaaaactccaggaatgtggaccctggggccacgcaggggttgggaagtgaagggcagggaacgcgggcggcgcccggggtctgcgggtaggcaggcggcctggccgcggaggcttccccgagtcctgcgccttcctagagagggaggggctcatatcggctggcacagcca

SEQ ID NO: 2640 - DNA, 392 bp, Homo sapiens
  source 1..392: mol_type = unassigned DNA
ggagcccgctgggcgcgcccggcccggcccggccccgccgcacgcccgcccccctggcctggccgaggaccccggggtttggacgtgccaacgccactctcgcgcgccgaagctgtgacggtttactaagcagagacttgcgaggcacacagagagggaatgaggcggaaccgttcgggggctcgttgacactgcagagcctcccgcagcatcgctgccttaaatcccgcctttccaggcgtgcgcgcacagcgagccagaggaggctccgtcccgacctggggtcccccgcggtcctcagcccgggggctcgggtccccgaagagatccttggcaatggcagaggtcccaaagcctagatgccaagccccgcgatggggcggatgcttcca

SEQ ID NO: 2641 - DNA, 203 bp, Homo sapiens
  source 1..203: mol_type = unassigned DNA
agagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcggg

SEQ ID NO: 2642 - DNA, 398 bp, Homo sapiens
  source 1..398: mol_type = unassigned DNA
aaaactgcgggagcccatctactgcgctcaggtggccagctcttgagccttccctatccgtggctccttgccggcatgcaggcatgcacaagcataccgccgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaaccc

SEQ ID NO: 2643 - DNA, 286 bp, Homo sapiens
  source 1..286: mol_type = unassigned DNA
tgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggc

SEQ ID NO: 2644 - DNA, 267 bp, Homo sapiens
  source 1..267: mol_type = unassigned DNA
ggctgccaaggaggcggggtggccagcgcggggggtggaggatgggggcaggacgcgggagggaagggcagggggtggggggcgaggccccggggaccagcgcgcgagagtgcccagctgggaaatgcagctccgaattaacatcgtatgtttcataatcagtttacgagccgatgtggggaaagccacttccagatggggaagagcagcccggatttccttaaggacgttcttcagccagactagggaggggagaaggagatgggg

SEQ ID NO: 2645 - DNA, 260 bp, Homo sapiens
  source 1..260: mol_type = unassigned DNA
cagagccgtctgcatctgcccgcatcctttgggaggctgcgatgatcgcagccagggtggccgagcgcccggcccactgcacccggcggctgttttgcagcgcccctggcattcagggaatggtttgcaaatctcaatgcaccacagactagttttcaccgtggagcaggaaaggcgcctattagccaggggcaaccggctttgcagacctgggcgggggcgtagggggaggggcggtggtgcaaacctatcgtgatttc

SEQ ID NO: 2646 - DNA, 239 bp, Homo sapiens
  source 1..239: mol_type = unassigned DNA
gaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcac

SEQ ID NO: 2647 - DNA, 846 bp, Homo sapiens
  source 1..846: mol_type = unassigned DNA
gctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacc

SEQ ID NO: 2648 - DNA, 526 bp, Homo sapiens
  source 1..526: mol_type = unassigned DNA
tgctgcttcctcccggcgctttgcttttctacaactggaagccgcgaaggcggctactgcgctgagccgctcgctctgctggtcaagtttgggcgacccgcgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgtgggactaagggcggcctcagagatgcccggaaaatcgctgccacggccagagtgcggcgcagacgcggcagagttggaggtgtccgcggtgcaggctgctgcccacgccgctcaggccaggtgctgagggctcagcccgcgcctcggccgaaccactctcagccccgttgagccacctcgtccgcccggctttcatcgcaccggccagaggaaagttcccgcggcccccacgcctcttcacagct

SEQ ID NO: 2649 - DNA, 201 bp, Homo sapiens
  source 1..201: mol_type = unassigned DNA
gccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaac

SEQ ID NO: 2650 - DNA, 523 bp, Homo sapiens
  source 1..523: mol_type = unassigned DNA
tgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaa

SEQ ID NO: 2651 - DNA, 276 bp, Homo sapiens
  source 1..276: mol_type = unassigned DNA
gccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcgg

SEQ ID NO: 2652 - DNA, 357 bp, Homo sapiens
  source 1..357: mol_type = unassigned DNA
aggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggat

SEQ ID NO: 2653 - DNA, 278 bp, Homo sapiens
  source 1..278: mol_type = unassigned DNA
ccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggca

SEQ ID NO: 2654 - DNA, 336 bp, Homo sapiens
  source 1..336: mol_type = unassigned DNA
gctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcacc

SEQ ID NO: 2655 - DNA, 311 bp, Homo sapiens
  source 1..311: mol_type = unassigned DNA
cgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctccc

SEQ ID NO: 2656 - DNA, 201 bp, Homo sapiens
  source 1..201: mol_type = unassigned DNA
cacaggtaacagagacaaggttaggaggcaaagcacatttatgtgcaaatgagacgcgctagggaacttgtaatcctctgcacccccgcccttgatgtctcgatccctacaatcacagaattctaggcagaggccgccgacttctccgccctcgccaagagggacccggagcaccgaagcttcccagccggtgccggcgtt

SEQ ID NO: 2657 - DNA, 201 bp, Homo sapiens
  source 1..201: mol_type = unassigned DNA
aaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggag

SEQ ID NO: 2658 - DNA, 481 bp, Homo sapiens
  source 1..481: mol_type = unassigned DNA
cgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccgg

SEQ ID NO: 2659 - DNA, 280 bp, Homo sapiens
  source 1..280: mol_type = unassigned DNA
taggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctc

SEQ ID NO: 2660 - DNA, 252 bp, Homo sapiens
  source 1..252: mol_type = unassigned DNA
cggagtctcagctacgaatcatccaatacccgcaggtcacagagcgacggaggctgaggctgtgaccgaatcaccgacgcctccctgaggggtgaaagcacggccgtggagaccctaaccgagctcacgctggcgcaaaaggcaaaagccgcgccagatcccggatgccgccccctcctctccggctgcgcgcctgattgggcagttctcaatccagcgctctgattggataagataccaagctccccacgc

SEQ ID NO: 2661 - DNA, 239 bp, Homo sapiens
  source 1..239: mol_type = unassigned DNA
ttacctgcgtgctgctctcgggccccgccccgctccgccccggagggatcctcaggccgggcccagacctaggagccacctggggatcccggggtggctgcgcgccgagggggcgccagcggggacgtgagctggcgccgagacagcctcggccccccagcgccagggccactgccaggagacccccggccagcacccacgtggggcgcccccgggagcccgaggggtccatcgcctgt

SEQ ID NO: 2662 - DNA, 405 bp, Homo sapiens
  source 1..405: mol_type = unassigned DNA
aagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccgagcagacagcggcggggcggggagcgcggggcgcgtggcttctgggtcctgcgggcccggagccccggctctgcgactccttgagcctggttgggaact

SEQ ID NO: 2663 - DNA, 237 bp, Homo sapiens
  source 1..237: mol_type = unassigned DNA
cgcgcacggtggtgtaggagccccggtagcccagcgtgaggaagcccgagcgcttgtcctgcgcgccgccgccgccgccaccaccgtgcgctcccgggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttga

SEQ ID NO: 2664 - DNA, 204 bp, Homo sapiens
  source 1..204: mol_type = unassigned DNA
cgaccggggcggccccgctcagggttcggggcagcggcggcgtcggcggcgcccgagctccatcggaggagagacgcgcgagagaggagctccgccggtgcggcggcggcaatggagaggcaagaaggagctgctgctcctttggggcgagggcggggaagtgtgagagagacttgcgagaggctctagggctgctgctcggct

SEQ ID NO: 2665 - DNA, 224 bp, Homo sapiens
  source 1..224: mol_type = unassigned DNA
aggactccccactggggctgagcccctcccgccctcaacagaacctctaaacacaagtagcctttccctgcctccaggagctcacgaaacgctgccacaccgagcgaatgcaacgcgtacacacgtccacactcgaacagcacaagcaagagaccggctgggtgtggaatagaggcgcacatcgcgcaacgcattcacagcatgcacacgcgcgcaccccgacc

SEQ ID NO: 2666 - DNA, 278 bp, Homo sapiens
  source 1..278: mol_type = unassigned DNA
gtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgct

SEQ ID NO: 2667 - DNA, 232 bp, Homo sapiens
  source 1..232: mol_type = unassigned DNA
ggtggggtaaaaagcaagacgaaacccacccagacagctcttccgactcccagaggaccgacacctctttcgagggccccaacagtggccgctcagggtccgagggcaacggccgaggcgccacgcggggccgcggctcgccctggccacggaggaccggacctgttgcgcctctgtgagtttgccttatttctacctactcggtgtctttcggcacgccgacctgtttccc

SEQ ID NO: 2668 - DNA, 331 bp, Homo sapiens
  source 1..331: mol_type = unassigned DNA
aacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagca

SEQ ID NO: 2669 - DNA, 231 bp, Homo sapiens
  source 1..231: mol_type = unassigned DNA
gcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagc

SEQ ID NO: 2670 - DNA, 201 bp, Homo sapiens
  source 1..201: mol_type = unassigned DNA
ctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggca

SEQ ID NO: 2671 - DNA, 201 bp, Homo sapiens
  source 1..201: mol_type = unassigned DNA
agcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagct

SEQ ID NO: 2672 - DNA, 219 bp, Homo sapiens
  source 1..219: mol_type = unassigned DNA
cggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcgg

SEQ ID NO: 2673 - DNA, 284 bp, Homo sapiens
  source 1..284: mol_type = unassigned DNA
gcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggcggccccacctcccccggc

SEQ ID NO: 2674 - DNA, 429 bp, Homo sapiens
  source 1..429: mol_type = unassigned DNA
tctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttt

SEQ ID NO: 2675 - DNA, 283 bp, Homo sapiens
  source 1..283: mol_type = unassigned DNA
ctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtctttt

SEQ ID NO: 2676 - DNA, 241 bp, Homo sapiens
  source 1..241: mol_type = unassigned DNA
ccgtccacaccgccttccctctgcaggtgaggaatggggtctgcttcgtttggaatgtgcctttgccgggtcctgcctgacctccaccttccagccgggacgcgcgagcttttccgtttggctgagtcaaaaagggatcgcgcgcatcccgccgcccctcaccacgaagcgcagacacaggaggttgcagggtcagtgctgcggagaatcccagacggccccacagccgccgccacccgcg

SEQ ID NO: 2677 - DNA, 244 bp, Homo sapiens
  source 1..244: mol_type = unassigned DNA
ccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgc

SEQ ID NO: 2678 - DNA, 225 bp, Homo sapiens
  source 1..225: mol_type = unassigned DNA
tcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgc

SEQ ID NO: 2679 - DNA, 249 bp, Homo sapiens
  source 1..249: mol_type = unassigned DNA
gagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcg

SEQ ID NO: 2680 - DNA, 255 bp, Homo sapiens
  source 1..255: mol_type = unassigned DNA
gtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcggg

SEQ ID NO: 2681 - DNA, 243 bp, Homo sapiens
  source 1..243: mol_type = unassigned DNA
tcagcagcgccgccgcctcccagcgccgatgcttcagccggcggggcggctgaggggtgagggggaactccgcgggcgggggcgagggagcgtgtgtgcgcgagcgtgtgcgcgcgcgaggggagcgcgtgcgcggtgaggacgcgcgccggcggttggggcgggggcgggggccggggcgctcctgtgggaagggaggggtgaaaggtcgctggtccccggcaacacggctcaggcaaacgt

SEQ ID NO: 2682 - DNA, 201 bp, Homo sapiens
  source 1..201: mol_type = unassigned DNA
tggagagaaatgagctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccg

SEQ ID NO: 2683 - DNA, 208 bp, Homo sapiens
  source 1..208: mol_type = unassigned DNA
gccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgcggcccccggggaccgcgagcaacaaaagcccggcccgcagcccctgctcctcgccttccttttcaattctc

SEQ ID NO: 2684 - DNA, 257 bp, Homo sapiens
  source 1..257: mol_type = unassigned DNA
ttcagctctccgcaagtaccttcctcgccttcctaccccccccagcccccagccgccgccgctcccgcagccccggtcccgcgcctccccgcagccccggcgcccgcctacccgccaggcaggcggtggtgtcgatccacttgagcagctgccccgcgctcagctcgccgcgcgcagtggcgtgcgccggctggatggcttggctcatgaccacctcgccgggcgccggccgctccatggccagggcgagagcgcta

SEQ ID NO: 2685 - DNA, 350 bp, Homo sapiens
  source 1..350: mol_type = unassigned DNA
gaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcacttt

SEQ ID NO: 2686 - DNA, 216 bp, Homo sapiens
  source 1..216: mol_type = unassigned DNA
accaaattaggggctgggagtttccagattgaaatgcgccctccaccaccaagagggagctcacgcggccgcggggggccgaggcagccagccggcgccgcggtcctggggagtccgtgcaggggtgtgctctggtgtgaaacctggcaggactctgcctgggcttgcatgcagggaggggttagagactctgaaatgtactagcgggcagggtgg

SEQ ID NO: 2687 - DNA, 269 bp, Homo sapiens
  source 1..269: mol_type = unassigned DNA
ggcattgctgcccgaacgaacgaacgaacgaacgaacgaagcggtttcgtttaggaaaaataccctcttgacgcgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcgg

SEQ ID NO: 2688 - DNA, 258 bp, Homo sapiens
  source 1..258: mol_type = unassigned DNA
agatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgct

SEQ ID NO: 2689 - DNA, 224 bp, Homo sapiens
  source 1..224: mol_type = unassigned DNA
tgtgctcccctcttcctcctcctcctcttcctccttcgccgcttcccctcctcctcccactcttcctttttgctcgccttttccctcctcctcgcggccgcggctcggatagaggttacccagcgccctcccgtagctctccggagagcatgtgaccaggccgttagcagcgccgcgagtgcccggcaatggcagggatggtgcctcaaatatccctggaagct

SEQ ID NO: 2690 - DNA, 256 bp, Homo sapiens
  source 1..256: mol_type = unassigned DNA
cgccatcccgcgccagtgcctgagctgcaactgcaaactgcgcgtcctggcacgagcagcggtgggggcgggtgggggaaggagcgagtgactctccaggcgtcttccgctacctgacaccagccaggcagcccccagggccagagcgtcagcgccgaagccaggctcatccgggaagccactccggtggccgcggggtgcccatgccagcaccagatctctcttcggaaggaggagcggggcgggctacacggcc

SEQ ID NO: 2691 - DNA, 310 bp, Homo sapiens
  source 1..310: mol_type = unassigned DNA
gggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggag

SEQ ID NO: 2692 - DNA, 410 bp, Homo sapiens
  source 1..410: mol_type = unassigned DNA
aggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccgcgcgcacgaaccgggtagtgtgcgcgtgtgtgtgctcgcgtgtgtgagcgcgtgtgccagcgtgcgtctccgcgcgggcgtgcgtctgggtggatcctt

SEQ ID NO: 2693 - DNA, 274 bp, Homo sapiens
  source 1..274: mol_type = unassigned DNA
ctggggccagtcccccctccccaccgccgccgcctccccacccactccgcgctcaccccacaaccactccgcctggtctttccccggccccacctccatgcgctcctactactctttcaaacactgcagcaagttgcagcaaggcgggcaaataccgacagcgcgcgtgggggcgggcggcgggcgccgcggggcccaccccctccccggtctccccgcgccctcgccgcctcccgcgctggctctcaccgcatgagcagcgttccctcggtct

SEQ ID NO: 2694 - DNA, 201 bp, Homo sapiens
  source 1..201: mol_type = unassigned DNA
tctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggc

SEQ ID NO: 2695 - DNA, 265 bp, Homo sapiens
  source 1..265: mol_type = unassigned DNA
ctcccgtggcaggcggcagcgagctgggcccggggccgggctgagctttgggaccgcgctgcgcagcccccgagccgttcgctacctggctgcggtcgcgcggccacctgtcctccgccctcggggcgccgcccagcttcgcgccaggcgccttctccagcgcccgccgccctttcccggcgagaccactcgggcgcgccccgcccgccggtccccgatgcaaacagttgggctccgtaggcggctggctccgcgcctcccggcc

SEQ ID NO: 2696 - DNA, 201 bp, Homo sapiens
  source 1..201: mol_type = unassigned DNA
accaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgc

SEQ ID NO: 2697 - DNA, 362 bp, Homo sapiens
  source 1..362: mol_type = unassigned DNA
cctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaa

SEQ ID NO: 2698 - DNA, 298 bp, Homo sapiens
  source 1..298: mol_type = unassigned DNA
gtccccgccccccaccgccccctcccgctccgcagcccccgagtggcgtcagcacgcccgccgggcatgggctttaaatgcccactagcgggagctcaggcgcttctgccctggagcgcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctg

SEQ ID NO: 2699 - DNA, 295 bp, Homo sapiens
  source 1..295: mol_type = unassigned DNA
gagcggcgcggagagcggcaggggcgaaacttcgcgggccagatgcccgagggcgcggcggcgctgccaggctgccgctgctgcccctgcgggccccgagcgcgcctccgcaggcggcactgcccgcggcgcggcgtgtgcaccgagcgagtgaaggtatgtgtggcgggcgcggctggagctgccgccgccgccgccgccgcgccagcaggtcctaatgcctgtcacttcccaggacgctggcagcagcagcagcccggagcccccgagccctcggcaggtttgcgtgtccttc

SEQ ID NO: 2700 - DNA, 203 bp, Homo sapiens
  source 1..203: mol_type = unassigned DNA
cgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatcc

SEQ ID NO: 2701 - DNA, 215 bp, Homo sapiens
  source 1..215: mol_type = unassigned DNA
cgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggct

SEQ ID NO: 2702 - DNA, 201 bp, Homo sapiens
  source 1..201: mol_type = unassigned DNA
ggaggctgcagccgctcgagtcggcccgggtgggggcggggtgggggcggcgcggagggcacggagattacggcggcgccacccgggacatccagggccccgaggccctgggcggtccccacgcgagatcgcaaaccatgacaataggcagtcacccgaggtcaaataaaaacggagtgggtcccccgcgcgccgccgccc

SEQ ID NO: 2703 - DNA, 340 bp, Homo sapiens
  source 1..340: mol_type = unassigned DNA
ggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggg

SEQ ID NO: 2704 - DNA, 201 bp, Homo sapiens
  source 1..201: mol_type = unassigned DNA
agggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgcc

SEQ ID NO: 2705 - DNA, 236 bp, Homo sapiens
  source 1..236: mol_type = unassigned DNA
cctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgtt

SEQ ID NO: 2706 - DNA, 251 bp, Homo sapiens
  source 1..251: mol_type = unassigned DNA
gctcctcagctccccgcgcaccctcctgcgctcgggccccgtcgtcccgctcagtgctggctacgggtcgtgtcactagcctgtgcgtcctcgtcactcgcgggtcggggcacttggcgccctgtgtgggtggcgggagcggggacgcctcggtgcccggggaccgcagcgcgctggcgtttaactttgccgtcgcccgccttggagtcgggaggctccagccgtctaagtgtcccgggagattcaggcac

SEQ ID NO: 2707 - DNA, 201 bp, Homo sapiens
  source 1..201: mol_type = unassigned DNA
ccccgcccccgccccatcccccaccggcgcaggttcaggccatcgctgccaggaccccccgctgtcgccgccccccgccccctccactcagactctgagtcgcccactccagccggtgcaggccgcggggccgcctctgatggcctgggcaccccccactcccgccccgttcacgaccaccgcggctgcctgagctgctca

SEQ ID NO: 2708 - DNA, 206 bp, Homo sapiens
  source 1..206: mol_type = unassigned DNA
gtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggtcgctgccgcagcccgcacgctgccccgtgcctccgagaggtcccttccccagcgc

SEQ ID NO: 2709 - DNA, 201 bp, Homo sapiens
  source 1..201: mol_type = unassigned DNA
ggccgccgctcacctcgcgtatttcgtcttctggaaatccagcagccggggggcgaacatcgcggcgcttccatgggaatctggccccgggctcagagcgcgggtagctggcagagcctggggggcgcggcggcggcagcagcaggttggagggcgcgcggcgggggccaaggggacctggtcggcgcccggagccggagc

SEQ ID NO: 2710 - DNA, 203 bp, Homo sapiens
  source 1..203: mol_type = unassigned DNA
gctgtaaccctgggcctgggattgcggggacgggacgggtgggaagcggccaaaggcgcagcggcttctggtcagagccgcagaggcctgagacgtgggccgcgccccggcccaggagaccccgcggccgcgccctaaccctcagtctcccgactgcgactgcgacccgggaaaacgcctacgtttttggaaaggaagtccca

SEQ ID NO: 2711 - DNA, 216 bp, Homo sapiens
  source 1..216: mol_type = unassigned DNA
ttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctccccta

SEQ ID NO: 2712 - DNA, 335 bp, Homo sapiens
  source 1..335: mol_type = unassigned DNA
agtgccggagcgctcggtggccgccgcgccgcgcgcctggagggatgctaacgtggagccggcgccgagtccgcccggcgtgcgtgcgtgtgtgggagcgcgcgagtcccctgacgcggggaccagttatgaatcgggggtgtgtgtttgcctccagagacctggcaaggtgcggagccctccagaagtgcggtcaagcggcagcggagacggcgagccaggaacctccccccgcgtccccagcttcccagcgtggcggcggaacccccggagaaagtttgcaaacttccagcgggcgcggcgaggacgccgggtcacctagggggcgggtgggc

SEQ ID NO: 2713 - DNA, 230 bp, Homo sapiens
  source 1..230: mol_type = unassigned DNA
gagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgg

SEQ ID NO: 2714 - DNA, 224 bp, Homo sapiens
  source 1..224: mol_type = unassigned DNA
cagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgct

SEQ ID NO: 2715 - DNA, 211 bp, Homo sapiens
  source 1..211: mol_type = unassigned DNA
ggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgttcgaagccattcgcgcgggcagtccctgcgtgtccccctgcgtgtccc

SEQ ID NO: 2716 - DNA, 205 bp, Homo sapiens
  source 1..205: mol_type = unassigned DNA
cgtgtaatccgatcccttctgactcacaagccctgagtgacagttctgatttggttcaaccgcgggagggaggggaaagagaaagaaagaaacccccagccgtacgcctctcctggcatccaatcgactttctggaaaaaggtcccatcccggcctggtgccccgtgctgggtggagaagccccccgccccgacctggcaccgcc

SEQ ID NO: 2717 - DNA, 398 bp, Homo sapiens
  source 1..398: mol_type = unassigned DNA
ctccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcc

SEQ ID NO: 2718 - DNA, 290 bp, Homo sapiens
  source 1..290: mol_type = unassigned DNA
acagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttacgcgcgggtcccgcagcgccgcggccgagccgggctgcccggcccgcggacacagcgccggccgccgcatcccgtgcggggccgcggcgcgatg

SEQ ID NO: 2719 - DNA, 307 bp, Homo sapiens
  source 1..307: mol_type = unassigned DNA
cgtgaaactgtccaatcaagtgcgcagctacagaggaagaggcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatggtgagtgcgtggagtgggtgtcccgagaatggggaagaggctgtttgaatccggccggaaccggctgcggtgg

SEQ ID NO: 2720 - DNA, 212 bp, Homo sapiens
  source 1..212: mol_type = unassigned DNA
agtgctgccaggcggaggctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccaccccc

SEQ ID NO: 2721 - DNA, 375 bp, Homo sapiens
  source 1..375: mol_type = unassigned DNA
tggctcctgagcagcatcgcccagtgcagcctccgtcaggaaaagcagcagaatcgacagccccagggggcgagcggggtccatggtgcagggggtcgggcggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctg

SEQ ID NO: 2722 - DNA, 201 bp, Homo sapiens
  source 1..201: mol_type = unassigned DNA
ggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactgcgctccatgccgcc

SEQ ID NO: 2723 - DNA, 356 bp, Homo sapiens
  source 1..356: mol_type = unassigned DNA
ttggagacgccgggacggaggagccacgcggagagaaggcgagaagaaggcggacgggagcggaacgggctcgggagcgggcctgggagcgggcccccgccgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccgccccgctccacaccttcttaaagccccgggcgccgcgtcccccccgccgccgccacacgtgtcccggccgctcccccgcccccgcgcgccgccccgccc

SEQ ID NO: 2724 - DNA, 265 bp, Homo sapiens
  source 1..265: mol_type = unassigned DNA
gccggtttctttgtctgagccggctgcgtcccgcgcccctcggggctcgcagtctgccagtccgggcggcccgcactcgttctgggaatccgcccgaggccgcgaaccgctaggggccctcgcgctcccttcccacccaggccccctgtccctcccgccgcggccgcccggcccctcgcggcagcgacagagcctcatctgtagaggattttaaaatgagattaagcgaaagtggaattggcagactcgagtggtgcctggaaat

SEQ ID NO: 2725 - DNA, 697 bp, Homo sapiens
  source 1..697: mol_type = unassigned DNA
gaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgc

SEQ ID NO: 2726 - DNA, 226 bp, Homo sapiens
  source 1..226: mol_type = unassigned DNA
tgggaggagcgcagacacctttcggtgatagggagggcttctcacttggctgttacctggaagtccacagtggccccggcgggcaggcgggcgggcagagcgcgggtccgaacgcccttcgcgctcgcggcggcgcacgtgcggcggcggcggcggcgccggcggcgcgggcgggacccactgggtggccgcgcgcgccacccgcgcgttttctgcgcgcctctgc

SEQ ID NO: 2727 - DNA, 201 bp, Homo sapiens
  source 1..201: mol_type = unassigned DNA
ttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctaga

SEQ ID NO: 2728 - DNA, 201 bp, Homo sapiens
  source 1..201: mol_type = unassigned DNA
tacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaag

SEQ ID NO: 2729 - DNA, 215 bp, Homo sapiens
  source 1..215: mol_type = unassigned DNA
ttgtccttcagtcagaacgtgaatgtactgctgacgcatactgttctgggagaagattagcgtgatgcagtgctcttatgtattagcgccgctccccctccgtcgcctgcctcgcggggttaacgccggcgccttccagcgccgcgccggccggcgccgcgcagccccgcgcctccggccgcccgtcttcctctttcctccttccttcctcctct

SEQ ID NO: 2730 - DNA, 252 bp, Homo sapiens
  source 1..252: mol_type = unassigned DNA
tgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcccgagcagcggcgg

SEQ ID NO: 2731 - DNA, 203 bp, Homo sapiens
  source 1..203: mol_type = unassigned DNA
cgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgcc

SEQ ID NO: 2732 - DNA, 201 bp, Homo sapiens
  source 1..201: mol_type = unassigned DNA
cggcggcacccggcgcagaggctccagcgcggggagccgggctcagccccggcctgccagcgccgcggtcctagcccacccgaggccggcctggggggcccgcagggcgcgcggagcgccgagtgcgcgtcgggctgggccccgcaccccggtgcaggagcgcgggcgcggcgcggcggagcgccccgcatggagccggcc

SEQ ID NO: 2733 - DNA, 201 bp, Homo sapiens
  source 1..201: mol_type = unassigned DNA
gctgaacaccgcccgggcccagtccccactccgcggtttggtgaagttggtttccgtgcctgcttgggaagcccctgcctggggataatcgtcaggtcctcgagtcgcttcccccctaccttccgctgcgtcggcaaccttatcctcccgtcctcattaacggatcggcactcaaatcaaagcccagccctctggggttca

SEQ ID NO: 2734 - DNA, 201 bp, Homo sapiens
  source 1..201: mol_type = unassigned DNA
ccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttat

SEQ ID NO: 2735 - DNA, 213 bp, Homo sapiens
  source 1..213: mol_type = unassigned DNA
cagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgg

SEQ ID NO: 2736 - DNA, 385 bp, Homo sapiens
  source 1..385: mol_type = unassigned DNA
tcatcccctgcttgtctaagccggctggctctcgtgactgactcggaacaacagagcagatgtttgcgtgggaggcaagcctcacccaacatctgtcctgcggcgggaaggcctgggtgttcacagatagagctggagttccccggtgggtggcacagacaattagctggggctgcctcacatgtaatctaattacaggggaaacaggctcaaacaccgggtgataagcagcgcaactgtttcgggtgactctgtaatttttcctccattaattttctccataacgcacatgattgtcataagggttaattaaaaagagcgtgagtggcctcatgtcacatgtagctggaccagaaagtgttgagtacctgctcatgcgtgcaag

SEQ ID NO: 2737 - DNA, 278 bp, Homo sapiens
  source 1..278: mol_type = unassigned DNA
ggcactgcggctcagcccccgcccggggactcgcgggccgactgtggccccttctggggaagccggggcgcggggaggcgttccgggcatctcagccgcacggggtacgctcgccctcggcggggcccctcgctccgctgtgggagtggcagtgggtgtcggggtggagaaagtacgcgtggcgcggagtcctggggacgcggcgtcccacccgctctggggagccccggactctctccagcttccaggctcgcatgcccctcttttcttagtgccct

SEQ ID NO: 2738 - DNA, 248 bp, Homo sapiens
  source 1..248: mol_type = unassigned DNA
acgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccga

SEQ ID NO: 2739 - DNA, 216 bp, Homo sapiens
  source 1..216: mol_type = unassigned DNA
tataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcga

SEQ ID NO: 2740 - DNA, 201 bp, Homo sapiens
  source 1..201: mol_type = unassigned DNA
tgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgc

SEQ ID NO: 2741 - DNA, 208 bp, Homo sapiens
  source 1..208: mol_type = unassigned DNA
cgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcg

SEQ ID NO: 2742 - DNA, 201 bp, Homo sapiens
  source 1..201: mol_type = unassigned DNA
tcaggagcccggatccttgcccagcttcttggcggagccaagttcgagcgcacagatttcccgagctccagcggccagggggcactgtgtgagcggctgacgtcacccctccgcccggccgaaaccaggcggcgggatcccacacagttgaggagagggagccgaggccgtgacttagggctggcgacgattaaaccaagt

SEQ ID NO: 2743 - DNA, 364 bp, Homo sapiens
  source 1..364: mol_type = unassigned DNA
gccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccgaatgctctcagtgtctgtaattctttaagaagttcctagagcagacagcccttggatcgtgggcacttctccccggggacggggaccctgctgaccgcc

SEQ ID NO: 2744 - DNA, 213 bp, Homo sapiens
  source 1..213: mol_type = unassigned DNA
gcccagcctctccccagcatgtaaagtcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaa

SEQ ID NO: 2745 - DNA, 201 bp, Homo sapiens
  source 1..201: mol_type = unassigned DNA
tctcctcgtcacggcaacccaactggaggcagaagccggcggggcggccgagcggggcggggcgggagcgcggccgccgcgagccacggtggggagcgggcgcgggggaccctggcgggccccgggcagcgcggctgcacttacttgtgtcacaactgcggcgacggggggctgaggaaccggttcttccaaaagcaaacc

SEQ ID NO: 2746 - DNA, 201 bp, Homo sapiens
  source 1..201: mol_type = unassigned DNA
ctctgggcggctgcagaggccggccgtccggtttggctcacctctcccaggaaacttcacactggagaggtaagggcgattctaaaatgcatcgctgagtcgtcaagctgccaccctttcctatctccctttgccttcttaaactgtacttaaaaaaaaaaaaaagccaactgtacagagtggttgggcgcgatgggtggg

SEQ ID NO: 2747 - DNA, 296 bp, Homo sapiens
  source 1..296: mol_type = unassigned DNA
tccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatg

SEQ ID NO: 2748 - DNA, 201 bp, Homo sapiens
  source 1..201: mol_type = unassigned DNA
ccctgcctggcggctcctgcgcccggggctgctgagcccggggttcgtcctgaggccgcggctgtggttcctggccctcccggcccgcgtcactgtcgcgcggcgcccgctgcatcttgccttccttgcggcttcgcatgcccttggtggaacccagctcggcggacgacgaggaggatgagatggaagcctgctggaaac

SEQ ID NO: 2749 - DNA, 297 bp, Homo sapiens
  source 1..297: mol_type = unassigned DNA
ggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgca

SEQ ID NO: 2750 - DNA, 268 bp, Homo sapiens
  source 1..268: mol_type = unassigned DNA
tcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcac

SEQ ID NO: 2751 - DNA, 201 bp, Homo sapiens
  source 1..201: mol_type = unassigned DNA
ctgagcagtcgaagggacaactagacagtcatagacagacagacggccagcccgagcctcgggcaggagagaggctgcgaggagcagcccatgcttgccccgctcagccctcgcgctcccgggctgcttttttaattccgacccgcgcacgctgcgagtccccggcgctgtcgtccagccggaggggcagtcccgctcctt

SEQ ID NO: 2752 - DNA, 201 bp, Homo sapiens
  source 1..201: mol_type = unassigned DNA
cgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttgg

SEQ ID NO: 2753 - DNA, 201 bp, Homo sapiens
  source 1..201: mol_type = unassigned DNA
ccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggc

SEQ ID NO: 2754 - DNA, 201 bp, Homo sapiens
  source 1..201: mol_type = unassigned DNA
tttctcctcctcgcgcatctcgtggtccgactcgagggcgtcgaacacggcggcgcccaccagcaggtaggtgaaggtgcagacgatgagggacagagtccgcacgttctgcctcttcatggccgccagcaaggagccggcgcggggggcatgtcccgcaggctcacagccgcgcgcgtcccactgcagcgcccggcggcc

SEQ ID NO: 2755 - DNA, 302 bp, Homo sapiens
  source 1..302: mol_type = unassigned DNA
cgcccacccgggcgcgcgggtgcgcagcggggtccccgccgggcgtcggccggtgcgcgaagtttgctcggctcaacccccaaggcgcgggagcggggcgcggccccaggacggcagggaccgcgatggagcggcttcgggggcggccgggggacggcgcggtggcggtcggccagcccgctcctccgggggcggcgggcgcggcggcggcggcgggaggggtcccgcgggcctcgcggagcagcggggcggacgcgggcgcatgagccgcgcgggggtcggggccctccggcgtccgggcg

SEQ ID NO: 2756 - DNA, 201 bp, Homo sapiens
  source 1..201: mol_type = unassigned DNA
tcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagg

SEQ ID NO: 2757 - DNA, 220 bp, Homo sapiens
  source 1..220: mol_type = unassigned DNA
gcggggcgggcgactgccgggccccgggccagctctcgccccccgccccgcccccgatcgctcggctcccccgcccggcgctccctcgggctgcgctccgcggctctcggcggcggcggcggcgggcgcagagcgcggcatgggcgcccgggccgcggggcctggcggcggcgggcggacgggcgcgcggctgcgggcgcaggtgcggggcggcgggccg

SEQ ID NO: 2758 - DNA, 347 bp, Homo sapiens
  source 1..347: mol_type = unassigned DNA
caccgtcccgggtgcggcggctccaagcggagacctgagcgcggcgggccgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgcc

SEQ ID NO: 2759 - DNA, 201 bp, Homo sapiens
  source 1..201: mol_type = unassigned DNA
tggcaccaggcttccccatgggcaccggagcaggcggacaggggtggggtcccgcgagcgacacggaagggtcagtgtggcggagcggaccctgtggaggcggggtcactgtgctcctgagaagggtcctcgggggtggagtctatcaaggttgcgggggcgtggtcacggagcggagccaataaaagcggggcgtgcacg

SEQ ID NO: 2760 - DNA, 201 bp, Homo sapiens
  source 1..201: mol_type = unassigned DNA
cgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctg

SEQ ID NO: 2761 - DNA, 225 bp, Homo sapiens
  source 1..225: mol_type = unassigned DNA
agtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttttttttttttagatggagtctcgctcggttgcccaggctgcag

SEQ ID NO: 2762 - DNA, 318 bp, Homo sapiens
  source 1..318: mol_type = unassigned DNA
gctgccaactcattcgggagcccggggcatgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcc

SEQ ID NO: 2763 - DNA, 265 bp, Homo sapiens
  source 1..265: mol_type = unassigned DNA
aggaaggggagcgcagtctgcagactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccac

SEQ ID NO: 2764 - DNA, 259 bp, Homo sapiens
  source 1..259: mol_type = unassigned DNA
cggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggccc

SEQ ID NO: 2765 - DNA, 201 bp, Homo sapiens
  source 1..201: mol_type = unassigned DNA
gacggggcaccggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctc

SEQ ID NO: 2766 - DNA, 323 bp, Homo sapiens
  source 1..323: mol_type = unassigned DNA
cccccgcgacctcaccggggaaacaccgcggacagtcgggccagcagcgcccggagctcactccaggtctccaaacttgcagcacttcccagagcgcgcgcgctcggagcgggacctgcttgctccagtgcacgccgcggagcgaaccatcgggctggcgggggtggaggggtgcaggcgtgggggctgcgggccgctcgggccttgggcttctcctgccgccgccgccgcctcccgcccccggccaggagtcgcgcgtgacgcggttcgccgcaggagcctcgaaggcgcggcgccggcgagcccttccccggcaggcgcgt

SEQ ID NO: 2767 - DNA, 201 bp, Homo sapiens
  source 1..201: mol_type = unassigned DNA
agccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctg

SEQ ID NO: 2768 - DNA, 355 bp, Homo sapiens
  source 1..355: mol_type = unassigned DNA
gcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctg

SEQ ID NO: 2769 - DNA, 201 bp, Homo sapiens
  source 1..201: mol_type = unassigned DNA
cccgcgcggagcgattgtgaggggctctgctggaatttggcagcgcggaggcttggagagaagccccatgctggctcccattcagccggcccgttttcctcgagctttggaagtttcactcagccgtgcactcaatggcttcacaaagctgattacaagcttcagcgcattcctgaaggagccaaaagcgacgcaggtgca

SEQ ID NO: 2770 - DNA, 290 bp, Homo sapiens
  source 1..290: mol_type = unassigned DNA
gacaccttgtggagcaggtggcccaggctgccgggcccatcgtcgggcgccttgcgcagcgcctcgccggacaccaagtagggagccgccgccggggtcgcgcgcgccgccgaaaccttgcctccgccgccgctcaccgacaggctgtggagaaggtcatcgaccgatgtcaccgagtcattcctgaagcggttatacttggtgcgtggaagcatgcccctccgtgggctcgctgcatccgcccgggcgctgctggtgccggccccggcgcgggctgccgcgcatagcag

SEQ ID NO: 2771 - DNA, 201 bp, Homo sapiens
  source 1..201: mol_type = unassigned DNA
tagagactgtagcttccgccgggctggatgcgagtctcccaggttagagcccagaagcgcgctgggacctgggtctggcttttgggtctgtgtccttcctcgtttggccccaattgtccgcattcaagatcataataaaaaggcttaggaagtaaacttcttggacgcggaagggccggctcgcgggtttccgccgagtga

SEQ ID NO: 2772 - DNA, 201 bp, Homo sapiens
  source 1..201: mol_type = unassigned DNA
agaggccggcccgccgcgcgggagacactctttccaaagtggaagcgctgcgtgggcagcagcgcgggccgggccctcggatcccagtctctgttgctcccgagacccccgccccgcgccgcatcctccgagctcagcgccctcgggctgcgctgggcgcagtggctcccggtcagggcgcagtcggcctgggcgctagag

SEQ ID NO: 2773 - DNA, 288 bp, Homo sapiens
  source 1..288: mol_type = unassigned DNA
cgatgtagctcagaatccgcgatccagcccggtccaccacagccttcagcagcgacactcgcagcctccgacctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggc

SEQ ID NO: 2774 - DNA, 212 bp, Homo sapiens
  source 1..212: mol_type = unassigned DNA
tcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaagg

SEQ ID NO: 2775 - DNA, 201 bp, Homo sapiens
  source 1..201: mol_type = unassigned DNA
agtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctc

SEQ ID NO: 2776 - DNA, 246 bp, Homo sapiens
  source 1..246: mol_type = unassigned DNA
gcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccccggagcgcaggcggcggctcgggcgggaagaggcgctgggcggccggactcgcagaggggcgtgcgcggagctgggcg

SEQ ID NO: 2777 - DNA, 201 bp, Homo sapiens
  source 1..201: mol_type = unassigned DNA
ggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatccctgggagg

SEQ ID NO: 2778 - DNA, 201 bp, Homo sapiens
  source 1..201: mol_type = unassigned DNA
ggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggt

SEQ ID NO: 2779 - DNA, 358 bp, Homo sapiens
  source 1..358: mol_type = unassigned DNA
gacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttag

SEQ ID NO: 2780 - DNA, 201 bp, Homo sapiens
  source 1..201: mol_type = unassigned DNA
cggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagc

SEQ ID NO: 2781 - DNA, 201 bp, Homo sapiens
  source 1..201: mol_type = unassigned DNA
gcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcg

SEQ ID NO: 2782 - DNA, 201 bp, Homo sapiens
  source 1..201: mol_type = unassigned DNA
agagagaatccgaggctgtttctgccgctgaaatctgagcgggagagcatcccgaagccgcctgcgtggagcgagcagcccccgcgtcatgggccagaggcgcccgggagaatctgcgggtcacggatcacacccgcaggggcctggcggagcaaggtgccgttcgccgcctgcgggcaggagccggctctgggcctcggc

SEQ ID NO: 2783 - DNA, 277 bp, Homo sapiens
  source 1..277: mol_type = unassigned DNA
ccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccct

SEQ ID NO: 2784 - DNA, 201 bp, Homo sapiens
  source 1..201: mol_type = unassigned DNA
agtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtg

SEQ ID NO: 2785 - DNA, 247 bp, Homo sapiens
  source 1..247: mol_type = unassigned DNA
gcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggc

SEQ ID NO: 2786 - DNA, 201 bp, Homo sapiens
  source 1..201: mol_type = unassigned DNA
cccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcg

SEQ ID NO: 2787 - DNA, 201 bp, Homo sapiens
  source 1..201: mol_type = unassigned DNA
cgccaggcccgcccccgcccggccgcccgcccgcccggtgggtcgcggtggccgcgggctgcgctgcgcgggccgggcctggcgggccgggggctgcgcgcgtccgcgagggcgcccgacgcgggctgaggggcgctggcgtgtgcccgcaggcggccctgcgcgggggacggcgcgctcctggacaccgccggcttcaag

SEQ ID NO: 2788 - DNA, 201 bp, Homo sapiens
  source 1..201: mol_type = unassigned DNA
cccccgagctccgcgatccctccgcctaccggggaaggagacctcagcgtcgctgtcctgcccctcctgaacgctgtccttgtccgacttggagccgccgcgggagcgcttcatgttgcggaaatactgcccccagcgctgccggccggcgtccttcttcagcctcttctccttggcccggcggttctggaaccaaacctg

SEQ ID NO: 2789 - DNA, 356 bp, Homo sapiens
  source 1..356: mol_type = unassigned DNA
aacacggagcacgaacataagcaggtaccgcacatctgcgagctattcgggtctccgggggaaggcaaaaagccccaacaagccttaagtaagaccaggacgcttctatagttttgctttgacagctaaggaaaaaatctgccaaaaaccagaggcgctgctgagtgttggcgtgggaatgctagtttagtcagagccttgctctgggccatttaaataaaaacagacatgttggtggcaaatgccagttgaacacgcaggagagcggtgcttctcgggcccggagaagggtttgcagctgcactctctcttcccttttctcttggcctccccagccttcttatcatcacgatcag

SEQ ID NO: 2790 - DNA, 201 bp, Homo sapiens
  source 1..201: mol_type = unassigned DNA
tcaacgcctgcctctacttcaagtcctgccacagctgctacacctactactgctcgcgcctgtgccgccgcgaggactgggacgcccacaaggcgcgctgcgtgtacggccgcgtgggcagcgtgtgccgccacgtactgcagttttgccgcgacagcggcccggtgcaccgcgctttctcgcgcatcgcgcgtgtcggct

SEQ ID NO: 2791 - DNA, 281 bp, Homo sapiens
  source 1..281: mol_type = unassigned DNA
agcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagccc

SEQ ID NO: 2792 - DNA, 222 bp, Homo sapiens
  source 1..222: mol_type = unassigned DNA
gcccaggtcacacaccagatcccactggggatgtgagaagggtgcagcgggcgtgaggccccgccctcgccgctctctgcccgcccccagacccgcggcccgcctggccgcctcacctggccgatggcgttggtggtgagcacaggaaggccattatagtcccaatccttgaggcaatggttgaagtccggcggggcgaagccgctgcacgaggggtcggta

SEQ ID NO: 2793 - DNA, 237 bp, Homo sapiens
  source 1..237: mol_type = unassigned DNA
cgggcctggatcaggacggcgaggcgggccggcgcgcgcgcgaggtggccttcatccacatccagcgcgagctgcggctgcgcggcgtcttcctgcgccacgagttcccgcgcgtctacgagcagctttgcgagttcgtcgaggccaacaggcgcttcacgcccaccaccatctaccccacggaccggcgcaccggccgccccttcatgtgcatgatcatggccgcctccgagccgc

SEQ ID NO: 2794 - DNA, 201 bp, Homo sapiens
  source 1..201: mol_type = unassigned DNA
cctggttcctcaatctagcagtgcttttgaatgaacgtgtgacagcttaatgaagcagccgagtaccttgatttgaatgttggagccggggttcacagggggctgtattagtcagtacaggctgggttatgccactgtgacaaagagccccagatctcaaaccccgtccttgtgggtcagctgaggtctctgttccaggcc

SEQ ID NO: 2795 - DNA, 364 bp, Homo sapiens
  source 1..364: mol_type = unassigned DNA
gcttcaccagcctcccggccgagcggaaggcgccggcgcccagctgggtcaagttgttgtagctgaggtcgaggaacacgagcttggccgagccgctgaacgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcggtcgcggcagtccacggtgtgcgggtcggtgcaggcgcagcccgcggggcacgcgtgcccgggcgcgagcagcagcagaaggctgcagagcccgagcgc

SEQ ID NO: 2796 - DNA, 201 bp, Homo sapiens
  source 1..201: mol_type = unassigned DNA
gaaattaacccgctagaaaaatctcttgggagaggcgggagcggcaggggtggccgagtggccgtcgccaaaacgcggccccaccctggcagctgatttccgagatctggcagtaagacgccgcgcgcaccgggcgggctgcactcgacgtctaagttcagctaccaagcccaggagcggtttccctaaggcgtgtcccgg

SEQ ID NO: 2797 - DNA, 201 bp, Homo sapiens
  source 1..201: mol_type = unassigned DNA
gcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggc

SEQ ID NO: 2798 - DNA, 201 bp, Homo sapiens
  source 1..201: mol_type = unassigned DNA
aggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcgg

SEQ ID NO: 2799 - DNA, 222 bp, Homo sapiens
  source 1..222: mol_type = unassigned DNA
tgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgct

SEQ ID NO: 2800 - DNA, 201 bp, Homo sapiens
  source 1..201: mol_type = unassigned DNA
gacaataagatctgttattgacgccaccgggttggtgatacttaggtacagcagccctagcaaacgaatacacccccatgagaactaagctccctgagagcggtaagctgccttgtcttgctcacagctgacaagaacacgcctgtacggtcacttagcacctagtactgccatttaaccgtttcactagtatgtatgaac

SEQ ID NO: 2801 - DNA, 265 bp, Homo sapiens
  source 1..265: mol_type = unassigned DNA
aggcgcacacgaggagcccggcccagtattcccaaaccagactccggaggcgccgccagggagcggtcatcgttgggcgccgccgagcgtgcccggggcgcggccgtggcgggctccctggggcggcagctctaggcgcgggcgcgcagcagccccgaaggcgccgcctggcccagccgcccggctcccgagcgccgctgcaagtggggggcgccccgcggcgccgcgcacatcttactggggggccgccccgccggcgcccgcc

SEQ ID NO: 2802 - DNA, 242 bp, Homo sapiens
  source 1..242: mol_type = unassigned DNA
ccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggc

SEQ ID NO: 2803 - DNA, 201 bp, Homo sapiens
  source 1..201: mol_type = unassigned DNA
ctccagggcgcagggccacgagctcccgctcccaccctcggcccctggcacccggcgccggctccgccgccctctctcacacgcacccttggcagggccccgcggggcgccccaaagcttgggggcagctcccaggtgtctctgggaagggaaagaaaggccacaaagcaaaagaaggagcaaagagaaggcgagggagga

SEQ ID NO: 2804 - DNA, 261 bp, Homo sapiens
  source 1..261: mol_type = unassigned DNA
tcgcccaccgatgagccgccgccgcccgcgcccgggtgcaggtgcgccgccgccgcgtgcaggccgcccgcgtgtgcatgtccgtgtgcgtgtccgtgggcgcccagatgcggcggcggcgacggctccagctgcgcctcgtggccatcctcgtgcagcgcgtggtgcaggcccggccccgcgccgccaccgcccgccgccagcatcccggccaggccgccgccgccgccccccgggtaggccgcctgcgcgtacagcccg

SEQ ID NO: 2805 - DNA, 201 bp, Homo sapiens
  source 1..201: mol_type = unassigned DNA
cggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggcacgctggcctgcgcgggtcccc

SEQ ID NO: 2806 - DNA, 337 bp, Homo sapiens
  source 1..337: mol_type = unassigned DNA
gaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttac

SEQ ID NO: 2807 - DNA, 201 bp, Homo sapiens
  source 1..201: mol_type = unassigned DNA
tgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggcggccctcgcctgcgcctttgcgcgccacccaaaactt

SEQ ID NO: 2808 - DNA, 201 bp, Homo sapiens
  source 1..201: mol_type = unassigned DNA
cagtaggcagtgcgggcacagtgttgcagaccaccacctcgccaggtccgggcagcgcccactagacggacaggcgcccgcggccgcccctaccccggcgcgcccacctcgagcctctcacgccgcggcgggcgggcgcaacatattctcctacctccagccgccgaggaccacactctccgctcagccctctcgactcat

SEQ ID NO: 2809 - DNA, 201 bp, Homo sapiens
  source 1..201: mol_type = unassigned DNA
ccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgc

SEQ ID NO: 2810 - DNA, 201 bp, Homo sapiens
  source 1..201: mol_type = unassigned DNA
gctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggc

SEQ ID NO: 2811 - DNA, 386 bp, Homo sapiens
  source 1..386: mol_type = unassigned DNA
tgcttgttgaaaaacaacattgtgatcacttccagcggcgaagggtgtgcttgggaacggtttggggaggggacagaagagagaggggtgggatggacggcggcagaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgaggtagtataaggtttgctatccttccacttgctggcagttgcagaagaagatctgctttttaagtgaaacgtacatgccacc

SEQ ID NO: 2812 - DNA, 201 bp, Homo sapiens
  source 1..201: mol_type = unassigned DNA
aggccacataggggccgggtgcaggccccacgcggaaaggcgcgcagtgctcggggtccatgccggctcagggcgcacaggcctccggggctccggggctcgcgctgcccgcgccgcctgtgagcgcccgccaagggggagggacctgggcgcgggggcgcggagcccccgggagcggcgcgcgccgcggggggcgggggg

SEQ ID NO: 2813 - DNA, 201 bp, Homo sapiens
  source 1..201: mol_type = unassigned DNA
tgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgcccc

SEQ ID NO: 2814 - DNA, 309 bp, Homo sapiens
  source 1..309: mol_type = unassigned DNA
cctgggccgcggcggttcccacctcgccaccgccgccgccgccgcacggctgcccgtcgcgaacaagcaccggcaccaccacgcgacgcagcaggccgggcgcggcgtgcagctcggcggatgctgccaggtcaggcgactccgccgcccctggagcgcgagcgcgcttcagcttgtagcgatgattctggaaccagatcttgacctgcgtgggcgtgaggcgaagcaggctcgccagctgctcgcgctcgggcgcagacaggtaccgctgctgccggaagcgccgctccaactccagcgtctgcgcct

SEQ ID NO: 2815 - DNA, 203 bp, Homo sapiens
  source 1..203: mol_type = unassigned DNA
caccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgct

SEQ ID NO: 2816 - DNA, 388 bp, Homo sapiens
  source 1..388: mol_type = unassigned DNA
accgggaagcagcccggtgttccaagccttttgagattctccggacctgcgcgccgcccgctcggcagggggctcggcaggcgcgggcggcgggtgggggcgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccgagcc

SEQ ID NO: 2817 - DNA, 241 bp, Homo sapiens
  source 1..241: mol_type = unassigned DNA
gagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaact

SEQ ID NO: 2818 - DNA, 232 bp, Homo sapiens
  source 1..232: mol_type = unassigned DNA
gggctctttatctgcattttctcataaaactgccgtccgtgtgtgtttctgcgcctggcctcttgcatttctaaggggcctttgaagacagggccgaatgcgcgcgggggcttcaggcactttgcgctccacggcgggtcccgcagcccggcccgagccggccctggaagcttcgccctggactagactggcaccgacgccgcccccagcctgagcgctgagagggaaaacg

SEQ ID NO: 2819 - DNA, 214 bp, Homo sapiens
  source 1..214: mol_type = unassigned DNA
gaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggc

SEQ ID NO: 2820 - DNA, 250 bp, Homo sapiens
  source 1..250: mol_type = unassigned DNA
agcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcg

SEQ ID NO: 2821 - DNA, 201 bp, Homo sapiens
  source 1..201: mol_type = unassigned DNA
ccaggaccctgcagacccggccgcggccgggccgagtgcctcccgccggggccttacgcccacggtccacgcttgcaacaccagggctgtacggcgggtccgcagctgggtctgcgcctgggactcggggctccctgcgctcctcgtgccgcaccccttgccttaaccccaagcggacgggtcctggggcttcaccggcca

SEQ ID NO: 2822 - DNA, 467 bp, Homo sapiens
  source 1..467: mol_type = unassigned DNA
tcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggccgtttcccatcttcgcttcgcgtccaaagtgttgggtcataatctggatttggaggcaaacccttgccagatcctctccacgccgcttctcccccctctcccgccggtgcccgg

SEQ ID NO: 2823 - DNA, 201 bp, Homo sapiens
  source 1..201: mol_type = unassigned DNA
ctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcg

SEQ ID NO: 2824 - DNA, 232 bp, Homo sapiens
  source 1..232: mol_type = unassigned DNA
ctggggtgctcccaggaagtgaaggaaaaggtccccgacgacattgtcactggaaaagtgctggccacggcctccgccttaccctctccacccacgggttcggagcccccaggagcagtcagaccgatcaccgctcctgcagcctcatttgtttccggagagacacccacaagccagcccacggagagtctggactcgcccgccccagcacccacgcctcccccgcgcccgg

SEQ ID NO: 2825 - DNA, 222 bp, Homo sapiens
  source 1..222: mol_type = unassigned DNA
ggctagggacagcaaaggagacacgggtgggtgagacgccggaccctacgagggcctgctgcccttctggcgcgggcgtggaggcactggccagagggcacgcccactagcccgagactttcgggatgaggccatttcctgagtccacatctggacatccacctctccgaatgcggtgacctcattcataccacagcggtcatcagcgggcctgagatcgtg

SEQ ID NO: 2826 - DNA, 239 bp, Homo sapiens
  source 1..239: mol_type = unassigned DNA
ggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcccggtcgcggcgagactcacgcctgcggtgtgctagggcggcggcgacggtgacgggcgtggggcgcggcgctg

SEQ ID NO: 2827 - DNA, 209 bp, Homo sapiens
  source 1..209: mol_type = unassigned DNA
cgccccgggggtccctgcaccctagccggggaatgctgccaccctgaggggggctgtctggctgcggggcgccggggctgggggtactgctcccccaggacgcggctccgcagtgcagagcgccgccgcctgcgtggggggatctggcagcttcaggggctgccctgagctccctggcgagcaggagtgagctgctgcggcgagtgagc

SEQ ID NO: 2828 - DNA, 380 bp, Homo sapiens
  source 1..380: mol_type = unassigned DNA
gaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcgcctcccgggctttttctttctccccgctcacatgccttctcattactcctcttcctctctcccattgcactttgatgaaatggttttgtctgtctaaac

SEQ ID NO: 2829 - DNA, 394 bp, Homo sapiens
  source 1..394: mol_type = unassigned DNA
cgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggcc

SEQ ID NO: 2830 - DNA, 201 bp, Homo sapiens
  source 1..201: mol_type = unassigned DNA
cttcgtccgggtccctcaaacatgtcgcagcgtggctgctcactgtcccctctgggcaagaggaggccccagacatttccacgggatctgaactcccgagcgccctgcacggagcagccatcccgccagcaccccaaagtgaagctgctcacaacggacaagcccggagaccccatgagaggccggggtggagaagccggg

SEQ ID NO: 2831 - DNA, 557 bp, Homo sapiens
  source 1..557: mol_type = unassigned DNA
gtcgccatcgttcagcctcgctgcccaggtgggaggggtcacctgccgcggggtctccaagccagtgccgcttgctcccggcccccacccactgacagcacggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccg

SEQ ID NO: 2832 - DNA, 212 bp, Homo sapiens
  source 1..212: mol_type = unassigned DNA
agctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccag

SEQ ID NO: 2833 - DNA, 201 bp, Homo sapiens
  source 1..201: mol_type = unassigned DNA
tttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctatt

SEQ ID NO: 2834 - DNA, 201 bp, Homo sapiens
  source 1..201: mol_type = unassigned DNA
tcctggacaacaatgcgcgcccccgcccccccagaaagccagggacgcccccagtcgccgccagagctggctcggcttcccagcccctctccgtggcacccgcaggcgagacaaagttcgctcccggtgaggctgcgcgcgtccaaagcgtgcgggatgcccagcacggaggtccccaagcgggggacccctggctccccc

SEQ ID NO: 2835 - DNA, 294 bp, Homo sapiens
  source 1..294: mol_type = unassigned DNA
ggcagatgacgattcgccgagctcgccgcctgtcctcccggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacgcagaccacccagccacaccacaactctgcctgcggagagaggagaggagaaaaaggggccgcttcaaaaactttcaaa

SEQ ID NO: 2836 - DNA, 244 bp, Homo sapiens
  source 1..244: mol_type = unassigned DNA
tagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcc

SEQ ID NO: 2837 - DNA, 303 bp, Homo sapiens
  source 1..303: mol_type = unassigned DNA
ggtctggggccatgggaacaggatcaaggccccctgagcgccgggcctggcttctgtggcttcgcaaacttttcagcctgtgtgccacggcgacgcgcagcggctgagtcggagcccacgcggcgcgcgcctcccgcgaggaacttttcggcttgtaggctgcttgtcactctcgctttccgacgcgcctccccctggctcgcgctcccggagttccctcccctcctggcgaggacctttcccggcgcccgcggctccgatccccgccgcgctgcgcccgctctcccggccccggctgccccg

SEQ ID NO: 2838 - DNA, 286 bp, Homo sapiens
  source 1..286: mol_type = unassigned DNA
aacagatccccgagctgaaaaaacaaaaacaaactggggagccagagcccctgaaagctccggtaggaaattcaatgggcctcctgttcctttaaactctcgctttcgcccccgctgacactttgcaaagccgcggcggcagcggcggggaccacgctgcggtgcaccaccttccgccaccctcccgcgctgggctggggtcgagggggcttcgcagagtcggtaaccgaaccggctctggtttgctttctccactccctagccactaccagaaccagcctccgcg

SEQ ID NO: 2839 - DNA, 261 bp, Homo sapiens
  source 1..261: mol_type = unassigned DNA
tggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccc

SEQ ID NO: 2840 - DNA, 201 bp, Homo sapiens
  source 1..201: mol_type = unassigned DNA
gaacgcgcagagagttccttggagtgccctgattttgtccccgagagggcccccaacctccgcatcctcttagtggctgtcctggcaggtgcgcgtcctgcggggagttgcgccccgggggctatcgccgagcgggagctgcctcctggaaccctgcccaccgcgaactgggtgcctactccccatttctgcctttcagtg

SEQ ID NO: 2841 - DNA, 201 bp, Homo sapiens
  source 1..201: mol_type = unassigned DNA
tcgcgtctcagcaccgagtgctccaagccctgcgcgcagcgccgggcttggaaggcggcgaatggctgcctagccgccgcccctactagtgacactcggccgccagcccccgcccaggatgtgcacatctgctggcagcactggcccgggtggcagtcaccgggccacccactccacaggtacaaccgcacccaatccaac

SEQ ID NO: 2842 - DNA, 201 bp, Homo sapiens
  source 1..201: mol_type = unassigned DNA
gcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttg

SEQ ID NO: 2843 - DNA, 201 bp, Homo sapiens
  source 1..201: mol_type = unassigned DNA
ccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcg

SEQ ID NO: 2844 - DNA, 201 bp, Homo sapiens
  source 1..201: mol_type = unassigned DNA
tgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcg

SEQ ID NO: 2845 - DNA, 201 bp, Homo sapiens
  source 1..201: mol_type = unassigned DNA
ctgcggaggggccggtgggtcagagccaggccaggcagttgctgagccttcccctcccctcctggcgggagtgtgtgtgcaaggggccagggggcggagtcggagaaagggttgggggtgtccgtgtccagcgctcctccggacgcggctccacaatccagctgcgagaacagatggacgcagcggcggctcacctcgggg

SEQ ID NO: 2846 - DNA, 201 bp, Homo sapiens
  source 1..201: mol_type = unassigned DNA
cgcggctccccgtgggctggccgggccaatgagcgcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgc

SEQ ID NO: 2847 - DNA, 201 bp, Homo sapiens
  source 1..201: mol_type = unassigned DNA
ttcgccgatccccagaggcaccggttgcgcttcctggtggcttggaacggcgcggagggcaagtttgctgtgacttgtcacgaccgcaccgcgcagcagccgcagcggcgcgagggggcccggctggggctggagcacaagcccgaggccgccgtgtccccgcccagctgggccggccggctctcggccgcggggttccgc

SEQ ID NO: 2848 - DNA, 344 bp, Homo sapiens
  source 1..344: mol_type = unassigned DNA
gccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaag

SEQ ID NO: 2849 - DNA, 201 bp, Homo sapiens
  source 1..201: mol_type = unassigned DNA
atccctccccgcggcgccccctcgcgcagcctccagactgttcagccggtgtccgcgggcgctcgctctctgcgagccccaggttcgcgcgagttgcctgcgggaggggtcggggacacggacagacgctgccctaccagggattcggaggacctggtgggcaagagcatgacccagcgactcccgcctcgggcaagcgcc

SEQ ID NO: 2850 - DNA, 218 bp, Homo sapiens
  source 1..218: mol_type = unassigned DNA
attattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccg

SEQ ID NO: 2851 - DNA, 234 bp, Homo sapiens
  source 1..234: mol_type = unassigned DNA
gcgcgccccgtgcgcccccgccccccgcgcgcccccggcccatccccgtccctggagagctgtcgcttgcgcccgggcgcgcggctggctgcctcctcggcggcggcggcggcggccccattagcggagcctccgcctatgattggcttcgcccgggaagctggagacgggcgatgaataattgatgtgtgcggtgcggtagccggacggcggcggcggtggcgggcagcagcg

SEQ ID NO: 2852 - DNA, 201 bp, Homo sapiens
  source 1..201: mol_type = unassigned DNA
cgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctca

SEQ ID NO: 2853 - DNA, 201 bp, Homo sapiens
  source 1..201: mol_type = unassigned DNA
agccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggcggcccaggtgttccggcgtgcgcccccggccctgact

SEQ ID NO: 2854 - DNA, 235 bp, Homo sapiens
  source 1..235: mol_type = unassigned DNA
ttccgcggcctgggggacgggagaatggggggtccacggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgc

SEQ ID NO: 2855 - DNA, 201 bp, Homo sapiens
  source 1..201: mol_type = unassigned DNA
atccgtccaccttctacccctggctcatccaccgctaccgatatctgggtcatcgcttccaaggtacgtgccacgtcgcggaactgcagcgcgccgctcccgccgcatccttcactgcccccggcctgctccgggtgggcgcttggcaaggcctgggcggaggttcctccggctcgcgggccagcgcgccctgttgggaaa

SEQ ID NO: 2856 - DNA, 241 bp, Homo sapiens
  source 1..241: mol_type = unassigned DNA
gccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggact

SEQ ID NO: 2857 - DNA, 201 bp, Homo sapiens
  source 1..201: mol_type = unassigned DNA
ggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtc

SEQ ID NO: 2858 - DNA, 201 bp, Homo sapiens
  source 1..201: mol_type = unassigned DNA
ggccggcgcgcgtgggccccggcgaggcggcgctgcaggagctttgcgggcagctggagcgctacctgggcgcggcggcccacggctgtggcggcgccaccgtgcgcgacgctctcttcgcggctaagggccgcgcggccgactgcgagagcccgcgcgagtttcgggagcgggccctgcgcgcctgatgggtcgaggcgg

SEQ ID NO: 2859 - DNA, 217 bp, Homo sapiens
  source 1..217: mol_type = unassigned DNA
ccggcggcgagcgctgcaccatcccacgcgggcgccgagccggggccgggcgtcgcgaccggagggatttcctgcctcggcgagtcagctccggagccctcgcgcagcgcccgcgccgccgctgagctcttctagcctttcatttttaaaaaagtttccccccgtgtgtgtgcgtgcgtgcgcgcgcgcgcgccgttctggcacaagccagccttga

SEQ ID NO: 2860 - DNA, 201 bp, Homo sapiens
  source 1..201: mol_type = unassigned DNA
cagggtcccgaccctccgtggggtacgcgcgacttcggcgcagatgtcagtccgctgccttccgggttgagggagcgaggactccagacgaccccagggccgctgtccaggcccagccccgcgttctccacctcgccacctcgctctgcggctccagcctggagatctacggacttcattgcgatctcttgcgcagtgtag

SEQ ID NO: 2861 - DNA, 201 bp, Homo sapiens
  source 1..201: mol_type = unassigned DNA
caaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctc

SEQ ID NO: 2862 - DNA, 201 bp, Homo sapiens
  source 1..201: mol_type = unassigned DNA
tgcagtccgcccggcggcgttttcgggcgagggtctggtgctggggagcgagcgcggagcgaggtgtctctttaaatacgctctgcagtgtgacggcggccgcccggctggaagagccatccccaccctgcggcaggagcccgcccgccgccatcgcccgccccggtccccatggttacgcgcctgcctccggccccgggt

SEQ ID NO: 2863 - DNA, 317 bp, Homo sapiens
  source 1..317: mol_type = unassigned DNA
cgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtg

SEQ ID NO: 2864 - DNA, 221 bp, Homo sapiens
  source 1..221: mol_type = unassigned DNA
tctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacgcatcttcacctccactgtcgggagttgacctgctcctcccgcgtggttacccgtcgctgtaaat

SEQ ID NO: 2865 - DNA, 201 bp, Homo sapiens
  source 1..201: mol_type = unassigned DNA
ccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccac

SEQ ID NO: 2866 - DNA, 201 bp, Homo sapiens
  source 1..201: mol_type = unassigned DNA
gcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggc

SEQ ID NO: 2867 - DNA, 201 bp, Homo sapiens
  source 1..201: mol_type = unassigned DNA
gagccccacgccgccgccgccgcgccagcggtggggggcgggctgggggcggggcggccggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggt

SEQ ID NO: 2868 - DNA, 201 bp, Homo sapiens
  source 1..201: mol_type = unassigned DNA
gggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgca

SEQ ID NO: 2869 - DNA, 230 bp, Homo sapiens
  source 1..230: mol_type = unassigned DNA
ccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagg

SEQ ID NO: 2870 - DNA, 201 bp, Homo sapiens
  source 1..201: mol_type = unassigned DNA
gcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtc

SEQ ID NO: 2871 - DNA, 201 bp, Homo sapiens
  source 1..201: mol_type = unassigned DNA
ccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcg

SEQ ID NO: 2872 - DNA, 201 bp, Homo sapiens
  source 1..201: mol_type = unassigned DNA
gcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagca

SEQ ID NO: 2873 - DNA, 201 bp, Homo sapiens
  source 1..201: mol_type = unassigned DNA
aagctcctatcccttggacccgggcctggcgcccccgcccccggcgcgtcctcacccggcggacgcggccgcgcacaaggcccagcacggcccgcgtccccgcagcccggccgcggttgaacatctccagcgcgaagcgggtgggcgccagcagctccggggacggcggcccccaggcctgaaagctggcggctcggggct

SEQ ID NO: 2874 - DNA, 201 bp, Homo sapiens
  source 1..201: mol_type = unassigned DNA
ggttccccagcctgggccaggccggggcgcgtgtctcgggccccctgtggctgcaccgcgcgccctgtgcccacgggcgaaggcgctggaattcggcgctcggagcccgagtttctgaaggcgggaggcggcgcccgacctcaggggttgcgctgggctgccggagccaagagtgtctgcgtccccagccccgcgtcagaa

SEQ ID NO: 2875 - DNA, 201 bp, Homo sapiens
  source 1..201: mol_type = unassigned DNA
tcagagtgtgactgagcgggttggcccggcggccgttgccccccgcccccgccccttcgcgcctggccgcgccactcactgtcgcgggtgtccgcgtgcgcgccgccgatgcggccgtcggggagcgcctggaggtggaagccgatgcccacgttgcagtagagccgccgcagccgcttgatgcccagcaggtagtcgccg

SEQ ID NO: 2876 - DNA, 201 bp, Homo sapiens
  source 1..201: mol_type = unassigned DNA
cattcagaaaatggaaagctgagtggtcgatgaaccggaactgggagcagctttctatgaatcagagaaaatgcaagttaaaaggagacaccatttcccacgcattagactggtaaatatcaggaaataccaagtcttgctgaggaggaggggcccagggagttctcacaccatgtgggtgggattgtaacttggtacaac

SEQ ID NO: 2877 - DNA, 201 bp, Homo sapiens
  source 1..201: mol_type = unassigned DNA
tctccgggacggacgctccaggcgcggcgccgagtggaggcgagggggctgcggagggggaaggggccacgcgggccacggggtttaacccctgactccccgcgacgccaagaatgcaggagggcagagttgagggagacctcaggtggaactttcaggtggggaaggctgagctgtcggggctgcgggtaccgggaaggc

SEQ ID NO: 2878 - DNA, 201 bp, Homo sapiens
  source 1..201: mol_type = unassigned DNA
ccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccgggg

SEQ ID NO: 2879 - DNA, 268 bp, Homo sapiens
  source 1..268: mol_type = unassigned DNA
gcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagct

SEQ ID NO: 2880 - DNA, 614 bp, Homo sapiens
  source 1..614: mol_type = unassigned DNA
agagtcatcctgcccgttgttctggatcttgaaacttgggagacccacaccaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcgccgcctgcgcgtggcgcagttaatttgggtaagggaagaccgtttggtccacagctggctggaaagcccaggcccccggcggcagcagccccggccgat

SEQ ID NO: 2881 - DNA, 201 bp, Homo sapiens
  source 1..201: mol_type = unassigned DNA
gggcaccagctccgagctcaggccccactcccgggcggttcgggacgaatcccctctacaggccagtgtgtgtgcagggcaagtgtagggggctgaggggcgctggcggggaggcagtagaggtggcctggaccatcttggcgcggcgcgcggtgagcgcgaggattccgccagtgggagtcgctgagctaaagtgcatct

SEQ ID NO: 2882 - DNA, 201 bp, Homo sapiens
  source 1..201: mol_type = unassigned DNA
ctcgcggcgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggcttagcctcttgtaaaggaagcagggc

SEQ ID NO: 2883 - DNA, 201 bp, Homo sapiens
  source 1..201: mol_type = unassigned DNA
ttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgc

SEQ ID NO: 2884 - DNA, 201 bp, Homo sapiens
  source 1..201: mol_type = unassigned DNA
cgctcggccgccgcctccagccaactcgggtccctcccacggcgaccaatcagtgcgaagctggctgggcgggaagccgcgagaggcttttattgcggcgcgggtggcggccaggagctgccaggacagtctcccggtgcttcagcctaacggtctcgctcactcaccgccaagagaaaccccgccctgcggccggtcccc

SEQ ID NO: 2885 - DNA, 201 bp, Homo sapiens
  source 1..201: mol_type = unassigned DNA
cgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggctt

SEQ ID NO: 2886 - DNA, 261 bp, Homo sapiens
  source 1..261: mol_type = unassigned DNA
ggaccggcggtgacaccggagctcgccgtgcgctcccggccgctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgc

SEQ ID NO: 2887 - DNA, 201 bp, Homo sapiens
  source 1..201: mol_type = unassigned DNA
cggccagggcaacagccagggcaaagggagagagaagccgccccggggcgagaaggagaaaagttagagggctgaacaggtgacgctgagcttgttggagcgtgtgtgctccaccacgcaagggcgcggagttcggccgcctcatctcccgccatctgcgcgcccgggggcacgtcctctgcgatagcctggaacccagac

SEQ ID NO: 2888 - DNA, 201 bp, Homo sapiens
  source 1..201: mol_type = unassigned DNA
gggcatcggtgccgacgccgcgagggcagcgcccgcggcgggaatactaatgcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggcc

SEQ ID NO: 2889 - DNA, 201 bp, Homo sapiens
  source 1..201: mol_type = unassigned DNA
cctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctctcctgccagcgcgcccagctgtcccggccgccgccacgcgggactgcctg

SEQ ID NO: 2890 - DNA, 201 bp, Homo sapiens
  source 1..201: mol_type = unassigned DNA
ggaaaatagggcatccggagtgcaggagattcctcagggccgcccccttctccgggggtgccctgaggaaccgcggcggggactcgccgctggcagcctgcgggtcctggtgccagcgcgcatgggcgggctgtgcggacgtggctggtcctccaaaggtttcagatcccgtccgggccgctcagtcccttaaagctgtgt

SEQ ID NO: 2891 - DNA, 219 bp, Homo sapiens
  source 1..219: mol_type = unassigned DNA
ccccgggccaggaagctgtcaggcaggggagggccagcgccagctgtggacgttccgggacagcccctcaccccagtccctgtccctgccctcggcgcggcgcaaacgcaaaagcctccgtggccgcagctccagccccggtggccgcccgacccccgtcgggaccccggctgcacccactggagaagcggcggctccgactcccgaggaggcggcggc

SEQ ID NO: 2892 - DNA, 268 bp, Homo sapiens
  source 1..268: mol_type = unassigned DNA
cctaccactgcctcttcctcccgctctctacctccctgcagcgccaagccggctccccaacctggtctgctgaacgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctga

SEQ ID NO: 2893 - DNA, 201 bp, Homo sapiens
  source 1..201: mol_type = unassigned DNA
tccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcc

SEQ ID NO: 2894 - DNA, 517 bp, Homo sapiens
  source 1..517: mol_type = unassigned DNA
cagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcggcagcggagggcctgagtggaaaaattcttattggatgcactttttaatggttggtttgcctcggttttcgtccgagtcttccccggcagtaggcgctg

SEQ ID NO: 2895 - DNA, 226 bp, Homo sapiens
  source 1..226: mol_type = unassigned DNA
cgcgctctcccagccgcggccccctcccccgccgcttcctcttgctctcccagccccttcccccacgtgtggatgacgtcaaaattccgcgaaaaagccgcgtggtggctccccgagcggaggcgcgattccgccgcccagcggccccctcccgggggcgcctggagggggagaagggcggaggcggccggttccttctcctcccgggaggcaggaccccccgacg

SEQ ID NO: 2896 - DNA, 201 bp, Homo sapiens
  source 1..201: mol_type = unassigned DNA
tttccgggaggcgagccgcgggctgctgggcgcggaggctggagccgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggt

SEQ ID NO: 2897 - DNA, 212 bp, Homo sapiens
  source 1..212: mol_type = unassigned DNA
tcccgggcgtctggcatcctcccctaccggggccccggcggcgcgcggcgtctgcccggaggggggctcgggcatggtgctgcggcagctggacccgccgcgagctccccgcgctccgccgccgcctgcgccgcggagttggcccagctgcaaataaacagcagtccccccgcctcccccggccatcgccacctcctccgccccactgcgca

SEQ ID NO: 2898 - DNA, 388 bp, Homo sapiens
  source 1..388: mol_type = unassigned DNA
ccctcccggttacctgtgctgcttccgccctggctgcccctgtcccgagggaagatgcccgagcacttctcccactccacctggccggcgaagcacagctcggtgacgatgtgcagagccttctggcacagactgttcactccgtcctccttgtggaaactcatcgtttggcttttctttcgttttctctttttttcccagttagccgtcttttcctcttcccgtacctctaacccctctggcgccctaagccatagtccgcccgcggtgactttggctggagattgcgccgctgagagccggcaactcttaggagccccacgttggccccatggcgggagcggagggcgtaggggaaggagaggcgcgcgaggaggctgcggctgcc

SEQ ID NO: 2899 - DNA, 201 bp, Homo sapiens
  source 1..201: mol_type = unassigned DNA
ctcctggatgccaaacccggtctagggagcccaggagccgttgcagcctcagctcttctccctccctctctcgatgacccgggcaatgccaacctcctttcgggattgaaagctctaaatccaaggtgctaagttgatgggcggtctttgctctcacccctcgatttcgggcgcgtgtcttgaaagacaggagagaaaaaa

SEQ ID NO: 2900 - DNA, 201 bp, Homo sapiens
  source 1..201: mol_type = unassigned DNA
ccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtcacttgagcaactgatgggcttccaggggaagtaa

SEQ ID NO: 2901 - DNA, 212 bp, Homo sapiens
  source 1..212: mol_type = unassigned DNA
cccgccgcttcccccccaccccgccccccaccgccgcccttagccctcccccgggatgagagagagtcgcgctgcggagcaaccccagtggatgggtccgcgggggctgagcgggcggaggacgcgggaactccgtgacaccgaccagctgacgctgcccgcgtgaaaccagagccgggcatcagggcctcatctccactgtctctgcacct

SEQ ID NO: 2902 - DNA, 250 bp, Homo sapiens
  source 1..250: mol_type = unassigned DNA
caggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggg

SEQ ID NO: 2903 - DNA, 488 bp, Homo sapiens
  source 1..488: mol_type = unassigned DNA
acacgccccccgccagcctgggcgccgggctccgaacccccggtctgcaaacttgcgcatctcccctcgccgcgcccgccagacaacttggcgaacagctcgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcag

SEQ ID NO: 2904 - DNA, 201 bp, Homo sapiens
  source 1..201: mol_type = unassigned DNA
ggctgaggagaagggagggagagcagagggaggggggaacccggccgggggaggaggagagaggcgaggaggcggctctggcagcgcgcggcggcggcggcggtagcggcagcagcagcggcggtgcggagagcttggactgggagcccaaagctcggctgggcagcgggagaggaggagccgcaggagctgcagctctgc

SEQ ID NO: 2905 - DNA, 364 bp, Homo sapiens
  source 1..364: mol_type = unassigned DNA
tctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctccggtgcgcgcaggccccaagcccacatgcgcagt

SEQ ID NO: 2906 - DNA, 220 bp, Homo sapiens
  source 1..220: mol_type = unassigned DNA
gcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacac

SEQ ID NO: 2907 - DNA, 201 bp, Homo sapiens
  source 1..201: mol_type = unassigned DNA
ccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgc

SEQ ID NO: 2908 - DNA, 201 bp, Homo sapiens
  source 1..201: mol_type = unassigned DNA
ggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcaga

SEQ ID NO: 2909 - DNA, 201 bp, Homo sapiens
  source 1..201: mol_type = unassigned DNA
gtgtcggcctccgaacgcaccccgaggcggggtgagggctggcagtcgcccctgcacccgccgctgcgagccgcgcccctcaaacccaggtatgggacctcggaaaatcgacccgctgccctgagtgctcaccacgtgaggaactggagtggccgagttcgccaaggcgccggggacacctgagcagatgagaactggagc

SEQ ID NO: 2910 - DNA, 358 bp, Homo sapiens
  source 1..358: mol_type = unassigned DNA
gcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggt

SEQ ID NO: 2911 - DNA, 201 bp, Homo sapiens
  source 1..201: mol_type = unassigned DNA
ggagcccccgggcgcgccctgggcgcattggggaggtccccgggcgggcaggcggacgccctggggcggcgggcggcggctgccggggctcgccggggctcggccgcccgctgcccatcgataggtattaggaattgatctcgccgctgctctttgttcggttcagtcatcgattagctgccgcgaccatggagaagcgct

SEQ ID NO: 2912 - DNA, 328 bp, Homo sapiens
  source 1..328: mol_type = unassigned DNA
cgcagggagggagggggcatcgcctgtttctctgctcgaaaggtggaggtaaagagggatcccggaccccagagaggcttacaaccttccataagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggag

SEQ ID NO: 2913 - DNA, 201 bp, Homo sapiens
  source 1..201: mol_type = unassigned DNA
cgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctc

SEQ ID NO: 2914 - DNA, 319 bp, Homo sapiens
  source 1..319: mol_type = unassigned DNA
tggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctatggtaccaaaaaaaaaaaaaaaaaaaaaaaaaaaaaaaaaaaaaaaaaaagaaggagaaggcgaccggcgaaagcaggagggaaaaagcaggcggcggcgggcgggcaagcaaaagcgcgagggagcgcgcggagtgtctgggtggacgtgtgtgtgcgccc

SEQ ID NO: 2915 - DNA, 201 bp, Homo sapiens
  source 1..201: mol_type = unassigned DNA
accgcgggaggagagcgcaaggaggctcctcgcaaagttggaggccaggccggagcgatgttccgggagcggagccctcccagcctcgggcccccagccgcggacagctggcagtgccaaagactccgccattacctgcggctcgcagttgcgattcggccgcagagtcgggcaccgaggaaggcgtaaagttgagcttgg

SEQ ID NO: 2916 - DNA, 370 bp, Homo sapiens
  source 1..370: mol_type = unassigned DNA
agggcggcccggggtgggggcgcctcacctttgccctccatggcgtgcacgaagtccccctggtacagctggctgcgaagcttctcctccaggctgaagccgcggacgctgacgatctcctccacgtccgacaagtcctcgttctcgtcgtatcgctggcggtcaatcgggcgctgcgaggacccaaaccagagagcccgggacattattgtgggggctggaggtcgcctctcaacctgggcccagcactaacaggtgcagcagccgagcgccccctgcaccccaccattgcaacccaagcaactttgcgcaattgccaaagatgctgaaaagcaggacaaggagaggggcccgcaccccgagggtccag

SEQ ID NO: 2917 - DNA, 201 bp, Homo sapiens
  source 1..201: mol_type = unassigned DNA
gctatgttggaacttggaggggaggggggatgctggagaggcacacggtgatggacatggaaggacccgggaggtgtggagtggtgggcccggcccgtcgcgggaaggacacagagggacataggctgccctggagaggcgctttcggacatctggaggggcgcatagtgctgggacttggcggcgcctggggcggagggg

SEQ ID NO: 2918 - DNA, 201 bp, Homo sapiens
  source 1..201: mol_type = unassigned DNA
gtcccccgcccccacgccgcagcccgggccagcggggcccgccgcggtggcgttcgcggatgctgccgcattggccgctgcggcacggacggcgcagcctcgggcgcggcccggcacaggcgccggcggtccccgccagctagcagcccggcgaggcgctggcccacccatggtcctcgggcggcggcccctgcgcccagc

SEQ ID NO: 2919 - DNA, 201 bp, Homo sapiens
  source 1..201: mol_type = unassigned DNA
atccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcac

SEQ ID NO: 2920 - DNA, 263 bp, Homo sapiens
  source 1..263: mol_type = unassigned DNA
tgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcgcgcgcccggccgcccgcccgcccgcgggatccccgcgaggccgcgc

SEQ ID NO: 2921 - DNA, 201 bp, Homo sapiens
  source 1..201: mol_type = unassigned DNA
gttttgttttctttgtttttaacgaattggtaagtaaaatattagttgttcaccctgaaatctgccctaaccacttccgtaccccctgaagctcgctgggcgcgccctgggctgtccttccctgagcagccgggcctagagtcaaggcgcgatgattgccgcgcaagctagggtccacgcggccggggctcctctcccgcc

SEQ ID NO: 2922 - DNA, 201 bp, Homo sapiens
  source 1..201: mol_type = unassigned DNA
cttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggca

SEQ ID NO: 2923 - DNA, 201 bp, Homo sapiens
  source 1..201: mol_type = unassigned DNA
ttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgacccct

SEQ ID NO: 2924 - DNA, 201 bp, Homo sapiens
  source 1..201: mol_type = unassigned DNA
cgcggggtcgggcggggaccggccgggggcgccgcgcgcccggtcgggttgactgtcgggggcgatttccgcggggcaaggcgggggcgcgggagcagcgcgcagctgcggggccattccacctgagcgccctgaggtcagggccggggcctgaggacacggcgctgggctccgggggacgcgggttcacgccggcgcccg

SEQ ID NO: 2925 - DNA, 215 bp, Homo sapiens
  source 1..215: mol_type = unassigned DNA
ccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtc

SEQ ID NO: 2926 - DNA, 201 bp, Homo sapiens
  source 1..201: mol_type = unassigned DNA
cgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcgg

SEQ ID NO: 2927 - DNA, 201 bp, Homo sapiens
  source 1..201: mol_type = unassigned DNA
gtgccagcagccccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtcc

SEQ ID NO: 2928 - DNA, 201 bp, Homo sapiens
  source 1..201: mol_type = unassigned DNA
ccaggttgtctgcagcgtcgccctgttcttctatttcagagcgcaggtgagtggccaccttcccaggggatcgcggctgagagcgcccatctccttcccccgcacttggaaactgagtctggcggcagggctgggccacccagagcttgcatattccggaagggaaagtgactccagaagggagagaggaagtgttgagtt

SEQ ID NO: 2929 - DNA, 217 bp, Homo sapiens
  source 1..217: mol_type = unassigned DNA
tgtagctggtgctgctcctgggacgatgtagacgccccatatccaggcgcgggtgccaggtcgccgggcaccagctcactcccagggcctgtgagctgcgcgcattccctcggccgcgcattccctgggaggctgcagtcagagcgctcttgaagggagggcggcagaagacactccctctcggttcatgcaaatcgctgggggaacttcagccaat

SEQ ID NO: 2930 - DNA, 317 bp, Homo sapiens
  source 1..317: mol_type = unassigned DNA
aagcgagcgaccctctgagcccgggtggtccggcgggcaagggcggcgcgggagacccgcagggcgcgggcgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgct

SEQ ID NO: 2931 - DNA, 201 bp, Homo sapiens
  source 1..201: mol_type = unassigned DNA
tacccctgtgggggggagggtgcagcgaaggctgccagggaccccgcgatcgcgccttaacacgtattggagcgagtgtgcgagtgatcatgagtgtgagcgggtgcgagcgctcggcggggctgaccgtcacgttggcggggccggcggggccaggcagtcttctccgcgtccccctcctcccgctccgtgcctcccctc

SEQ ID NO: 2932 - DNA, 201 bp, Homo sapiens
  source 1..201: mol_type = unassigned DNA
acggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcgg

SEQ ID NO: 2933 - DNA, 201 bp, Homo sapiens
  source 1..201: mol_type = unassigned DNA
gcgccgcagcctcccgggcaccggcggcggtgaccaacctgtaaccccagcgctcagagctgtcatggtgcccgcgggcggcggcggcggcgacagtgggcgaccggcaggatcagtgccaggcgcggcgcccagggcgggcggggacgcgggcccctcacctacggcggctcagctcaggcagcgcgctcggcccggctg

SEQ ID NO: 2934 - DNA, 201 bp, Homo sapiens
  source 1..201: mol_type = unassigned DNA
gcggtgtgcacgggagtccgccgggcacacgcggggtacacttaagtgcactgccaggaggccgggagcccagcgtgcgagcgtgaggtcagactgtgcacggtaccgaggactagttccattcctgagtatgaaagggtgaaaccgttcacctcaagtttcaccccggagttattaaataatgaatgcatcagtcacact

SEQ ID NO: 2935 - DNA, 201 bp, Homo sapiens
  source 1..201: mol_type = unassigned DNA
gggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgc

SEQ ID NO: 2936 - DNA, 221 bp, Homo sapiens
  source 1..221: mol_type = unassigned DNA
ccgagacacaaagaccgaggctgagaccgccaggggttgagggtgaggccgcgtcccggggccgctggagcgcgggcgtcatgcgagactgtcccggctgcgcgccgccccagaggagtccgagcgcccccttcagccgcggcgcgctggccctggccgggactgcagccaggtgggcgccgcgcgtgtgagcgccgcgcgtgtgagcgcagacctggact

SEQ ID NO: 2937 - DNA, 311 bp, Homo sapiens
  source 1..311: mol_type = unassigned DNA
gaccactgccgaacagccgctggagacccgcagagaagggcgggccctgcgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggc

SEQ ID NO: 2938 - DNA, 308 bp, Homo sapiens
  source 1..308: mol_type = unassigned DNA
ctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctcaaaggccatcaccacactgcccgccacc

SEQ ID NO: 2939 - DNA, 201 bp, Homo sapiens
  source 1..201: mol_type = unassigned DNA
aatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcg

SEQ ID NO: 2940 - DNA, 201 bp, Homo sapiens
  source 1..201: mol_type = unassigned DNA
ttattccacttgagcgtggccaaactgttgctatttagtggggagcaaaaaaaaacaatttgcaccatcgaaacgagccagcaactggttgggaggcgggcggtagctgggccccgcgtgccctcggcggccggggtcctctccggggagaggcacacacacgcatagccggatcgcgcctcgccagggccggagtcacct

SEQ ID NO: 2941 - DNA, 201 bp, Homo sapiens
  source 1..201: mol_type = unassigned DNA
ggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtccc

SEQ ID NO: 2942 - DNA, 630 bp, Homo sapiens
  source 1..630: mol_type = unassigned DNA
ccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggct

SEQ ID NO: 2943 - DNA, 201 bp, Homo sapiens
  source 1..201: mol_type = unassigned DNA
aaatgggaccagagcgcggagggagcctggccaggaggcctcctaggactcagccgcgacgctgaaaagcatgaagggtcggaattaggcactcatttagcgagcgttactaatccgaagttacagcgctaattccctgatccggccgctcccacacgcagcgccgggattagaggcgcggccgccgcccgccccgccctc

SEQ ID NO: 2944 - DNA, 239 bp, Homo sapiens
  source 1..239: mol_type = unassigned DNA
gaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacggg

SEQ ID NO: 2945 - DNA, 201 bp, Homo sapiens
  source 1..201: mol_type = unassigned DNA
tgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtc

SEQ ID NO: 2946 - DNA, 221 bp, Homo sapiens
  source 1..221: mol_type = unassigned DNA
ggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctg

SEQ ID NO: 2947 - DNA, 201 bp, Homo sapiens
  source 1..201: mol_type = unassigned DNA
cagccccacgccggtccgcctcccgcccacggctcggcctccctcccgcctggctcggcgctcctccgccccgagttctccatcccctggatcccgggctcgcgggggcgcggagaagaggatccaggaaaggtttgggaacctgatgggtttgtggctggggggaggggcagttctcccgccaccccatcccctccccgc

SEQ ID NO: 2948 - DNA, 246 bp, Homo sapiens
  source 1..246: mol_type = unassigned DNA
tgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggc

SEQ ID NO: 2949 - DNA, 223 bp, Homo sapiens
  source 1..223: mol_type = unassigned DNA
tgacactgggggcaggtgatacaggagttgcggggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcgg

SEQ ID NO: 2950 - DNA, 201 bp, Homo sapiens
  source 1..201: mol_type = unassigned DNA
gggcttctcgccagcgtttgcgtttggctcccagctctgagctccgcgcccacctaccgcgggcgagtgctgcgcagcacggaggacgccccttctcttccgctgctggcagccttcgcaggcgtctcacccgggcctaggcttctgcacggcagtggggcttttctccttctccgtgaatccgctgacgccgtgccctgg

SEQ ID NO: 2951 - DNA, 244 bp, Homo sapiens
  source 1..244: mol_type = unassigned DNA
tgcgcttacccgctgcacaacgcgtcccgccccggcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggc

SEQ ID NO: 2952 - DNA, 201 bp, Homo sapiens
  source 1..201: mol_type = unassigned DNA
tcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaa

SEQ ID NO: 2953 - DNA, 457 bp, Homo sapiens
  source 1..457: mol_type = unassigned DNA
cccttccaaatatacgttcccttgcccgcggcccgccactcccgcccgggcctcgggctgtgcagcttcctcctaggcctgcccgggcccatgcctcccccgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcgggccggagccgcccaggcctgcacccgggggctcgcggccgacgcatgcgcacgcgcggtggcgggtctgcaggcccgaaggcccggcccctccctcaa

SEQ ID NO: 2954 - DNA, 244 bp, Homo sapiens
  source 1..244: mol_type = unassigned DNA
gagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgc

SEQ ID NO: 2955 - DNA, 206 bp, Homo sapiens
  source 1..206: mol_type = unassigned DNA
gccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctc

SEQ ID NO: 2956 - DNA, 203 bp, Homo sapiens
  source 1..203: mol_type = unassigned DNA
ggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctct

SEQ ID NO: 2957 - DNA, 266 bp, Homo sapiens
  source 1..266: mol_type = unassigned DNA
ccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcgggcctcagtttccccatcccgcccacgaagggaggcgattgcgagcgcttggggtttctgacggaccccgccccgggggtggggcggggagtggtcacg

SEQ ID NO: 2958 - DNA, 242 bp, Homo sapiens
  source 1..242: mol_type = unassigned DNA
gcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcaggtaacggggcgtcccccccacgcgccccgggccgccaagtttggggaggttcggg

SEQ ID NO: 2959 - DNA, 201 bp, Homo sapiens
  source 1..201: mol_type = unassigned DNA
agctcagacccgcgcgaacgtggatgggcacacagtctcgcccttccccactctgttttcccgaggcgccagtaatctgtctcttgccggtgacctcgggcgccccctttgccgccgcctgaggaaggctctgagacccgctttgtgaccgtgacccgccaagcgtcgacgcgccgcggtcgtttgtcctgttttgctttg

SEQ ID NO: 2960 - DNA, 201 bp, Homo sapiens
  source 1..201: mol_type = unassigned DNA
tcctgctccggctcctgcggggatggatgcttcacgcagtaagcgagtaagcgagccctggagaccggggccctgggtgtgcggtcggctcagtgccacgcggtgagataggcatggttatcaacccacgccaaggcggttgtgtacctggcatagaaaacactgctgttgaatgttgtttccatagtcattcgccagcgt

SEQ ID NO: 2961 - DNA, 312 bp, Homo sapiens
  source 1..312: mol_type = unassigned DNA
ccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgacca

SEQ ID NO: 2962 - DNA, 203 bp, Homo sapiens
  source 1..203: mol_type = unassigned DNA
cgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgc

SEQ ID NO: 2963 - DNA, 201 bp, Homo sapiens
  source 1..201: mol_type = unassigned DNA
cgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccggga

SEQ ID NO: 2964 - DNA, 283 bp, Homo sapiens
  source 1..283: mol_type = unassigned DNA
agcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccac

SEQ ID NO: 2965 - DNA, 201 bp, Homo sapiens
  source 1..201: mol_type = unassigned DNA
gttcccggggcgccctgccctgcgccaccgcgcgctcgctcgcccgcccgcccaactcacctgctgaagaccaggcagcccaggtggttgatcttgtggtcggagcggtggcggctgtagtcctcccacaggtccctgaaggccgtgatggccaggatgaagagcaccggcgccagtgccaggccgggctggaaggcgttc

SEQ ID NO: 2966 - DNA, 247 bp, Homo sapiens
  source 1..247: mol_type = unassigned DNA
ttgagcgcgtgacatggtttgccgtccctgaccaagacgggcacggccacccggcgcggcgagggcaggggcgtcacctccatacctttctcggcccgggcgcgcttcatcttgtagcggtggttctggaaccagatcttgacctgcgtgggcgtgaggcggatgaggctggccaggtgttcgcgctcgggcgccgacaggtaccgctgctgccgaaagcgccgctccagctcgtaggtctgcgcct

SEQ ID NO: 2967 - DNA, 427 bp, Homo sapiens
  source 1..427: mol_type = unassigned DNA
ggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctg

SEQ ID NO: 2968 - DNA, 246 bp, Homo sapiens
  source 1..246: mol_type = unassigned DNA
cggcccacagccgggatgcgcccccgccggggtcaccgcggcggcgaacgtcccggacttcgcatcccggtgaccccttgggatgaaccgaagccggacccgcaccttggccgtaacaagcgcgctccacgccgccacgcaccagcggtgactcccgagtcctctgtcgccctggcctccccgcaggcgggtttcgaggcccccgcagggagttcagggccacggccacgtgcagccgcccccgag

SEQ ID NO: 2969 - DNA, 384 bp, Homo sapiens
  source 1..384: mol_type = unassigned DNA
tgcgcgtcggtctggcttgcctgcgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcgcggggcggcgcggggcggcgcgcgcggtcctggagcgctagtacttgcttctcgactccccggccgccgcctccggccgccccggggattccgccacca

SEQ ID NO: 2970 - DNA, 415 bp, Homo sapiens
  source 1..415: mol_type = unassigned DNA
tgggcagccccaggccgtcgaactcggcgcccagcgggggcagctcgcggaaggcgcgagccgagccagacgccgcggggaaaggctcgggcggtggctgcgggggcgctaatcccgggagcaggaggccgggctccagccgccgggccttgcgcgcctgcttcttgcggcgcggccggtacttgtagttggggtggtcgcgcaagtgctgcacgcgcagccgttcggcttcctccacgaagggccgcttctccgccgcgttcagctccttccacgctttgcctgcgggccgtgggcgccagtgagtggaacgccgtcgggcgggtgggcgccgagccctccgtgcgcccgggacgccccgcgagggtttggcgcagcccccgcaccccgcggcccgggacccctgccccccccg

SEQ ID NO: 2971 - DNA, 543 bp, Homo sapiens
  source 1..543: mol_type = unassigned DNA
tgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcg

SEQ ID NO: 2972 - DNA, 227 bp, Homo sapiens
  source 1..227: mol_type = unassigned DNA
ccaggagcgatggctgcaatgcctttttctttgctttgctttccggtgccgggagccttgcctcccgccgccacccctggtcagctctgcgcaagaacgtcgttctgtttggcagccaggccgagacgcagcctgaatgtgagcaggaactcggagaagggaagggagagaatcagaaagaaggcccgggagggacccgggaagcagtgggaggtctgcgccctgga

SEQ ID NO: 2973 - DNA, 323 bp, Homo sapiens
  source 1..323: mol_type = unassigned DNA
ccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcaggg

SEQ ID NO: 2974 - DNA, 279 bp, Homo sapiens
  source 1..279: mol_type = unassigned DNA
ggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgcc

SEQ ID NO: 2975 - DNA, 261 bp, Homo sapiens
  source 1..261: mol_type = unassigned DNA
ctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggaga

SEQ ID NO: 2976 - DNA, 364 bp, Homo sapiens
  source 1..364: mol_type = unassigned DNA
gctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtaca

SEQ ID NO: 2977 - DNA, 242 bp, Homo sapiens
  source 1..242: mol_type = unassigned DNA
ggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcaccgcctccaccctg

SEQ ID NO: 2978 - DNA, 285 bp, Homo sapiens
  source 1..285: mol_type = unassigned DNA
acggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactg

SEQ ID NO: 2979 - DNA, 222 bp, Homo sapiens
  source 1..222: mol_type = unassigned DNA
ggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccccggttggctgcagggcgcgtcactccgcggggaggcggcggcagcggtggcg

SEQ ID NO: 2980 - DNA, 201 bp, Homo sapiens
  source 1..201: mol_type = unassigned DNA
gcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctac

SEQ ID NO: 2981 - DNA, 298 bp, Homo sapiens
  source 1..298: mol_type = unassigned DNA
gggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgg

SEQ ID NO: 2982 - DNA, 272 bp, Homo sapiens
  source 1..272: mol_type = unassigned DNA
tgacagggaccgggctcagatctgccaaatgctgcggaggcagaacctgacagtgcgggagggcaggcgcctgggaggtaggagctggtggagatgacagcgtggaactcgtgagccccacgcaacgcctccctgccgcccagggtgggctcctagaagcacagaaatggtcgggctgcgggacaccacagcgaggaaccagcggagtacaggggccccaggagcgccgggacatgccaggccgggtagacagcctcgggtcggagtgagtg

SEQ ID NO: 2983 - DNA, 201 bp, Homo sapiens
  source 1..201: mol_type = unassigned DNA
gagcatgagggagagtgccatccctcagctgaaggccactgtgccttgtatttctggtttgggcaagtgaggagcctgccagcccctggcaggaagtgcacgtgaccggcggctggccaggggcacagagacgcactccacacagaaacccaggctggcggggtgggcggccggggagccagccctgcagatgttactaag

SEQ ID NO: 2984 - DNA, 251 bp, Homo sapiens
  source 1..251: mol_type = unassigned DNA
gcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgta

SEQ ID NO: 2985 - DNA, 249 bp, Homo sapiens
  source 1..249: mol_type = unassigned DNA
acccgctctcggagctccgctcggcggcacctgccttggccacgcgccccagtcccgccaggcccctcggcgggcccgaacccgcagccgggaaggcacacgcgagcaggagggcgcactccatggtcaggtgcggacgcggcggctgcgggtggccagacgcggcaggcggagcgcacgggcggcgcgcattctttccgcggccccggagctcggcgccccaggtgcggctccaggtgagagccgccg

SEQ ID NO: 2986 - DNA, 249 bp, Homo sapiens
  source 1..249: mol_type = unassigned DNA
gtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcggggatttgttggtgccccgagactcactgagttgcgggggccttggagacctccaggtctgaaaagttagctctagaga

SEQ ID NO: 2987 - DNA, 201 bp, Homo sapiens
  source 1..201: mol_type = unassigned DNA
ctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggcc

SEQ ID NO: 2988 - DNA, 201 bp, Homo sapiens
  source 1..201: mol_type = unassigned DNA
acggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccat

SEQ ID NO: 2989 - DNA, 251 bp, Homo sapiens
  source 1..251: mol_type = unassigned DNA
cggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcgcggctcgcgtgggccccaggcgcgggatggcggcgtccagcagcgcgggtccgcgcagggcgcgcagcgctgggggcaacagcgtggggtccggtcggcagtggggcgcgggctgcgcggt

SEQ ID NO: 2990 - DNA, 201 bp, Homo sapiens
  source 1..201: mol_type = unassigned DNA
cacggtggatcctgtgggtcgctgagttttctgactcccggtttgtcttattttgctttgtcagtgggctctgcgctcgcgttaacaattcgaatgggcacgtttctgcgtttcagaacgctgttcgcttcctcacacttagattgaggtggaactcacgtcacataaaccgggtcgcaaggctcagctcagcggggcccc

SEQ ID NO: 2991 - DNA, 201 bp, Homo sapiens
  source 1..201: mol_type = unassigned DNA
tggcgcggggcgcaggtgcacgcaggttggccgcgggcgcgcggggtccggcgggagtcccggggtggtccccgcgtggggccgggggcgtccgcgcgggcggggcgaggtcggggagggcagctgcccgccctcctcggcactgggagctttcggctggtactgcgggaggagctcccgggtgacccgcgggttctgaaa

SEQ ID NO: 2992 - DNA, 201 bp, Homo sapiens
  source 1..201: mol_type = unassigned DNA
tgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcccgggccgcgcggtcactgaccgctggctgcacgggggcgccgtgcggactcggcct

SEQ ID NO: 2993 - DNA, 337 bp, Homo sapiens
  source 1..337: mol_type = unassigned DNA
ctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccac

SEQ ID NO: 2994 - DNA, 201 bp, Homo sapiens
  source 1..201: mol_type = unassigned DNA
ggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggca

SEQ ID NO: 2995 - DNA, 201 bp, Homo sapiens
  source 1..201: mol_type = unassigned DNA
acatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaa

SEQ ID NO: 2996 - DNA, 201 bp, Homo sapiens
  source 1..201: mol_type = unassigned DNA
ccgatcctgctccgggcaaccgatgggaaacttcccgagagcgcggcctccctggggactcggcgcccctgacgcctccaggcgcttcctcgggccgctgcggcccctcctcgccgcccgccagcgcttaaggtcgcgctctccccacccccgccttcctcccttcctcggcggcttccggatctggacagagctgcagga

SEQ ID NO: 2997 - DNA, 1216 bp, Homo sapiens
  source 1..1216: mol_type = unassigned DNA
gaagcgaagaggggtcccttgatttgcaacatagaggaaagcgccgcttccgcccagcctggcacccacgcgcccacacgcacccggcgccggccgggtcgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccgcgggtggtggggggcgctgtgcccagcaggggcgacagcgcaggcggggcctcctgcagcccccttccccatccccggtcgcgtcccggtccccaccttg

SEQ ID NO: 2998 - DNA, 365 bp, Homo sapiens
  source 1..365: mol_type = unassigned DNA
ggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcc

SEQ ID NO: 2999 - DNA, 201 bp, Homo sapiens
  source 1..201: mol_type = unassigned DNA
gcggaaagcaaggcgcgttcacagccgccctccctcctggaagcccgcgcccacccctgcgcggcggccgctccggaggcgtcgggctgggcgtgaggacgccgcactcaccactgggcccgcgagcgccgccagctcagccgcctccccccgcaggtccgggggcagcgcaccccgcaggccccacaagccgtcacgcca

SEQ ID NO: 3000 - DNA, 201 bp, Homo sapiens
  source 1..201: mol_type = unassigned DNA
gcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgcgagaagtcgatcacctcgtcctccgtgccgtggatgatgagcacgggcgacgtgat

SEQ ID NO: 3001 - DNA, 201 bp, Homo sapiens
  source 1..201: mol_type = unassigned DNA
tcgccctggccgaagcgcagtccgagcgccgcgacgcgctccacgcgcaggaagccgtcggggtcgcggccgcacacctcgaacacctcgcgcaggcggcgcacggagcgcagcagagccgcgggggcgcccgaccagcccgcgccgcccgccatccgggccggcccgcagctcagcccggacccctcgcccgccgcgccc

SEQ ID NO: 3002 - DNA, 201 bp, Homo sapiens
  source 1..201: mol_type = unassigned DNA
cgccccgcgccatgcacacccattgtggtgatgagagctcgcgccccgtgcccgtcacggtcactgtgcgtccaataaaaacaaacactgccgaggagccgccgcgatgcggggcggacgcgcggcccggaaaggggagggggccctaggaagagctacacccgcgagccgggcctgggccaggggcgaggggagagcgcc

SEQ ID NO: 3003 - DNA, 201 bp, Homo sapiens
  source 1..201: mol_type = unassigned DNA
gtggccccctggtccccctaggcagctaacaccacaatcttccctgggagggggtccgcagaagggcgcgcgctgcttctcccgcttcccaagctgtagcggggcgggtcgggagccagggttagggtctggagacttgggaggggaccggtgccagaagcgaagagctagggttagaaagttaggtcaattaaggggggg

SEQ ID NO: 3004 - DNA, 201 bp, Homo sapiens
  source 1..201: mol_type = unassigned DNA
ggagaagggggtccgtgcaaatcccaggctgacgaccgcgcacgcgcccctcgggtcaccagccctgtcgctcttggtggggcacaccgaggagaccgccgtggggaaccggggaccggattgcctgacagccgagcgctgaagactactcttcctgagcctagggaggtctggctgccctgagccccctacccctgggct

SEQ ID NO: 3005 - DNA, 213 bp, Homo sapiens
  source 1..213: mol_type = unassigned DNA
ccctgcggctggctaggaggagctcctcgccgcccccattccagccgcgccgggcgctgggcccgacccccagcacctttggcactgatgtgcctggtgcgcgctgagacgcgaacgctctgcaagatgagcccttattcattcgttccttctttccttcatttgttcatcttacaaactgagtgcctggccactttggttcaggcaagaggc

SEQ ID NO: 3006 - DNA, 201 bp, Homo sapiens
  source 1..201: mol_type = unassigned DNA
gcccagcggcttgcaccgagagccaggagaggctcagaccggatcccgacccttcgaggcgcgggagcccacggagcgcggtgggcgcggcgctcgggtcgcgcagctaggtggggagcggcgcgcagccccagactcgcaggcaggcagcggcggactgcacttgcctcgccccgcagcgccccctgcctgccgcctccc

SEQ ID NO: 3007 - DNA, 201 bp, Homo sapiens
  source 1..201: mol_type = unassigned DNA
gcgtccgaggccggcgcggtggggaccgcgggcccaccaccagccaagcccagctacttaactatttgtagagctgctgcaggcacaggtccaggctttcgccctccacctcctcgcgggtgatgcgctctgacagcggtcgcgggagcgggggcaaaggcggcagctggggcggcggcggcggcacggccgagtgccccg

SEQ ID NO: 3008 - DNA, 201 bp, Homo sapiens
  source 1..201: mol_type = unassigned DNA
ccgcaaggggcacccggctctgtgcgcgggggcggcgggggctctgcgcggggccgggctgggccgggctgagctggcccgctccggcgccggggaccacgcgcgactggttagatcttgtcgtgatctctggaaaactgtgactatctcacatgtcctgcccagctcggatcccctgcgctaacgagccaggcccccctt

SEQ ID NO: 3009 - DNA, 324 bp, Homo sapiens
  source 1..324: mol_type = unassigned DNA
cggggtccgggctgggaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggtaagtggagccgaggggagccgggtcccgggcgcggccgcccccttccctccgccggcccggccgcggagcttctgcccgggcccccttcgaccgtctcccaggcccccacc

SEQ ID NO: 3010 - DNA, 201 bp, Homo sapiens
  source 1..201: mol_type = unassigned DNA
gagggggcggctggaggacccggaccctcaagaacctggccttgggttttgacccgggcggccggagagaaggcgaagaagaggccgagcagacaggcgcgcggcggacgcgagagaaggacgcgggcgaagcgtccaagacgttcgtccccagggtcgccgagccctcctcctccttcgcttggcgcggcagcaccgcgg

SEQ ID NO: 3011 - DNA, 330 bp, Homo sapiens
  source 1..330: mol_type = unassigned DNA
agcccagcccagccaagcagcagagagaacaggacggaggctcccatttcccagggactgcagcgcctccaaaccgcccatctgcgacggccccgcgagcgtgcgcagcccagcccctcccggacgtcctcgcccccgcccgggcacatcgtgctccgcaccgaggcagagaggggcacgcggatcccagcccctgcgagcccctctgcccgccgccacttcacaccccgcattgcctcagctgccgttccagaagatgcatcgtctggcgcgcaaagcggtgcacggtccccagcccgcgcgcagcagcctggaggggcgccagagtcc

SEQ ID NO: 3012 - DNA, 293 bp, Homo sapiens
  source 1..293: mol_type = unassigned DNA
gcgttccagcccgtggcgctgccggcgcagaccccgcgtggggaccggcgaggctaacccctcctgcggcccggggtcggcagagcacgcaaggggccgcgggccgcgtgggtttgggcgcgccgtggtgggcaagcggggccagcggagcgggaacccgcacaccctccgagcggagccgaggacaggcccgtgcgggccgcggggtccctctggcgccaggaagcggcggccgaaggagacaacgagaacgcagccccggctcagggaggcttaaaagctgagatgctgaa

SEQ ID NO: 3013 - DNA, 201 bp, Homo sapiens
  source 1..201: mol_type = unassigned DNA
accgccggcgtcggcagctagagcgggacccagctcccaccgcgtcctccactggagcccctttcggcccctcggcgagtgcggcccgtggggagtgggcgtcggcgcgaggaagttccccggcccgggcgaccccggcttctgagcggcccctccccacgtcgccgcccgccaggccgacggaggaccggggcggggacg

SEQ ID NO: 3014 - DNA, 201 bp, Homo sapiens
  source 1..201: mol_type = unassigned DNA
cggcgccccacgctctcctcttggagcaaatccgcctcgctctcctcttggagcaaatccgccgcactctcgcctgcaccgaaatcctgagcgccgccccgcgccacccccagcccgcgcccgcgctgccctcctccccgggccgcaggctgagaggctgggccgcactctggccacgctttgtccggctttagcgggata

SEQ ID NO: 3015 - DNA, 226 bp, Homo sapiens
  source 1..226: mol_type = unassigned DNA
tcggggctgccagggcgccgggttcgtgcgcggacactgggggcgcacccggctcccgggtcaggcgcggctggagacctcgaggttggggttttgaagcgcgcaagtattcccctccccatcgcgtctttgcaagtagtttgaagccctaagtcgttgtttacggattcccgtttccaactttttaattgaaaaaacctgccgaggagagtggaggcatcgccat

SEQ ID NO: 3016 - DNA, 363 bp, Homo sapiens
  source 1..363: mol_type = unassigned DNA
cacccgggcgcgggagcacgggcgggccgggggcgcctgggtcggcctgccgtggcccgggggctcggggcggcgcgactcacctggcgccctcggggccgcgattctcctcgggaggtgtctgcgaaggcggctctgccgcggtgggggtggggaggctagggcttcggaccgctggagttggggtcgcagccagttcctggcgagtgtttcctggctgctgccgcaggggcttgctttttcggatttcccctctaatctcgccggacttcttccccttcccccccacgcccgccaagttcatggcttctgcaatgcggtgggtgtggttacctagtaaattgtaactgtggtcccttgcaa

SEQ ID NO: 3017 - DNA, 201 bp, Homo sapiens
  source 1..201: mol_type = unassigned DNA
cctctcggagtgggggactgcgagggggtctcggctttacgaggtgcggaggaagagcccgaggcctggggcgaggcgcgcgggacagtggggctgacgcgtggcttcggcgccgcgcggtctcccgaatcccgagccccgcgcccggcgcggccggggtccccaaccgccctcccgctcgccgggacccccaccgggccg

SEQ ID NO: 3018 - DNA, 201 bp, Homo sapiens
  source 1..201: mol_type = unassigned DNA
ctcgcccggcgttgcatcttcccgtggctcggctgtaaggacctgcggtggaggcttggcggaggcgggcccgcgctccagagagagcgtcacgtcacccgagaaggcgacgctgggggctgctgagcctcccaactccctttggcgcgtcctgctcagaagccggggagctcctggccggcggctggcggggaagcgcgg

SEQ ID NO: 3019 - DNA, 267 bp, Homo sapiens
  source 1..267: mol_type = unassigned DNA
ggtgagctactgggacttcgctgccagggagcaagctggcaggcaggaagtagccaagatttgggggaatccttcccagggaacgaatacagagaaggacgcatctgaaaattccgccgcagccacctccctcccatgggaaagccccgacctcggcgggcccagcgccacccggctccccggggtgtggaacactgagcgaggcaggtgcggcgggagcatgcgcgcggggcgggcagggggcggctcccgcgcccccaccccgcg

SEQ ID NO: 3020 - DNA, 707 bp, Homo sapiens
  source 1..707: mol_type = unassigned DNA
agggaatggggagggtcacgcatactctgtgcggcccgagtggtccggatggcacagcccaggtgtccgggctaaagttggcatctccaaagtccagaacgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccgccgctctgcctgcgctgccgcctccgctcgccggccgggctcaactggctcccagcgccgcggcgctagctcgtccccctgcagccgccgacgccaccgc

SEQ ID NO: 3021 - DNA, 201 bp, Homo sapiens
  source 1..201: mol_type = unassigned DNA
tggtgctgagtgcgggccgggccgctccccggcggcggtgggtgggcgcgcgagggcggagggggccgggagctttggttccgaggcagcgaggagagacgggtaaacagcagagcgctaagccaagcccccaaagtgccaacagttgcagaagtccgaactccagcggctccaggggcgcgggcacagggtcctgggtcc

SEQ ID NO: 3022 - DNA, 201 bp, Homo sapiens
  source 1..201: mol_type = unassigned DNA
gctgcccggggctgctgcacaagccggtgacactgccctgcgggctcacggtctgtgagcgctgcgtggagctggggcccgcgcggccacgggcgcgggcgcgggcgcgggcgcgtgaacgtagtgctgagccgcctgctggagaggttcttcccggccgagtgcccgctgcgcaggctggagggtcaggcgcggagcctg

SEQ ID NO: 3023 - DNA, 201 bp, Homo sapiens
  source 1..201: mol_type = unassigned DNA
agccagcgcggcccccgggtccctgcgcttatggcgagggtcgcgggggaacagcccctggtaggtaacttgccgggcacccacctgagttctccgcaccgcggcccgaaaacctgggagcgtcccaggacaaagggccagccctctggaattagccgtgtgtgactagtgtgtgccagctcgtatgtgggggtcccagtg

SEQ ID NO: 3024 - DNA, 201 bp, Homo sapiens
  source 1..201: mol_type = unassigned DNA
gctgcgcaggcatcgggctccgtccgggcgccggggcagggttgccggggccagtaggtctctcgcgcctttcctggcggggctctaggggctggattgcgggtcccctctgctccttcttcggggccgagcaagctcgcggggggtgtccccaggcagcaggagggtgaggcaggataactcccaggttttgcagttttc

SEQ ID NO: 3025 - DNA, 203 bp, Homo sapiens
  source 1..203: mol_type = unassigned DNA
atctccaaagaatgacaaaataaagaagcgtacgttaggctcccaaggagacaccgcccccccttccccaccattcttcatctccattagattccctaccgcggaccaaagatgaacctgctaccaatcaagttcctgcccaagttattttatttcccgcagcccctccacctgccggggcggtgctcggcgcactctaggct

SEQ ID NO: 3026 - DNA, 201 bp, Homo sapiens
  source 1..201: mol_type = unassigned DNA
tgatcgggcgccgaaacgccgggagtcgggggctaagggctcgagccaggaggccccggagcagcagccgcccgctcctcacgccgccgccgccgcccccgcggttgcctggacacgggataaccgacttggggcctcgaccgcagcagagccggaggggtgggcaggcgcgggtccgggagacgcgcggggaaacgcgcg

SEQ ID NO: 3027 - DNA, 201 bp, Homo sapiens
  source 1..201: mol_type = unassigned DNA
ttattttaaagcggcagcgcacctccagagctggcctccctccccgcctcgggttcccggaccggctgcaggagcttccttccccgggtcgggcggcggcgtctggcgtcctcgggctgggccattgtcccatgtccttctctgggcgcctggcgcgtgtcccaccgccgccaccgcgcctaaaggccaggctggaagccc

SEQ ID NO: 3028 - DNA, 208 bp, Homo sapiens
  source 1..208: mol_type = unassigned DNA
gggggcgccccactgacccttcttggcgcttgctttcctccccaggctgcgccttcctcacctactgcgagcgtgagtcagcgctgaaggcccagagcgcgctgcacgagcagaagactctgcccggggtaagtggcgcccgccgtggcgcaagcggccgacgcgccgacagggggcgacttcgggaggccgggcggcggcgcggcgc

SEQ ID NO: 3029 - DNA, 201 bp, Homo sapiens
  source 1..201: mol_type = unassigned DNA
cactgatgaatgcgcgctcggatccccgggcggactccctccaagccggctcgcttttctagtctaaataaataaataaagccagatggaagaaaaaagcgcccattccacctccgccgccgccccgcccgccatccctgcctttgcttcgcccgcctggcgccctaatagagcatagcttggtggataaagcccccctac

SEQ ID NO: 3030 - DNA, 201 bp, Homo sapiens
  source 1..201: mol_type = unassigned DNA
gaaaggaaaaagcgatacctctgtttcgcacagagccaaacactggaagcacgagatagccgacgtggaccaggaccatcctggctcctcgcgcggcggcggcggcggcggctgcgcgcgggccctttgtggcgcggctccggggcgcgggcgcgggcggcggcggggctgcgggagccgccggggcgggaggcggagcgc

SEQ ID NO: 3031 - DNA, 595 bp, Homo sapiens
  source 1..595: mol_type = unassigned DNA
cctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcct

SEQ ID NO: 3032 - DNA, 201 bp, Homo sapiens
  source 1..201: mol_type = unassigned DNA
ccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtg

SEQ ID NO: 3033 - DNA, 269 bp, Homo sapiens
  source 1..269: mol_type = unassigned DNA
cccaccgaccgcaccatctgaccgcgggaaacgaaatctgagctcaggaatttgaactgccccacgcacgttcgttcccggataaatctcctagaggaccgtgatttttccacttagagattatttagggagatgtcctggatgggacaagtagacaaatggcggcccgaggaaaatgcaggaaactctacattgtagacgcttaagcaccaactgtctgggccccggggcagggaacgggagacattatccaccggaaacatcacacc

SEQ ID NO: 3034 - DNA, 201 bp, Homo sapiens
  source 1..201: mol_type = unassigned DNA
cgcggccgcgaggcggggctggagggcgctgcgggctgcgcggaggctgcgggaagcgcggggagcacgcggagcccgactagcagggagatcgcgtcgcgccgggcacaggcacgggacccgcgctctaggagggcgcagcgagaggcgcactgcgcacccaggggctgcggtcccggccgccgtgcggtgacaagctga

SEQ ID NO: 3035 - DNA, 267 bp, Homo sapiens
  source 1..267: mol_type = unassigned DNA
tgaaatttagaggaaaataaaaatgcagcggttcctacggaggctcctggcttgcaggacatttgagggtggagacaaggatgccgcggagggaggactcgggagcccggccgcgccctccagcctcggcacccgcgctcagcgcgccgcgccccgcgtcccccgcgcgtggccgcctcccgcgggccgggccggggctgcgctgccatctagcggccgcgcgcccagcgccgcgccaccgcccctgcaggccgccggggctcctgc

SEQ ID NO: 3036 - DNA, 287 bp, Homo sapiens
  source 1..287: mol_type = unassigned DNA
ggtccagactccgcgagctccgggctccgcttacccggccggcggcctcctcggggcggagcgcggcgtctctggagccggcatcccggactccggcgccgccccgcgcaccgcccccgtcccagccttcagtggcgcggcgccccctcgcgacatccgcgggtccccaggagcgagccgaccctcggctgggtttggagccggggccaagtccactcggagggagcacggagcccacccagctgcccttgggggcaggaggcccaggccccactctgcacaccgcc

SEQ ID NO: 3037 - DNA, 201 bp, Homo sapiens
  source 1..201: mol_type = unassigned DNA
cgacctggcaccagcgcggaggccaccttgcgcagccgggcaggcacggcggctcccaggcactcccgcagcagttccagctcctggtccgcggcgccgcgagggcgagaacccgtgggcgccggcccctcctcccgccgccggtgccctgcaaagtggaggccggcgcccccggcgcccccgccgcgctcggggcaggcc

SEQ ID NO: 3038 - DNA, 201 bp, Homo sapiens
  source 1..201: mol_type = unassigned DNA
cggaggtctacgctgagctcgcgcagcgcgcacggcccgtcggcggcggtggcccccgcgctgcgctgtgcccgacccggcccgcgcggatcccgcccgcgccactccacgcgcaggccctgcagcgccttcaggagcagcagcgctcgcaggggatcgccgaggccgccggggccacctgggcagagcgcgagcaggcgc

SEQ ID NO: 3039 - DNA, 286 bp, Homo sapiens
  source 1..286: mol_type = unassigned DNA
gcgcgggaggcgccgggggccgcggaggcggggcggggaggggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgag

SEQ ID NO: 3040 - DNA, 244 bp, Homo sapiens
  source 1..244: mol_type = unassigned DNA
aatgcttagcattatttaaaaagaaaaccacacacattagccaatgatatattctaaccctcaacaaagctggtatttttctctgattacagactttgccgtggcaaacccgggctccgacgacagaggcagcgcagaagctcgctcctaaatgagacaattttattaaaatcataattccttgcatttctatagcgccttttcagtggcggagatctcaggtgccccacgccagggtctacta

SEQ ID NO: 3041 - DNA, 201 bp, Homo sapiens
  source 1..201: mol_type = unassigned DNA
gttctaacccctctccgagaccccgggcggcggggatcttccctcgggtggctgcgtgcgcgctcagcaacccggtgggtggaggcctggagccccgcccgcggccgcccccgttgaccccccagtgtctctgtttgtcctccagagctcaggcagtcagtttcccgctaggaaggcagagcagcgagatccccggcccac

SEQ ID NO: 3042 - DNA, 372 bp, Homo sapiens
  source 1..372: mol_type = unassigned DNA
ggacccgccgcccaggcccgcgtggggaccgcagggaactcgcgccacgccgggggtcactgtccatcgcgaggtgctgaagtggctccgtgaccgccgcgggccgtggctgacatcgcggagaagttaggactttcacagtctctgccagacttgaaagcaagctggaaatcgatagctgtttcagctgtttcagattctaatctggtttgggtttttccccctttcatttgaaaatagactcagggcaatgcttaagagaattccaaccgacggaagtggccgggaaatcctgccttcggtactgagggatgttaccggagattcccctgccccaggcctgccggagtccaccacattcgctaatgccac

SEQ ID NO: 3043 - DNA, 201 bp, Homo sapiens
  source 1..201: mol_type = unassigned DNA
aaccctcccgtgctccctgcacaatctgggagagacgcagcgctgtgggtgcagagctgcccagagagggctccaggccagggcagggaagagacaggacgccgcggggcccggctgtcggcgctgttgccatcttatggctgaaggggactgaggccgaactgggcaaggagaagtcggtcgcagattgtggagctgact

SEQ ID NO: 3044 - DNA, 247 bp, Homo sapiens
  source 1..247: mol_type = unassigned DNA
ggggcaggaccttagaagttatccaatcagggacgctgggctggaaaccgtccaatcaggcacggggcaggagaggacagggcggcttccgggatgtggcggggcctttgtctctggctgcagttggagctctgcgtctcgtcttcgttcttctgtgtcctctgctgctagaggtccagcctctgtggctctgtgacctgcgggtattgggggatccacagctaagacgccaggaccccccggaagc

SEQ ID NO: 3045 - DNA, 201 bp, Homo sapiens
  source 1..201: mol_type = unassigned DNA
ccgttccctctctcgggatgtcggaccggcactctcaccatttctaggcttccagggggccctggcgtcttagctgtggatctcccaatacccgcaggtcgcagggccacacaggctgggcttctacgtgcagaggacacaaagcagacagacgaaaattggagcttcggcggcagcgagaaacaaaggccgcgccaaatc

SEQ ID NO: 3046 - DNA, 201 bp, Homo sapiens
  source 1..201: mol_type = unassigned DNA
ggaccctgagctggggaccgtccaatcaggcacgcaactggagcggacagggcggcttccgggatttggcggggcctttgtctctcgctgcagctggagcgcttggtctcgtcttccctgctttgtgtcccctgctcttagaggcccagcctctgtggccctctgacctgcaagcattgggagatccacagctaagacgcc

SEQ ID NO: 3047 - DNA, 235 bp, Homo sapiens
  source 1..235: mol_type = unassigned DNA
accccgtcccctgcaagcctgcaacaccccgcacccagacccgcaatccaggcggaggataaagggttgcagcggagggcgcagagcagatgctcagggcggggcagagggggcgggaagctggcgccacggtcgcggcgagggcgagcagccgcgcgctcccggtgctaggaggaatgcccgcagagcggaggctggcaggcgcgagaggccctaagcgcgcagtccgaccaag

SEQ ID NO: 3048 - DNA, 201 bp, Homo sapiens
  source 1..201: mol_type = unassigned DNA
gcggcacctcgctcccggctttgcgcgctcaccccggggcgcgccgaggccaccgcagggcacttacttggcacttgcttttgagtgtgcagatcgtcgcggttttcacttgggttttcaaacaagtttcagggagaaagaaggaggcaaaaaaaaaaaatccaattatgcaaatggactccggactgggaggcgcgggat

SEQ ID NO: 3049 - DNA, 201 bp, Homo sapiens
  source 1..201: mol_type = unassigned DNA
gccgcgccaacgaacgcaggcggcgggaggctcggcggcggggctcgcgttcctgcaccgcgaccgcgccagaaaacaccccggggctgggcggcgtctcggagacgcattcctttgttactcccaccgtctttggtaacgattattaatgccatcatgtcccatttcccctcaccttcccccgctcccagagccgcgccc

SEQ ID NO: 3050 - DNA, 201 bp, Homo sapiens
  source 1..201: mol_type = unassigned DNA
aaagagggagaaagagactaaaaaaagaaaaagataaggggagggggaaggaaggaaggagagaaggaggaagaagtctggggtttgctgctccaggagcgctcaggcagccggtgctggagcgcggggcgcccgccctcgccgggactgtcggcctcggggcctgcgagagcgccagagccccagccggcgcgcccgggc

SEQ ID NO: 3051 - DNA, 201 bp, Homo sapiens
  source 1..201: mol_type = unassigned DNA
gctcctgcgcgcggaaaggcgctggaggcggctttatagccggggaggccagcggcggcgcatctgcatcctgggagacgtctggacccagcccaagcccgcaggctgggcgagcggagacttttgatcttaccgtgtgggtgagatcactgtctcccggtctaaaagaaaagaaagcatgctgtgaacttttgaaacaaa

SEQ ID NO: 3052 - DNA, 201 bp, Homo sapiens
  source 1..201: mol_type = unassigned DNA
tggaacccacggcgcttcgcccgtcccgcgcccaggaatactgtgcgcctagcgcagatgcgtccccacgaccccctgcctggcccggggccatgtggccgcgcaccggcctctgaagcccccatctgactgctggggaaggcgcccagaactaggagcgggttggttggggactggtcctcgcgctgggtcgcttcgccc

SEQ ID NO: 3053 - DNA, 296 bp, Homo sapiens
  source 1..296: mol_type = unassigned DNA
ccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggca

SEQ ID NO: 3054 - DNA, 201 bp, Homo sapiens
  source 1..201: mol_type = unassigned DNA
gccggccgagccccgggagccgaggctggaaacgctggagcgggcgctgcccaccgaaggcggcccgggaccgggacgcgggtccgagcgaccggagcgcgggctgccgtggcgctggtcgtagcccaggctgatgccgctggatcgggcgctgccgccaccgccgccgccgtcggaccccgccaggctggcccgtgggct

SEQ ID NO: 3055 - DNA, 201 bp, Homo sapiens
  source 1..201: mol_type = unassigned DNA
actcgccactgtgtacctggacgccatctgcagacccagcgcctgcggggattccggaaacgggagagcgggcttccggaaacggtgaccaatgggaaacgtgatcagatgttactaggcgaacagtccgtttccaggcaacacagaaggaagagacgctctcagtcaccctaaaatagacggagctttcagccaatggat

SEQ ID NO: 3056 - DNA, 266 bp, Homo sapiens
  source 1..266: mol_type = unassigned DNA
ggaaaccgctagctctgagcgccggactctttgtgctgggtgggagtgggggcccgcggtcctggtgccccaatctttggaggaggacgccgggcggggcgatgcctgtgcttgtggttccctgaggcagtgggagtggcgtgtgaaggactgtgagagtctggcgtgaagtgactgtcatttgccagacattcgtctggctgagtgtggccccgggatcgtgtccgtaagcggatttcgtggaggcgctttcccttttatctttc

SEQ ID NO: 3057 - DNA, 201 bp, Homo sapiens
  source 1..201: mol_type = unassigned DNA
caaagaagccgcgggtatcggcccaacaaggtgcagcgaacagtcgcccgctcccgcctcaactcacagcctcacattccacggtgccattgacttcctcgcacccagtcacacaggacgtggacaggcacacggggtgacagcctcgcactgaacggtaccaacctccactcgcaccggagtcacacagatggcctgcga

SEQ ID NO: 3058 - DNA, 228 bp, Homo sapiens
  source 1..228: mol_type = unassigned DNA
aggacacgctggacagttccgaaaagacacagtgggtggtcccgggcgtgggcaaccgggtgcggaactacagcgtacccggagctgcgaacccagacgcgggtgactgctgaccctctgccctgtcgtttccatttgtgcatgcaggtggcggttagttggggccagggaagcgtggagggtgggttccaatcgagtcaagaaaagcctggggtgtcctgaactctg

SEQ ID NO: 3059 - DNA, 248 bp, Homo sapiens
  source 1..248: mol_type = unassigned DNA
ccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtgaacgccccaggatgaaggtcccctgcaaaacgctgggacctagatttggggtgggtgtctggggtct

SEQ ID NO: 3060 - DNA, 387 bp, Homo sapiens
  source 1..387: mol_type = unassigned DNA
aagccgaggtgctggaggacgtgttgcgggagcagttcgggccgctgccccagctggccgctgtctgccggctcaagcggctgccctcgggcggctactcgtccactgaaaacctccagttggtgctggagcggcggcgtgtggccaacgccaaggagcgtgagcgggtgagggatccctagggtcgacgtccgttccccccttccctgctctaccaccaaacacctggtcaacacccgggggtccgctcaccgcccacccccgctcgaggcgacttcgagctcccgaggcctcccacgcccccagcttgtcaggagaatggcagtggcctccttcttctgcacctccgtgcagctgctcgttggcggccgctgcggtggccgcctc

SEQ ID NO: 3061 - DNA, 203 bp, Homo sapiens
  source 1..203: mol_type = unassigned DNA
cgacctaggctctccagcccccgcccagtcccccgcgtgcgggcgccgggaccgcagtacctgtgacgccgaagcccagcaggccgcagacgggagccacgcgcggccctggcacagggtaaaaacctacgctcaggtaggcgggcagccacgatgtcgggcaagcccagggcagacccccggtggcgcacagggaagcagcg

SEQ ID NO: 3062 - DNA, 203 bp, Homo sapiens
  source 1..203: mol_type = unassigned DNA
tgcgaacaagaccaaggcgaggtgaggcccaggcccccgggactgacagcgccgcggcagggggctcgaggcgggagctggggaccccagcgccccccacgcgcgccccacgggggctgccgccaataaaggcggagggcaagggtgcgtccacccaagcaagggggacggtgggccgcccgggctgagcagcggagcgcagc

SEQ ID NO: 3063 - DNA, 312 bp, Homo sapiens
  source 1..312: mol_type = unassigned DNA
ggcccaggaggagccgcgccgggctcggttataagaggccggctagcaggcgctccgctagcacccgcccgaccccggcccggagcaccgggcgcccagcgcgggtgaaggcggagccgcagggttggcccccaaagggatgctctcgcccgagcggcgagaccagccccgctcgcccctcgccgcggccgcgccgcagccgcccacggccgccgacatggccctctactgcggcgacaacttcggagtgtattcgcagcccggcctgcccccgcccgccgccaccgccgccgccccgggcgcccccccggc

SEQ ID NO: 3064 - DNA, 407 bp, Homo sapiens
  source 1..407: mol_type = unassigned DNA
tctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaag

SEQ ID NO: 3065 - DNA, 295 bp, Homo sapiens
  source 1..295: mol_type = unassigned DNA
attctgggccgcgggagaagtgcgtgcagcccgggcaaggccgggcggggccgggcgcgggcgggcggccgagggatgcgacagggccgggcacggctccgcatccccccgcactcggcgccgccgcctcgccgctctctcccgcttgcagggccgccccgggcaccccagggctgctgaggggcgggcgggccgtaaaagccacgagagaggggcggcagggcggcgcggcctgcgagcgccgcgggaccccgaggagcggcgcggggagtacaggggcgcgcggggcgggcgc

SEQ ID NO: 3066 - DNA, 435 bp, Homo sapiens
  source 1..435: mol_type = unassigned DNA
acaattctggccccacacatttcacatgccccgcacaaagaaacagaaagcgggcgacacgccctgggagggcgggctggcggcttctccagctcggagcgcgtggaggctgcgcgtaggggtccgggacgcgggacagggactccgcgcagcccaggcgccggggaaccggggctggagtcggggatctgagcccagcggacgcctcctccgcctggaggcccggcacggaccgggacaccagggcgtccgtggccgtggctcggcccctggctgctgcgggccgcggcctccagtgggtccccaggacccttccccacggcgggtactcaccgaggctgagaggccacgccgtgctgttggggcttctcgtcgaccacattcctgggcgtcagcccgggcagagaccgcggggactggccaggccgggccagg

SEQ ID NO: 3067 - DNA, 410 bp, Homo sapiens
  source 1..410: mol_type = unassigned DNA
tggctgtgccagccgatatgagcccctccctctctaggaaggcgcaggactcggggaagcctccgcggccaggccgcctgcctacccgcagaccccgggcgccgcccgcgttccctgcccttcacttcccaacccctgcgtggccccagggtccacattcctggagttttcctccccagtaaatagtgctgtcccccacttaacagcagaggcgcccaggagttcaggcgatgtgtccaaggccgaacagagggacagcagtgagctgctcaacctttccagctgcgcagccaggacacggctgggggcgggtggagatgtggcgcagggttagggtccgggtcccgggaagtaatgaccgagggcggtgaccactgtcttcagcttcccggcgggcttccctccaaggg

SEQ ID NO: 3068 - DNA, 392 bp, Homo sapiens
  source 1..392: mol_type = unassigned DNA
tggaagcatccgccccatcgcggggcttggcatctaggctttgggacctctgccattgccaaggatctcttcggggacccgagcccccgggctgaggaccgcgggggaccccaggtcgggacggagcctcctctggctcgctgtgcgcgcacgcctggaaaggcgggatttaaggcagcgatgctgcgggaggctctgcagtgtcaacgagcccccgaacggttccgcctcattccctctctgtgtgcctcgcaagtctctgcttagtaaaccgtcacagcttcggcgcgcgagagtggcgttggcacgtccaaaccccggggtcctcggccaggccaggggggcgggcgtgcggcggggccgggccgggccgggcgcgcccagcgggctcc

SEQ ID NO: 3069 - DNA, 203 bp, Homo sapiens
  source 1..203: mol_type = unassigned DNA
cccgaccccagtccgccgccgtcttctaggcggattccccagaggcaggtcccagtccccggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctct

SEQ ID NO: 3070 - DNA, 398 bp, Homo sapiens
  source 1..398: mol_type = unassigned DNA
gggttcggggataaagggtgacgtgtggtcctggggaaggtccgggatgagggagctgaacccagttgttccgcgcggtgcttagagtgtttcaccgcgcgcaataaatctccgtagacaccgcatctccaatgcggtgtccctctgtgtcagtgccccggcggctcttgcagggtgccaatgttacggctgtacaccgcttttccctcccatcatcctcacctgaacagacctggaggaggcggaaatggaaattagggcatgtccacaagctggattcgttagatcctcctgctcggcggtatgcttgtgcatgcctgcatgccggcaaggagccacggatagggaaggctcaagagctggccacctgagcgcagtagatgggctcccgcagtttt

SEQ ID NO: 3071 - DNA, 286 bp, Homo sapiens
  source 1..286: mol_type = unassigned DNA
gccggttcctccacacccacgtgcccctcgtgtgcgcgcccccggcctgcagatgctacaaggctggcgccgcctggatttccgggcggccccaccctccgcggccgctacgcctcgctccctgcattcagtctccttggcgtctccgctgcagcatccaagaccaggcgccgcctctgctagccgtgctgcccagcacgcctgagggccgctgccggcaggcctcacctcccgcccgggtcccccactcacctttccttctggacggtggggttcaagctctgca

SEQ ID NO: 3072 - DNA, 267 bp, Homo sapiens
  source 1..267: mol_type = unassigned DNA
ccccatctccttctcccctccctagtctggctgaagaacgtccttaaggaaatccgggctgctcttccccatctggaagtggctttccccacatcggctcgtaaactgattatgaaacatacgatgttaattcggagctgcatttcccagctgggcactctcgcgcgctggtccccggggcctcgccccccaccccctgcccttccctcccgcgtcctgcccccatcctccaccccccgcgctggccaccccgcctccttggcagcc

SEQ ID NO: 3073 - DNA, 260 bp, Homo sapiens
  source 1..260: mol_type = unassigned DNA
gaaatcacgataggtttgcaccaccgcccctccccctacgcccccgcccaggtctgcaaagccggttgcccctggctaataggcgcctttcctgctccacggtgaaaactagtctgtggtgcattgagatttgcaaaccattccctgaatgccaggggcgctgcaaaacagccgccgggtgcagtgggccgggcgctcggccaccctggctgcgatcatcgcagcctcccaaaggatgcgggcagatgcagacggctctg

SEQ ID NO: 3074 - DNA, 239 bp, Homo sapiens
  source 1..239: mol_type = unassigned DNA
gtgagcggggcacgagagtgcagggctccgctggtgtcctcctcccggcgcccgccggacccaccgtccccaccgctgcggtgttcgaacccgcggactcggatcggcggcagcagaagcggcagcggcaaagcacccgcagaatggggtatcgcgaaatagtttcttctcctcctcctcctgctggtggtgcagccgcgacagcccgtcttccaggcaggggtttggagcttgccttc

SEQ ID NO: 3075 - DNA, 846 bp, Homo sapiens
  source 1..846: mol_type = unassigned DNA
ggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagc

SEQ ID NO: 3076 - DNA, 526 bp, Homo sapiens
  source 1..526: mol_type = unassigned DNA
agctgtgaagaggcgtgggggccgcgggaactttcctctggccggtgcgatgaaagccgggcggacgaggtggctcaacggggctgagagtggttcggccgaggcgcgggctgagccctcagcacctggcctgagcggcgtgggcagcagcctgcaccgcggacacctccaactctgccgcgtctgcgccgcactctggccgtggcagcgattttccgggcatctctgaggccgcccttagtcccacaagcacttagccgcccatttcagagcagcggcgccgaccgttttaagaggagtcagttcccgacaccgcctcccacttacttctccacatttccaccgctggagggggtgagtgccgtggacaggcgctcccgtccggggacagctcagcggcggcagtcagcccgaccctcctccgcgcgggtcgcccaaacttgaccagcagagcgagcggctcagcgcagtagccgccttcgcggcttccagttgtagaaaagcaaagcgccgggaggaagcagca

SEQ ID NO: 3077 - DNA, 201 bp, Homo sapiens
  source 1..201: mol_type = unassigned DNA
gtttcccgcagataagtaaacaatctggacgtgaaatggaaatggtaattaatgcagtaatgctgttacacctcgagtgtgcaaatcccattgactcgccgcgccacggggggtgccgggcgtacggggaccggtggcgtgcgcccaggctgcccactccctccctcctctctccctcctccctaggtccccgggcggggc

SEQ ID NO: 3078 - DNA, 523 bp, Homo sapiens
  source 1..523: mol_type = unassigned DNA
ttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagca

SEQ ID NO: 3079 - DNA, 276 bp, Homo sapiens
  source 1..276: mol_type = unassigned DNA
ccgcccaggcagcatcctcgcagcagccgccaacgagctgcagccgccgcctactgtccgcgccggctctcgcctcccggtgcctgccgcaccgtgggccgcctcgccgtgcccgatgggtgcgcttctagcgctgccgccgcggcgctcggcctcgggttcccgccgctgcgccgctagctcgccggcagcagccgcgctcactggcgcggacccggagcggctcaggcgctcaccccgggacggcccgtgacgtcacggagggagggaggtggc

SEQ ID NO: 3080 - DNA, 357 bp, Homo sapiens
  source 1..357: mol_type = unassigned DNA
atccttcccccaggcaggagcagacacctgcttgtccccacggcgcgccagcgccctgctctagccgtccctgggccagagctcgaaactcacccactgcgctcccaccccggcacagacagccctcaaagttgtccgtactccccagacctcgccttctgctcagcccccggaccccgcccaggggttgagttgacgtccgcgggtggacctctctggtccgctgcgcagggaactgacttcgggaatccagggcgcacagaggccaaagaagctgcggcaagggagggtgggcaaatccagcttgagcctaggtccttgccgctttcaccctcaagcctgccctgcctccctcct

SEQ ID NO: 3081 - DNA, 278 bp, Homo sapiens
  source 1..278: mol_type = unassigned DNA
tgccgcgctgccgccgcagtcagccgcgccgccgccgctgccgcagcgcgggcggccgcgcgccggtagcaggggcttggcgaggaagccgctgagcctcgcgcgctccgcgctcctggcggtcgcagcgctgcctattaattgattctcttattgatttatttaatttttaggagcggctgctcggaggcacgggtcttctcctaaacctgcagcgacgcccccggcgtgggcacaaaggctccgacggcggccggcgggggctgcccagcgcccgg

SEQ ID NO: 3082 - DNA, 336 bp, Homo sapiens
  source 1..336: mol_type = unassigned DNA
ggtgatgaagtttgggcagaaatcccctgtcggccgtccgctccacgcttccctcggggccgacactgccaacctctccgggcactgaggacacctctgcgccctggagcggtgggaggacgcggagcgccgttctctggcttccgacaccctgcccgccctctctagtgggtctgtggctgcgccctctcgaaggaagtaataaatctttctgaccttgggggtcagaggagacgcttcagttttccggaggggtgtgcgggcgggaccgtctttccgctttactggacctctggccggggctgctcttgtttcattgtgccccacatgcggagc

SEQ ID NO: 3083 - DNA, 311 bp, Homo sapiens
  source 1..311: mol_type = unassigned DNA
gggagggcggtaaggagtgcggaggtccaaacgggcatgagcacggggcggcccggccggaggcggccctgggcgcccccagctgcctccggctgcccccgctgcggcacccagcggcccatcggggttgcactgctgcagcggctccttgtgccacttgtagtccaggaggttgagcatagtgagcaccagcagcagtgcatagcccgcgcacaacaccagcgccttcctacggaacaccttcattccgagaggggacgcgggccagcggcgtcctgggcgccggggccactgcgggagcagggcacgcg

SEQ ID NO: 3084 - DNA, 201 bp, Homo sapiens
  source 1..201: mol_type = unassigned DNA
aacgccggcaccggctgggaagcttcggtgctccgggtccctcttggcgagggcggagaagtcggcggcctctgcctagaattctgtgattgtagggatcgagacatcaagggcgggggtgcagaggattacaagttccctagcgcgtctcatttgcacataaatgtgctttgcctcctaaccttgtctctgttacctgtg

SEQ ID NO: 3085 - DNA, 201 bp, Homo sapiens
  source 1..201: mol_type = unassigned DNA
ctcccacttcgcgcctctcggaattccagaactcgggtggccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttt

SEQ ID NO: 3086 - DNA, 481 bp, Homo sapiens
  source 1..481: mol_type = unassigned DNA
ccggggccgcatcgccatggcgacctgctcacctgactcgctccgggtggactcgccgcgacccctgggcgttcaggcccctgagggcccaacgggcgacggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcg

SEQ ID NO: 3087 - DNA, 280 bp, Homo sapiens
  source 1..280: mol_type = unassigned DNA
gagccagccggaggggcggcggcggctccgcgcgcccagagcctcagcccatgaatgggactccaccctgagcgccccctcccgggcctggggaggcggcggcgcggcggcggggggcgccccgcaagcccgcggctctgagcggccacccgcgcagcaagttgggcgagttggcagccgcctgcacctgcctcctggccccggcccctgattccgcctccggccccaagcgcccgggttgcgccctcggctgcctcgcgaggtagccccaggaggccta

SEQ ID NO: 3088 - DNA, 252 bp, Homo sapiens
  source 1..252: mol_type = unassigned DNA
gcgtggggagcttggtatcttatccaatcagagcgctggattgagaactgcccaatcaggcgcgcagccggagaggagggggcggcatccgggatctggcgcggcttttgccttttgcgccagcgtgagctcggttagggtctccacggccgtgctttcacccctcagggaggcgtcggtgattcggtcacagcctcagcctccgtcgctctgtgacctgcgggtattggatgattcgtagctgagactccg

SEQ ID NO: 3089 - DNA, 239 bp, Homo sapiens
  source 1..239: mol_type = unassigned DNA
acaggcgatggacccctcgggctcccgggggcgccccacgtgggtgctggccgggggtctcctggcagtggccctggcgctggggggccgaggctgtctcggcgccagctcacgtccccgctggcgccccctcggcgcgcagccaccccgggatccccaggtggctcctaggtctgggcccggcctgaggatccctccggggcggagcggggcggggcccgagagcagcacgcaggtaa

SEQ ID NO: 3090 - DNA, 405 bp, Homo sapiens
  source 1..405: mol_type = unassigned DNA
agttcccaaccaggctcaaggagtcgcagagccggggctccgggcccgcaggacccagaagccacgcgccccgcgctccccgccccgccgctgtctgctcggccgacccacctggtgtcgcgtgcgctggcggcccgcgcggcagccaagccaaaggccgaggccgaggccgagcgcggcgcccagcagcacggcgggggccagcagggcgggcgccggccgcagcgcgtcccgccccagcagcagccgcgcgtcgctcttgcaggccgccccgccgcgggccatccggggcgctcaggctgccgccccgccgcatcccgccgcctgctgcaccgtccccgccagggcggcgacgcgggacttggagcccgggcgggccaggggcgcggcccgctccgcagactt

SEQ ID NO: 3091 - DNA, 237 bp, Homo sapiens
  source 1..237: mol_type = unassigned DNA
tcaagctgctgtcgcccaaggtcaccaagcagaactctctcaacgacgagggctgccagagcgacctggaggacaacgtctcgcagggtagcagcgacgcgctgctgctgcgcggggcggcggccgccgtgccctcgggcccgggagcgcacggtggtggcggcggcggcggcgcgcaggacaagcgctcgggcttcctcacgctgggctaccggggctcctacaccaccgtgcgcg

SEQ ID NO: 3092 - DNA, 204 bp, Homo sapiens
  source 1..204: mol_type = unassigned DNA
agccgagcagcagccctagagcctctcgcaagtctctctcacacttccccgccctcgccccaaaggagcagcagctccttcttgcctctccattgccgccgccgcaccggcggagctcctctctcgcgcgtctctcctccgatggagctcgggcgccgccgacgccgccgctgccccgaaccctgagcggggccgccccggtcg

SEQ ID NO: 3093 - DNA, 224 bp, Homo sapiens
  source 1..224: mol_type = unassigned DNA
ggtcggggtgcgcgcgtgtgcatgctgtgaatgcgttgcgcgatgtgcgcctctattccacacccagccggtctcttgcttgtgctgttcgagtgtggacgtgtgtacgcgttgcattcgctcggtgtggcagcgtttcgtgagctcctggaggcagggaaaggctacttgtgtttagaggttctgttgagggcgggaggggctcagccccagtggggagtcct

SEQ ID NO: 3094 - DNA, 278 bp, Homo sapiens
  source 1..278: mol_type = unassigned DNA
agcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcaggtaagtacctgtggatctaaacgggcgtctttggaaatcctggagaacgccggatgggagac

SEQ ID NO: 3095 - DNA, 232 bp, Homo sapiens
  source 1..232: mol_type = unassigned DNA
gggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccacc

SEQ ID NO: 3096 - DNA, 331 bp, Homo sapiens
  source 1..331: mol_type = unassigned DNA
tgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgtt

SEQ ID NO: 3097 - DNA, 231 bp, Homo sapiens
  source 1..231: mol_type = unassigned DNA
gctgcgccctgggcgcatctgcgcgcctggccccgcgccccgcggagagggcgatgggtcccggtcaggactgagccccccttcccctctccccagtcccgcctggcaccccctcctctgccccgagggcgagccacggtctgcgccgccgccttcccctccggtgcccccggctcgccgtcctcccgcgccctccctccccggacccgttcccggggccaccatggccgc

SEQ ID NO: 3098 - DNA, 201 bp, Homo sapiens
  source 1..201: mol_type = unassigned DNA
tgcccggccctgggcttagcccgccggcgctgctgggggcggcaagttccgcaccagcctctactcgcctcaccttccccggctgaatgagtgtcagcccgcgcactggggccacccagaggagacgggcaaagccgcggctccacgggctgcactactggccgcggagcccaggggagctgcaggagaaaccactgcgag

SEQ ID NO: 3099 - DNA, 201 bp, Homo sapiens
  source 1..201: mol_type = unassigned DNA
agctcgatgaccaggagctcccggccctcgaagctgcgccccaccgtgtaaatcctgctgatggcggtgcactgcagccacacggacacgagcgcctcgcgcagctcggggtagcggtggtactcgaaggagatgccgtcctcttgctgcagccgccggcgccgcctcatgcccgccgcgggcgccccgggctcctgggct

SEQ ID NO: 3100 - DNA, 219 bp, Homo sapiens
  source 1..219: mol_type = unassigned DNA
ccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccg

SEQ ID NO: 3101 - DNA, 284 bp, Homo sapiens
  source 1..284: mol_type = unassigned DNA
gccgggggaggtggggccgccggggaggaggcgagggaaacggggagctccagggagacggcttccgagggagagtgagaggggagggcagcccgggctcggcacgctccctccctcggccgctttctctcacataagcgcaggcagagggcgcgtcagtcatgccctgcccctgcgcccgccgccgccgccgccgccgctcagcccggcgcgctctggaggatcctgcgccgcggcgctcccgggccccgccgccgccagccgccccgccgccctcctcccgc

SEQ ID NO: 3102 - DNA, 429 bp, Homo sapiens
  source 1..429: mol_type = unassigned DNA
aaagcatctctctcccaacccatgaacggatcccgacccctgctctgccaccattcatgcgtcccgcatccgaggtgtcgccttcacccacacgccccacggccccgcgaaactcggccctccagctcgcgggacgcgctgcctgccaggcgggcccggcggtacctcgggggcgggaggggtcggtcgcagggcccccagcctggcgcccgcggggcgtccgcagcgaaggggtgggtgtcgctcgtgaacgcagcagggaccagctcagcccgcgctcgcccctgggcctcggccaccgcctctccgccactttctcggcccctgcgtggaccggcccgtggcgggggctgctctgcgccctcgtccccgcagcagtcgcggacccccattaacgttgacgagtcagtgtcgcgacccggggagaga

SEQ ID NO: 3103 - DNA, 283 bp, Homo sapiens
  source 1..283: mol_type = unassigned DNA
aaaagaccgcggtggagaagatggggcgttctccgcgacactcggctgcccagaggtgcaaagccggtgggcgcacgcccggggcggccctacagccctcgggccgccagtctcagggtgtcgggctccaactaaggccccgaagcccccacgcacctgagggcattttgaccagctcttgcgggctgtcttgcggccgcagtgggttctgaaagtccattccggcgtagggtggaaaccggcgggaggcgttgctgattctcgattaaacaatagtgacgag

SEQ ID NO: 3104 - DNA, 241 bp, Homo sapiens
  source 1..241: mol_type = unassigned DNA
cgcgggtggcggcggctgtggggccgtctgggattctccgcagcactgaccctgcaacctcctgtgtctgcgcttcgtggtgaggggcggcgggatgcgcgcgatccctttttgactcagccaaacggaaaagctcgcgcgtcccggctggaaggtggaggtcaggcaggacccggcaaaggcacattccaaacgaagcagaccccattcctcacctgcagagggaaggcggtgtggacgg

SEQ ID NO: 3105 - DNA, 244 bp, Homo sapiens
  source 1..244: mol_type = unassigned DNA
gcagcagccccacgttgttggcgcaggcggcgcgcaggagggtcgccgtctccgggacgctttccgggacgccctccgggacgctctccgcgctctcgacgccgtgctcctcctcgtcctcgaaagggtagaaagagtcgtccgaggcgatgctgcgggtgtctggcagactcgagaagtcctcaaactcttcgtagtcagcggggtcctcctcgacctgcgcgccccggggtggggacggcgg

SEQ ID NO: 3106 - DNA, 225 bp, Homo sapiens
  source 1..225: mol_type = unassigned DNA
gcagggggcgctgcgctcgccgagctcggaggggccgccgggccgggcgctgcgcactcgcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactga

SEQ ID NO: 3107 - DNA, 249 bp, Homo sapiens
  source 1..249: mol_type = unassigned DNA
cgccgctctcgcggcggcactgggcatgctccgcacccggggccggtttcggcggcggggcggacgctccctcactagccgggcgcccgggccggccgccgaggtttaggtggaggctgaggctgccgcgcgccgcgggaggagcctcgccctcggcggctgaggcggcggcggcacaggtggcgcgggccgcgcgcggggcgcagctcgggagcgctcggcgccgggcgccgcggcggccccaggctc

SEQ ID NO: 3108 - DNA, 255 bp, Homo sapiens
  source 1..255: mol_type = unassigned DNA
cccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtac

SEQ ID NO: 3109 - DNA, 243 bp, Homo sapiens
  source 1..243: mol_type = unassigned DNA
acgtttgcctgagccgtgttgccggggaccagcgacctttcacccctcccttcccacaggagcgccccggcccccgcccccgccccaaccgccggcgcgcgtcctcaccgcgcacgcgctcccctcgcgcgcgcacacgctcgcgcacacacgctccctcgcccccgcccgcggagttccccctcacccctcagccgccccgccggctgaagcatcggcgctgggaggcggcggcgctgctga

SEQ ID NO: 3110 - DNA, 201 bp, Homo sapiens
  source 1..201: mol_type = unassigned DNA
cggcctgctctgggctcgtgaggcgaggccgcagcgccccgacgccgggtgggcgtgtgggtggagtggagacttgggtccctcggcgcatgggagtcccgccgcctgcggtagggaaccgcctcccacccctggcccggcccgggccgggagccgtgtcccgcgttgactcggtgtaactctccagctcatttctctcca

SEQ ID NO: 3111 - DNA, 208 bp, Homo sapiens
  source 1..208: mol_type = unassigned DNA
gagaattgaaaaggaaggcgaggagcaggggctgcgggccgggcttttgttgctcgcggtccccgggggccgcgccgcgccgggccacgtgggggctctcgccttccgagcgggcgtcggtgggaaacctgcgcggcgagagacagggggatggggcgcttttgacgcgactgtggggtgcgggtagtcctggaggaggatgtccggc

SEQ ID NO: 3112 - DNA, 257 bp, Homo sapiens
  source 1..257: mol_type = unassigned DNA
tagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcgggtaggcgggcgccggggctgcggggaggcgcgggaccggggctgcgggagcggcggcggctgggggctggggggggtaggaaggcgaggaaggtacttgcggagagctgaa

SEQ ID NO: 3113 - DNA, 350 bp, Homo sapiens
  source 1..350: mol_type = unassigned DNA
aaagtgcttgtaaagtctgagcagagtgcgcggggccgagcggggagaagggtgcggggtaccggggtgagatacaggaaagaggaggacggtggggagcggtagaagacagcgtccccaggaccagcgactctgtggctcactcggccactgggtctcggcgcaaaccctccctaggcagtgcgggcgatgctgactgcagacgtcgggcagggctttcgtgcgggcgggagcgggggaagccagtgcgcccgggcgtcagctagttgatgcgggaagaggctggggagctgcagggccgtccgcccccgggtgcggtgctctggcgcagggcctgggctgagccgttc

SEQ ID NO: 3114 - DNA, 216 bp, Homo sapiens
  source 1..216: mol_type = unassigned DNA
ccaccctgcccgctagtacatttcagagtctctaacccctccctgcatgcaagcccaggcagagtcctgccaggtttcacaccagagcacacccctgcacggactccccaggaccgcggcgccggctggctgcctcggccccccgcggccgcgtgagctccctcttggtggtggagggcgcatttcaatctggaaactcccagcccctaatttggt

SEQ ID NO: 3115 - DNA, 269 bp, Homo sapiens
  source 1..269: mol_type = unassigned DNA
ccgcgaagggcacaacctgagaagcccgtggcagcccctcgcagcgtcgggtgacacagggctcccccacccccaggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgcc

SEQ ID NO: 3116 - DNA, 258 bp, Homo sapiens
  source 1..258: mol_type = unassigned DNA
agcaaaactcccactaccctcccggtgcttaccagtccgctcctccaggcctctgggaccatctcactcaaaagcagttcctctcagcggggtccagatcgtccctgagatttcgctgagaaactttcagcgggttagcgcttgggcgctgggcgccgagtccgacatggctttctggatgccgttgatttgctcgccggctgttcagtctctgcctcatcccggggcgcagaaaggggacgggcaggggcccgatct

SEQ ID NO: 3117 - DNA, 224 bp, Homo sapiens
  source 1..224: mol_type = unassigned DNA
agcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcaca

SEQ ID NO: 3118 - DNA, 256 bp, Homo sapiens
  source 1..256: mol_type = unassigned DNA
ggccgtgtagcccgccccgctcctccttccgaagagagatctggtgctggcatgggcaccccgcggccaccggagtggcttcccggatgagcctggcttcggcgctgacgctctggccctgggggctgcctggctggtgtcaggtagcggaagacgcctggagagtcactcgctccttcccccacccgcccccaccgctgctcgtgccaggacgcgcagtttgcagttgcagctcaggcactggcgcgggatggcg

SEQ ID NO: 3119 - DNA, 310 bp, Homo sapiens
  source 1..310: mol_type = unassigned DNA
ctccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttccc

SEQ ID NO: 3120 - DNA, 410 bp, Homo sapiens
  source 1..410: mol_type = unassigned DNA
aaggatccacccagacgcacgcccgcgcggagacgcacgctggcacacgcgctcacacacgcgagcacacacacgcgcacactacccggttcgtgcgcgcgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcggtggcctcagctccaccagtaactgccgctggcaggagcaccacacgctctaggagtttcccgggtatcaagtatgggtccagcccgtcccagttatcct

SEQ ID NO: 3121 - DNA, 274 bp, Homo sapiens
  source 1..274: mol_type = unassigned DNA
agaccgagggaacgctgctcatgcggtgagagccagcgcgggaggcggcgagggcgcggggagaccggggagggggtgggccccgcggcgcccgccgcccgcccccacgcgcgctgtcggtatttgcccgccttgctgcaacttgctgcagtgtttgaaagagtagtaggagcgcatggaggtggggccggggaaagaccaggcggagtggttgtggggtgagcgcggagtgggtggggaggcggcggcggtggggaggggggactggccccag

SEQ ID NO: 3122 - DNA, 201 bp, Homo sapiens
  source 1..201: mol_type = unassigned DNA
gccgccgccgccgctgcgccgctcttcacccagagcccggcggcgccgccctcctctcctcccgcgtggtggcggggcatggcatcaccacgggcaccgcgagggggccgccagcgcctgcggcgggggcagcggcctcatgtgcgccggcgggtttcaaggaggaagccggcggccgacggggcgcccgccagccagaga

SEQ ID NO: 3123 - DNA, 265 bp, Homo sapiens
  source 1..265: mol_type = unassigned DNA
ggccgggaggcgcggagccagccgcctacggagcccaactgtttgcatcggggaccggcgggcggggcgcgcccgagtggtctcgccgggaaagggcggcgggcgctggagaaggcgcctggcgcgaagctgggcggcgccccgagggcggaggacaggtggccgcgcgaccgcagccaggtagcgaacggctcgggggctgcgcagcgcggtcccaaagctcagcccggccccgggcccagctcgctgccgcctgccacgggag

SEQ ID NO: 3124 - DNA, 201 bp, Homo sapiens
  source 1..201: mol_type = unassigned DNA
gcgcagggggcagctgcgcataacgcgctcctggcagcgcggcggctgcgggcggggcgcgctccacgtgcttgaaggcggacgcctcttccggggggacggagagcagagggaagccgcgcagggccccagagcagggcaggccaggcggcggcggcggcggcgggtccccagcgagcaggcacttgggatggtggtggt

SEQ ID NO: 3125 - DNA, 362 bp, Homo sapiens
  source 1..362: mol_type = unassigned DNA
tttcaaaccgagtcctcgggtgtgcagacccgcagcggagtcgcgggagcgaggtgggaaatcctggccgcggcgccgggctccgcccgccggggggcgcggggcggcgggcgcatgcgcgtgcgcggtgcggccccagccctggctgccgccgcctgccgccgccgtcgcgatgcctattttagtcaaagcggctgcgggcttggggacccggcccgggcagcggagcttccggacccgccgacccgccgaggagcgcgcgtcgggctcccgtcgagcagctgagcccgtgtgccccgcgtcccgcgccccgaagctgccgctccgaactttggtcggcgctgcccaggctccccgccagg

SEQ ID NO: 3126 - DNA, 298 bp, Homo sapiens
  source 1..298: mol_type = unassigned DNA
cagcggagacggttaagtgttttttcattaactctccttccccggagctcaggggtgctgcatgggcggcgcttggacccgcgctctggagtcatcaggcggagcaaagccagcgcgctccgcggctcggaatccagctggctcgctaccctcccactcctgcgattttactcccgaccgcgctccagggcagaagcgcctgagctcccgctagtgggcatttaaagcccatgcccggcgggcgtgctgacgccactcgggggctgcggagcgggagggggcggtggggggcggggac

SEQ ID NO: 3127 - DNA, 295 bp, Homo sapiens
  source 1..295: mol_type = unassigned DNA
gaaggacacgcaaacctgccgagggctcgggggctccgggctgctgctgctgccagcgtcctgggaagtgacaggcattaggacctgctggcgcggcggcggcggcggcggcagctccagccgcgcccgccacacataccttcactcgctcggtgcacacgccgcgccgcgggcagtgccgcctgcggaggcgcgctcggggcccgcaggggcagcagcggcagcctggcagcgccgccgcgccctcgggcatctggcccgcgaagtttcgcccctgccgctctccgcgccgctc

SEQ ID NO: 3128 - DNA, 203 bp, Homo sapiens
  source 1..203: mol_type = unassigned DNA
ggatgcggccgcgcaggcgctcgctccctggcttcctggccgggtagcgggcgttcggctaccggagtccagcctaagggcccagccgaggtctccccgcgcgaggcggttgcgctaggtgagcgggtaccgcggccgcgcctcccttgtcatttactcagcggtcagaggcatcctgcgtctgggagtcccaagtgccttcg

SEQ ID NO: 3129 - DNA, 215 bp, Homo sapiens
  source 1..215: mol_type = unassigned DNA
agccccaaacctcacgccataaagccccgaagaggcgggttgggggcgggggccggggcggacttccaggggcgtggctgcgcgcctgcgaccccggaccgtgccaatctcgccgccgccccaaaacctgtgggaaaccccagtcctgccacccactcctcctggaggacgcagacaggatctgctctgcaggagcccaggccggccgatccgcg

SEQ ID NO: 3130 - DNA, 201 bp, Homo sapiens
  source 1..201: mol_type = unassigned DNA
gggcggcggcgcgcgggggacccactccgtttttatttgacctcgggtgactgcctattgtcatggtttgcgatctcgcgtggggaccgcccagggcctcggggccctggatgtcccgggtggcgccgccgtaatctccgtgccctccgcgccgcccccaccccgcccccacccgggccgactcgagcggctgcagcctcc

SEQ ID NO: 3131 - DNA, 340 bp, Homo sapiens
  source 1..340: mol_type = unassigned DNA
cccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcc

SEQ ID NO: 3132 - DNA, 201 bp, Homo sapiens
  source 1..201: mol_type = unassigned DNA
ggcggagggacagagctggactcggaagccgcgggtgggagctgctcctcgcgagcccgaggctgctggcaccttgtcgcgggcagcccgcgccagcctcgggagtccctgggctccgggagagcgagccggggtcgcctggccacaaagatgcccgcgcgcccgccctgcgtacgggacccgccctgcgccctgagccct

SEQ ID NO: 3133 - DNA, 236 bp, Homo sapiens
  source 1..236: mol_type = unassigned DNA
aacgctcggccaggtcccagagttcccgcggagagcggggcgcctgctgggggcggccgggagggccgggccaggggcgcgggagaccccgcggggacgcgaggtgttgcgggttttgtgcggttggttgggaacgaggagaatgtgccatcaacagtgtccaatcgactgatcaccttgggtgctgtgtttcctcccttatctctctttacctttgggaaaatgcactgctcagg

SEQ ID NO: 3134 - DNA, 251 bp, Homo sapiens
  source 1..251: mol_type = unassigned DNA
gtgcctgaatctcccgggacacttagacggctggagcctcccgactccaaggcgggcgacggcaaagttaaacgccagcgcgctgcggtccccgggcaccgaggcgtccccgctcccgccacccacacagggcgccaagtgccccgacccgcgagtgacgaggacgcacaggctagtgacacgacccgtagccagcactgagcgggacgacggggcccgagcgcaggagggtgcgcggggagctgaggagc

SEQ ID NO: 3135 - DNA, 201 bp, Homo sapiens
  source 1..201: mol_type = unassigned DNA
tgagcagctcaggcagccgcggtggtcgtgaacggggcgggagtggggggtgcccaggccatcagaggcggccccgcggcctgcaccggctggagtgggcgactcagagtctgagtggagggggcggggggcggcgacagcggggggtcctggcagcgatggcctgaacctgcgccggtgggggatggggcgggggcgggg

SEQ ID NO: 3136 - DNA, 206 bp, Homo sapiens
  source 1..206: mol_type = unassigned DNA
gcgctggggaagggacctctcggaggcacggggcagcgtgcgggctgcggcagcgaccccgacccgggcccccgggctttgtcgggctgagcctgcgcccgctccgccgccgccaagttcctccaactttgcccgctgcgctcggatcgcgcgccaggcctgggggcgcagcaggggctgggggcgcacgctgcgcactcggggac

SEQ ID NO: 3137 - DNA, 201 bp, Homo sapiens
  source 1..201: mol_type = unassigned DNA
gctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggtgagcggcggcc

SEQ ID NO: 3138 - DNA, 203 bp, Homo sapiens
  source 1..203: mol_type = unassigned DNA
tgggacttcctttccaaaaacgtaggcgttttcccgggtcgcagtcgcagtcgggagactgagggttagggcgcggccgcggggtctcctgggccggggcgcggcccacgtctcaggcctctgcggctctgaccagaagccgctgcgcctttggccgcttcccacccgtcccgtccccgcaatcccaggcccagggttacagc

SEQ ID NO: 3139 - DNA, 216 bp, Homo sapiens
  source 1..216: mol_type = unassigned DNA
taggggagacgaatcgattggctgcccggccgccggaacggcaggtcccgtcgctcccctcgcctcccgcattcccggcccggtcccctcccatcaccgcgtcccgccccaactcgcagtcagcatccccttcccatcctctccccgtccccgctgccacttccttccttggatgttggaagcgcagctggtattttcgttctcccaaccccccaa

SEQ ID NO: 3140 - DNA, 335 bp, Homo sapiens
  source 1..335: mol_type = unassigned DNA
gcccacccgccccctaggtgacccggcgtcctcgccgcgcccgctggaagtttgcaaactttctccgggggttccgccgccacgctgggaagctggggacgcggggggaggttcctggctcgccgtctccgctgccgcttgaccgcacttctggagggctccgcaccttgccaggtctctggaggcaaacacacacccccgattcataactggtccccgcgtcaggggactcgcgcgctcccacacacgcacgcacgccgggcggactcggcgccggctccacgttagcatccctccaggcgcgcggcgcggcggccaccgagcgctccggcact

SEQ ID NO: 3141 - DNA, 230 bp, Homo sapiens
  source 1..230: mol_type = unassigned DNA
ccgggcgctgacagacgacttttctcacttgtcagttttctcgcttgtcagcagagctgctggtaagtgagagaaaacagaggggcgcgaaggcaggcgcggccagggagtgagcggggcgctgggcgcggggcggagccgggtgcgcggcgtccgggtcaggccccaccgcccgcgccggctcccgctttgctcagccgccgcttttctctcccttctcactttctctc

SEQ ID NO: 3142 - DNA, 224 bp, Homo sapiens
  source 1..224: mol_type = unassigned DNA
agcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactg

SEQ ID NO: 3143 - DNA, 211 bp, Homo sapiens
  source 1..211: mol_type = unassigned DNA
gggacacgcagggggacacgcagggactgcccgcgcgaatggcttcgaacgcatgcgctccaccctacatttcacagtcgccatgacgaccgggaggtccgctcgtcaacggctagtcaacggctgcggggacaagtccgttgaggctgccaggcgagtcaggcctttctggacctcgcctgactcggatgggctgtgcctgaaattgacc

SEQ ID NO: 3144 - DNA, 205 bp, Homo sapiens
  source 1..205: mol_type = unassigned DNA
ggcggtgccaggtcggggcggggggcttctccacccagcacggggcaccaggccgggatgggacctttttccagaaagtcgattggatgccaggagaggcgtacggctgggggtttctttctttctctttcccctccctcccgcggttgaaccaaatcagaactgtcactcagggcttgtgagtcagaagggatcggattacacg

SEQ ID NO: 3145 - DNA, 398 bp, Homo sapiens
  source 1..398: mol_type = unassigned DNA
ggcgcgggccccggcgcgcccagcagctcggccagcgccagcgcgcccgccagcaggctgagaacggccagcgccttcagcgtggccgcctgctccagccgcagcgtgtagccgcggaacagcgcctccagctctgggcaagcgaactcctcgtcgcacgcccggagcccgcgccggcggcttgtcccggccgcccgctcggcgcccccgggctcgcccgcgccgcctccgccgccgcctccgccgcgcggcgcccccgccatctcagcgccatgcagcggccgcggccgcgggcgcgcccctcgccggcccggggcgccggggcgcgggcggcggcgccggggcgggcgggcggcgggcggcgaggcgccggggcgcggggcgcggggcgggcggag

SEQ ID NO: 3146 - DNA, 290 bp, Homo sapiens
  source 1..290: mol_type = unassigned DNA
catcgcgccgcggccccgcacgggatgcggcggccggcgctgtgtccgcgggccgggcagcccggctcggccgcggcgctgcgggacccgcgcgtaacccgtgggggcgcggcgcgggcgacacgtgcgggccgccaggagggggagggggacgcgcgccgccgggcccgccaccctgcacccggggccgctggtcggtcggggcaccctcacgctcgccccgctggcgagactggagggactcgggacatcgtaaagcactttccccagtgtctgggagcgcccgctgt

SEQ ID NO: 3147 - DNA, 307 bp, Homo sapiens
  source 1..307: mol_type = unassigned DNA
ccaccgcagccggttccggccggattcaaacagcctcttccccattctcgggacacccactccacgcactcaccatttcccagcctccagatgttccgccgtcctccctatggatctcccagtacctgcaggtcacaggataacagaagctatagtagagtcaccgaggaactccaggaacggaggagatggaacagtggagacgcgaactaggatcagagcccggaagctaggagacaaaggccccgccatattgaagaggccgcctcttcctctgtagctgcgcacttgattggacagtttcacg

SEQ ID NO: 3148 - DNA, 212 bp, Homo sapiens
  source 1..212: mol_type = unassigned DNA
gggggtggctgtgggtccgaagtggaggacgagcatggtttgggagataaggaaccgtcctgagacagagaaggctcccgggagcggacagagagtgggcgaaatcggtgcgcagtaatcgcggcgccagcttcagcgcggcccctggggcgcagtcccaccccgcctcagcagctgcggagccttctgacgagcctccgcctggcagcact

SEQ ID NO: 3149 - DNA, 375 bp, Homo sapiens
  source 1..375: mol_type = unassigned DNA
cagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagcca

SEQ ID NO: 3150 - DNA, 201 bp, Homo sapiens
  source 1..201: mol_type = unassigned DNA
ggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaacccc

SEQ ID NO: 3151 - DNA, 356 bp, Homo sapiens
  source 1..356: mol_type = unassigned DNA
gggcggggcggcgcgcgggggcgggggagcggccgggacacgtgtggcggcggcgggggggacgcggcgcccggggctttaagaaggtgtggagcggggcgggcgctttcccaggcctggccgaggggcgtcgcgcagaggcggcggcggcgcacggaggcggcagacgacgcgctctcggcgcccgcagccccggtcccgcgctcccgcggcccaaagtaactttgggagccgccgtctcccgcggaacttctcggcgggggcccgctcccaggcccgctcccgagcccgttccgctcccgtccgccttcttctcgccttctctccgcgtggctcctccgtcccggcgtctccaa

SEQ ID NO: 3152 - DNA, 265 bp, Homo sapiens
  source 1..265: mol_type = unassigned DNA
atttccaggcaccactcgagtctgccaattccactttcgcttaatctcattttaaaatcctctacagatgaggctctgtcgctgccgcgaggggccgggcggccgcggcgggagggacagggggcctgggtgggaagggagcgcgagggcccctagcggttcgcggcctcgggcggattcccagaacgagtgcgggccgcccggactggcagactgcgagccccgaggggcgcgggacgcagccggctcagacaaagaaaccggc

SEQ ID NO: 3153 - DNA, 697 bp, Homo sapiens
  source 1..697: mol_type = unassigned DNA
gcggggaggcggcgggggcgggagcgggcgaggggccgcggtcggccggcgtccgggcctcgacccccgggccggccaggggcgcgccgagcagcaggccgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcgggtcgtggcgcgaggcgcagtagtaccgcttgtgcacggtgtaggtctcgtggcggctgaagcggatgttgcaggcctcgcacagcgtgcggctggggtc

SEQ ID NO: 3154 - DNA, 226 bp, Homo sapiens
  source 1..226: mol_type = unassigned DNA
gcagaggcgcgcagaaaacgcgcgggtggcgcgcgcggccacccagtgggtcccgcccgcgccgccggcgccgccgccgccgccgcacgtgcgccgccgcgagcgcgaagggcgttcggacccgcgctctgcccgcccgcctgcccgccggggccactgtggacttccaggtaacagccaagtgagaagccctccctatcaccgaaaggtgtctgcgctcctccca

SEQ ID NO: 3155 - DNA, 201 bp, Homo sapiens
  source 1..201: mol_type = unassigned DNA
tctagggaggatgggggtcgcgggggaagccgggcgcttcggggtcctcgacacccacatccccgcacggcgcacgctctgcctcgagtttgcgttctccgagttagcacggcgagcttgggatttccgtgcccctcttttgtggctttcgagaaacgccggagttccgtgtcctgctgggggttggggggatggagaaaa

SEQ ID NO: 3156 - DNA, 201 bp, Homo sapiens
  source 1..201: mol_type = unassigned DNA
cttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggta

SEQ ID NO: 3157 - DNA, 215 bp, Homo sapiens
  source 1..215: mol_type = unassigned DNA
agaggaggaaggaaggaggaaagaggaagacgggcggccggaggcgcggggctgcgcggcgccggccggcgcggcgctggaaggcgccggcgttaaccccgcgaggcaggcgacggagggggagcggcgctaatacataagagcactgcatcacgctaatcttctcccagaacagtatgcgtcagcagtacattcacgttctgactgaaggacaa

SEQ ID NO: 3158 - DNA, 252 bp, Homo sapiens
  source 1..252: mol_type = unassigned DNA
ccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttca

SEQ ID NO: 3159 - DNA, 203 bp, Homo sapiens
  source 1..203: mol_type = unassigned DNA
ggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcg

SEQ ID NO: 3160 - DNA, 201 bp, Homo sapiens
  source 1..201: mol_type = unassigned DNA
ggccggctccatgcggggcgctccgccgcgccgcgcccgcgctcctgcaccggggtgcggggcccagcccgacgcgcactcggcgctccgcgcgccctgcgggccccccaggccggcctcgggtgggctaggaccgcggcgctggcaggccggggctgagcccggctccccgcgctggagcctctgcgccgggtgccgccg

SEQ ID NO: 3161 - DNA, 201 bp, Homo sapiens
  source 1..201: mol_type = unassigned DNA
tgaaccccagagggctgggctttgatttgagtgccgatccgttaatgaggacgggaggataaggttgccgacgcagcggaaggtaggggggaagcgactcgaggacctgacgattatccccaggcaggggcttcccaagcaggcacggaaaccaacttcaccaaaccgcggagtggggactgggcccgggcggtgttcagc

SEQ ID NO: 3162 - DNA, 201 bp, Homo sapiens
  source 1..201: mol_type = unassigned DNA
ataacccccggaaggagggggttaaatgcggcagcggcgggcctgaaaagggccaggagcgtcgtaggaactggggtgcacaggccctcgcgtgcccagcgcttcgcctttccccgccccaggcctgccaggggcgcgcgtggcgcgggcagagcctggtgggtgggttggcgcggacagaagctctgccggggagcgggg

SEQ ID NO: 3163 - DNA, 213 bp, Homo sapiens
  source 1..213: mol_type = unassigned DNA
ccgaccgcgtctcctgcgctcgcccgcgctttccctgtcgcttcgcggttcaggggtgtgagtcacccggcgacagccccgccaggtcaccccggggcgcgtaggtggacacgcacaggaagatcgctatttttaagatttccatattgtttaccgtggggcgaaatcccacaattccttgcacaaaatgcataaataatattaaatgagctg

SEQ ID NO: 3164 - DNA, 385 bp, Homo sapiens
  source 1..385: mol_type = unassigned DNA
cttgcacgcatgagcaggtactcaacactttctggtccagctacatgtgacatgaggccactcacgctctttttaattaacccttatgacaatcatgtgcgttatggagaaaattaatggaggaaaaattacagagtcacccgaaacagttgcgctgcttatcacccggtgtttgagcctgtttcccctgtaattagattacatgtgaggcagccccagctaattgtctgtgccacccaccggggaactccagctctatctgtgaacacccaggccttcccgccgcaggacagatgttgggtgaggcttgcctcccacgcaaacatctgctctgttgttccgagtcagtcacgagagccagccggcttagacaagcaggggatga

SEQ ID NO: 3165 - DNA, 278 bp, Homo sapiens
  source 1..278: mol_type = unassigned DNA
agggcactaagaaaagaggggcatgcgagcctggaagctggagagagtccggggctccccagagcgggtgggacgccgcgtccccaggactccgcgccacgcgtactttctccaccccgacacccactgccactcccacagcggagcgaggggccccgccgagggcgagcgtaccccgtgcggctgagatgcccggaacgcctccccgcgccccggcttccccagaaggggccacagtcggcccgcgagtccccgggcgggggctgagccgcagtgcc

SEQ ID NO: 3166 - DNA, 248 bp, Homo sapiens
  source 1..248: mol_type = unassigned DNA
tcggcgcaggcgagtttggtccaagggctcggatcgggtttgggaaaagtttgtccctcgagggggagagcgagcggccgcgctgaggcgctcgcgctgcgcgggggcgtctcccgttgcctgcagggagcgcggcgcggacgcggcgggcggtccggccacctggaacgggcgctcgccctggctctcggggctgctcctgtcgccccgggaagtcgtcgatgggtcccaccgctggcggctcgcgt

SEQ ID NO: 3167 - DNA, 216 bp, Homo sapiens
  source 1..216: mol_type = unassigned DNA
tcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttata

SEQ ID NO: 3168 - DNA, 201 bp, Homo sapiens
  source 1..201: mol_type = unassigned DNA
gcacctaccagggcgtcccgtaaaaaacctcgccttcgcctgtctctgggaaccataggtaagctttgggctttcgaggtgcagttctaggtagagctccgtgctgggaggtgggaagggggcttgaccctggggactcaggcagtctggggacagttccaccaggggccggtgcctagaattggtgagggaggcacctca

SEQ ID NO: 3169 - DNA, 208 bp, Homo sapiens
  source 1..208: mol_type = unassigned DNA
cgagacggacaggaatcgaggagattcccctgtagcgctctccaccttccggacagaaatcctgtagaccacgttcacttctccactccgtgcatcgcccgtggcccgtgggcagcagctgctcccctgggatccccctcgcctgtccgcgagctctcgcacggccgcgtccctgctgctggggtcgctcgctggccctggctgctcg

SEQ ID NO: 3170 - DNA, 201 bp, Homo sapiens
  source 1..201: mol_type = unassigned DNA
acttggtttaatcgtcgccagccctaagtcacggcctcggctccctctcctcaactgtgtgggatcccgccgcctggtttcggccgggcggaggggtgacgtcagccgctcacacagtgccccctggccgctggagctcgggaaatctgtgcgctcgaacttggctccgccaagaagctgggcaaggatccgggctcctga

SEQ ID NO: 3171 - DNA, 364 bp, Homo sapiens
  source 1..364: mol_type = unassigned DNA
ggcggtcagcagggtccccgtccccggggagaagtgcccacgatccaagggctgtctgctctaggaacttcttaaagaattacagacactgagagcattcggggtctggtaggaagtgcagtgtatctcccagctttagggtaactaggacagcatgaatcttttaccttgtggtagaataaacggctagcgcctcgatgtggcgcgctcgacttttcctcacagagcctaaaagtcacgctcaaccaaactgcagcgttcccgcctcagctgggcaccggcctggaagcggcctggaatcagactggactcgaggaggtaagacctcggcagcgcgaggttaaccacaggcctcacccgcggc

SEQ ID NO: 3172 - DNA, 213 bp, Homo sapiens
  source 1..213: mol_type = unassigned DNA
ttctccaggtccttggcgctctcggcgcggctgtctccgcggctgtcctcgctcatggtcggcggcggtgcgcagcgcggcgctgcccgccgtgctgagcgctgacccgcgcgcccgctgctgcccggcccccggcggcgagaatggaaagttgccgcctccgccaactccgaggagagacagaagactttacatgctggggagaggctgggc

SEQ ID NO: 3173 - DNA, 201 bp, Homo sapiens
  source 1..201: mol_type = unassigned DNA
ggtttgcttttggaagaaccggttcctcagccccccgtcgccgcagttgtgacacaagtaagtgcagccgcgctgcccggggcccgccagggtcccccgcgcccgctccccaccgtggctcgcggcggccgcgctcccgccccgccccgctcggccgccccgccggcttctgcctccagttgggttgccgtgacgaggaga

SEQ ID NO: 3174 - DNA, 201 bp, Homo sapiens
  source 1..201: mol_type = unassigned DNA
cccacccatcgcgcccaaccactctgtacagttggcttttttttttttttaagtacagtttaagaaggcaaagggagataggaaagggtggcagcttgacgactcagcgatgcattttagaatcgcccttacctctccagtgtgaagtttcctgggagaggtgagccaaaccggacggccggcctctgcagccgcccagag

SEQ ID NO: 3175 - DNA, 296 bp, Homo sapiens
  source 1..296: mol_type = unassigned DNA
catcagccgggctggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccaggtaagcccccgaccgaggtggggggcggcgggcgcggggggctcgggcggccgaggcgcggtcccgga

SEQ ID NO: 3176 - DNA, 201 bp, Homo sapiens
  source 1..201: mol_type = unassigned DNA
gtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggg

SEQ ID NO: 3177 - DNA, 297 bp, Homo sapiens
  source 1..297: mol_type = unassigned DNA
tgcactcccgacacggagttggtgctccgggaaggctgctctctgaagctcttcttgctctgctgtggttttgctcctccgcggactcctttcccgtgccgaggttcagtttctggttttaaggaataaattcgctggcttgaaagggagctacggcagaagtttaggggcagagcggcgggagcgcgcgatccgcgcggctggagctccgggggtatctggagagcagcgcgtccaagcggggccactggctccgcggctgcgcccctcctcctcccgcgccgcgcctccctcccc

SEQ ID NO: 3178 - DNA, 268 bp, Homo sapiens
  source 1..268: mol_type = unassigned DNA
gtgcagcggggtctggcgccggcccctcctcatcacgcgcccggcccagggtcgctcagccgccgccaccgccgccgccccttgggtcgatggagtcggcgcggaaggcccgcgcgccctgcgccgccgccgctcagtgccgccgccagcacctcctccgcccctccgcctcccgggctcatcccgcgggggcggcgtcacctcctcgctgcccaggcccgggcaccgcgggcgccccgcgggcggcagccgcccctcccgagcgcga

SEQ ID NO: 3179 - DNA, 201 bp, Homo sapiens
  source 1..201: mol_type = unassigned DNA
aaggagcgggactgcccctccggctggacgacagcgccggggactcgcagcgtgcgcgggtcggaattaaaaaagcagcccgggagcgcgagggctgagcggggcaagcatgggctgctcctcgcagcctctctcctgcccgaggctcgggctggccgtctgtctgtctatgactgtctagttgtcccttcgactgctcag

SEQ ID NO: 3180 - DNA, 201 bp, Homo sapiens
  source 1..201: mol_type = unassigned DNA
ccaactcgtccgcagctgcccgctctggattaagccgctccgcggctcgtgctaggcagtgggttcgcttcctccttccctctcttctttaaattgggacgtgcgaaggcgcagctgcctccccggggctctctccatcccccacacaccctgttttcgcttcttgtctctcaggttcgtggcggagagatgctgatcgcg

SEQ ID NO: 3181 - DNA, 201 bp, Homo sapiens
  source 1..201: mol_type = unassigned DNA
gccctggagcctagcagagctggagcgcatatccccgctctctctccttcgtctccgagtactaggcggacacatccgtacctcgaatgcctcagtgggcgcagagttcaccagaaatggatagccggattcctcggcgcctgctgggggcaccgctgccaggtgcttggggctcgctctcccggctttgctcgcacaggg

SEQ ID NO: 3182 - DNA, 201 bp, Homo sapiens
  source 1..201: mol_type = unassigned DNA
ggccgccgggcgctgcagtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaa

SEQ ID NO: 3183 - DNA, 302 bp, Homo sapiens
  source 1..302: mol_type = unassigned DNA
cgcccggacgccggagggccccgacccccgcgcggctcatgcgcccgcgtccgccccgctgctccgcgaggcccgcgggacccctcccgccgccgccgccgcgcccgccgcccccggaggagcgggctggccgaccgccaccgcgccgtcccccggccgcccccgaagccgctccatcgcggtccctgccgtcctggggccgcgccccgctcccgcgccttgggggttgagccgagcaaacttcgcgcaccggccgacgcccggcggggaccccgctgcgcacccgcgcgcccgggtgggcg

SEQ ID NO: 3184 - DNA, 201 bp, Homo sapiens
  source 1..201: mol_type = unassigned DNA
cctccctggggcccttcatgccaggccccgcggctgtgtccgcaagcgcagatggtctcgggactcgggccaccctgacgccgcagacccagcacgctgcggaccgggcacgttggatctcgggacaagtgcggagggtcgggggctggaagggatccgagagcagagcccgcgtccccatttcacggacgcggccaccga

SEQ ID NO: 3185 - DNA, 220 bp, Homo sapiens
  source 1..220: mol_type = unassigned DNA
cggcccgccgccccgcacctgcgcccgcagccgcgcgcccgtccgcccgccgccgccaggccccgcggcccgggcgcccatgccgcgctctgcgcccgccgccgccgccgccgagagccgcggagcgcagcccgagggagcgccgggcgggggagccgagcgatcgggggcggggcggggggcgagagctggcccggggcccggcagtcgcccgccccgc

SEQ ID NO: 3186 - DNA, 347 bp, Homo sapiens
  source 1..347: mol_type = unassigned DNA
ggcggcacaccggcagggcggccggccttgctgggctctctgggcgccggccccgggggctcgggcggcccctttcggtcctcggcctggatccgcgaacgcgcgggcgcgaggggttgggacgcgggagcctcttgagtgcggagcgcggagccctggtgtcccggcgcactgcagccacactcccgggccgcgcgctcccgccgcctcttacccgcgccgcagggtcctcccctttgaggcgccgcccgcgcaccgccgggggggagggggcagcgccaacaaattggggagctcggcccgccgcgctcaggtctccgcttggagccgccgcacccgggacggtg

SEQ ID NO: 3187 - DNA, 201 bp, Homo sapiens
  source 1..201: mol_type = unassigned DNA
cgtgcacgccccgcttttattggctccgctccgtgaccacgcccccgcaaccttgatagactccacccccgaggacccttctcaggagcacagtgaccccgcctccacagggtccgctccgccacactgacccttccgtgtcgctcgcgggaccccacccctgtccgcctgctccggtgcccatggggaagcctggtgcca

SEQ ID NO: 3188 - DNA, 201 bp, Homo sapiens
  source 1..201: mol_type = unassigned DNA
cagactcgggggaattaggaaacgcgcccggcgaccctcgggcagtagcaccgggccaggtttgctttcggaaccgctgacgccactcgccgcctttcccgcctgggcctctcgcgggtcgcaggggtggaagcccgacctgggccagggcccggatttcttcctcccggcctctgcgccgccgcccccggtgccaggacg

SEQ ID NO: 3189 - DNA, 225 bp, Homo sapiens
  source 1..225: mol_type = unassigned DNA
ctgcagcctgggcaaccgagcgagactccatctaaaaaaaaaaaaaaaaaaaaaaactaaggctgaacccgggctcccgcacgcccgcacccacctgcgcggccatcacgcgctgcctctcggcgatcaggttgcacttcttgcactggcagtcgcgccacatgcagaagcgcttgtggcccttgagcggcgaggcgtagccgtggttcctgcagcgtgcgcact

SEQ ID NO: 3190 - DNA, 318 bp, Homo sapiens
  source 1..318: mol_type = unassigned DNA
ggccctggcagagcgcgcagcgagtcggggatgaggctctccaagctctcgttggcctgctgccggcgcagcgccacctgcgcagccatgacccgctgccgctcgatgatgaggatgcacttctcgcaggtgcagtccttgaagcggcagtaacgcttgtggcccttgagccaggacaggacgccatggttgcggcagcgcgcgcacttgggcgtgcgctgcaggggcgcccgtggcggctgcgacaccgggccgcccatgtacaggtagggggagccgtagccgttcatgccccgggctcccgaatgagttggcagc

SEQ ID NO: 3191 - DNA, 265 bp, Homo sapiens
  source 1..265: mol_type = unassigned DNA
gtggagggaaggagggaggaagccagtcaagtcctcagcgacctagcccagcacatcccgaactctgcaaagttctgctcggtcttctgcagcctcgggcgcctcaccttgctgaggccgctttcggcttcctctgacccaggctgggcgggaaaggtcgggccgcccccgcctggctcagatcgctggctcacccggcgggcgcgcgcagttgcattcagcgcagcgccactggcttcagtctgcagactgcgctccccttcct

SEQ ID NO: 3192 - DNA, 259 bp, Homo sapiens
  source 1..259: mol_type = unassigned DNA
gggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcggtaaggacctccacccggccctccgcggcctcccctccg

SEQ ID NO: 3193 - DNA, 201 bp, Homo sapiens
  source 1..201: mol_type = unassigned DNA
gagcgcagaccaggcctccagggcgcgggagcctgttgctctcccctgcaggggccgctcccggacgccccatccgccgttacgtggtcccgggatgtgcgggttgcggtagagagtgggcagcaatgctcctggtcctgcgttctcgccttagccgcggggaccccgaggcgagccgctaattggtaccggtgccccgtc

SEQ ID NO: 3194 - DNA, 323 bp, Homo sapiens
  source 1..323: mol_type = unassigned DNA
acgcgcctgccggggaagggctcgccggcgccgcgccttcgaggctcctgcggcgaaccgcgtcacgcgcgactcctggccgggggcgggaggcggcggcggcggcaggagaagcccaaggcccgagcggcccgcagcccccacgcctgcacccctccacccccgccagcccgatggttcgctccgcggcgtgcactggagcaagcaggtcccgctccgagcgcgcgcgctctgggaagtgctgcaagtttggagacctggagtgagctccgggcgctgctggcccgactgtccgcggtgtttccccggtgaggtcgcggggg

SEQ ID NO: 3195 - DNA, 201 bp, Homo sapiens
  source 1..201: mol_type = unassigned DNA
cagcggcggcggccgagcccagcccgtagggtgggaactgagacaggcgtcccacgctgcccaccgcggctgccgcggccgccgccgccgccgccgccacggccgccgcctcctgcatcttgccggggtgagacggctgctgaggctgcgactgctggggcggttgctgcgggggctgtgacgggaggtgcggaggcggct

SEQ ID NO: 3196 - DNA, 355 bp, Homo sapiens
  source 1..355: mol_type = unassigned DNA
cagcgccgtatagaagtcgcagagcagcggcgtgaagtcgcggctcggcgcgcaccgggccgccgcgaagtacagtgccaccaccttgttctgcagcgccgcctcggcctccaccgtcgcgcccttacaggtcaccaggtgccgctcgcccagaatgtcaaccatggcgcagacacgcagccacctgagacccgaggacacctgcaggaggatgatcacctgcggggaggcggcggcgagcgccgcggtgccccgcctctgtccgcaccaccgggcgctggacctctcaagacctgccccagatgcgcccacaccttggccaggcctcgcctgtggctggagcaattgtgttcgc

SEQ ID NO: 3197 - DNA, 201 bp, Homo sapiens
  source 1..201: mol_type = unassigned DNA
tgcacctgcgtcgcttttggctccttcaggaatgcgctgaagcttgtaatcagctttgtgaagccattgagtgcacggctgagtgaaacttccaaagctcgaggaaaacgggccggctgaatgggagccagcatggggcttctctccaagcctccgcgctgccaaattccagcagagcccctcacaatcgctccgcgcggg

SEQ ID NO: 3198 - DNA, 290 bp, Homo sapiens
  source 1..290: mol_type = unassigned DNA
ctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtc

SEQ ID NO: 3199 - DNA, 201 bp, Homo sapiens
  source 1..201: mol_type = unassigned DNA
tcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctcta

SEQ ID NO: 3200 - DNA, 201 bp, Homo sapiens
  source 1..201: mol_type = unassigned DNA
ctctagcgcccaggccgactgcgccctgaccgggagccactgcgcccagcgcagcccgagggcgctgagctcggaggatgcggcgcggggcgggggtctcgggagcaacagagactgggatccgagggcccggcccgcgctgctgcccacgcagcgcttccactttggaaagagtgtctcccgcgcggcgggccggcctct

SEQ ID NO: 3201 - DNA, 288 bp, Homo sapiens
  source 1..288: mol_type = unassigned DNA
gcccaggagaacccgcaagccagcggcgcctgcgcccgagctgcagccgccctctgccgtccacgcgagctcgagagcggctcccggagtccgggctagcgccgagctgcaggcgcgcgcctaaccgctttgctgggctcacgcggtctgagaggtcggagcgcccaactgctggcacgcgagtaacggcttagttaagctcactcggtctgagaggtcggaggctgcgagtgtcgctgctgaaggctgtggtggaccgggctggatcgcggattctgagctacatcg

SEQ ID NO: 3202 - DNA, 212 bp, Homo sapiens
  source 1..212: mol_type = unassigned DNA
ccttgcgtggtagatatttagggataggccaatcaccacccccaatcatccgtctttgagaggcccaggatctgtctctatttgatggatagtggtgcacggattaaagacgacgcaggataggtaacctcctcctccaatcccccgggaccagggtagctctgaagacccccagaggcagccaagcagccccttcccgcagcggggagtga

SEQ ID NO: 3203 - DNA, 201 bp, Homo sapiens
  source 1..201: mol_type = unassigned DNA
gaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcacggatggcgcggccgccccggcagcacccgggggtctgggcgtcgctgctcctgctgctact

SEQ ID NO: 3204 - DNA, 246 bp, Homo sapiens
  source 1..246: mol_type = unassigned DNA
cgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgc

SEQ ID NO: 3205 - DNA, 201 bp, Homo sapiens
  source 1..201: mol_type = unassigned DNA
cctcccagggatggagcagctacgccttccgagtgtgcccattccaccgatggagcaaagtgaggctctcagctcgcccggatgtctctgcgccgctcgcggggcagctctcgcacagacacgcccgcaagcccccgacccgcccgccacccgcgcccagacacccgcgagcctctggggccgcagggacggtgcagcgcc

SEQ ID NO: 3206 - DNA, 201 bp, Homo sapiens
  source 1..201: mol_type = unassigned DNA
accccagatacacaggcagtcgggattcccgcccggtgcgcttgtctattcatccctctgcgtcaggctgggacgcgctccgtctgtaaaaggctcaaacgcatctcccgccgcggggcgggatctaggggcccaggccccggggtccagaggcgggtaactttgctaatctcccccagcggcggggaacgtcgcgcaacc

SEQ ID NO: 3207 - DNA, 358 bp, Homo sapiens
  source 1..358: mol_type = unassigned DNA
ctaacgggcccggtgcatcgccaccgcggccccggccccgcccgagctcggctgagcccccaggccgggctccgggccccgggcgctcgcggggcaggacgcctcccgccgaggcgcaggggcagctacattgcggggcgcctgggcgacggcgccaaagccagggtcacaagggcacgggacaagcggggcggggggagcaggagactaggacagaggtcggcgcccgccgcgggcgctttcacgccgcgggcatcgcccgcccggcttcagcgcccggggcgcaaagcaagggcgcaaactctgcccgaggcggcgacggctgcggtcggggttcaccctgaagccgctaggtgtc

SEQ ID NO: 3208 - DNA, 201 bp, Homo sapiens
  source 1..201: mol_type = unassigned DNA
gctgcgtgttcgccgcccacagccgcagccaaagagacgcaggcggccccacgcggcctggttcaccgccgcctgcagtgtccgcggcgcggggcgccccgaggctgggctcaccgtcctctccgcgtccttgaagatctcccgggcctcctcgaaggagcactgctcctccttgcactccctctccagggagcccggccg

SEQ ID NO: 3209 - DNA, 201 bp, Homo sapiens
  source 1..201: mol_type = unassigned DNA
cgcctccccgtccccggcccgagcggccgtcatcgcgggcgggcggcgctgcgcccgggtgcggctcctcgccggcggcggcggcgcggccgagaggtgcgggctccgcgcgggcgggacgcggggcgctgctcgcaggagcgaccaggtgggcgccgggccgaccgcagccgccgtcgcgccccctctcgcgtcccgggc

SEQ ID NO: 3210 - DNA, 201 bp, Homo sapiens
  source 1..201: mol_type = unassigned DNA
gccgaggcccagagccggctcctgcccgcaggcggcgaacggcaccttgctccgccaggcccctgcgggtgtgatccgtgacccgcagattctcccgggcgcctctggcccatgacgcgggggctgctcgctccacgcaggcggcttcgggatgctctcccgctcagatttcagcggcagaaacagcctcggattctctct

SEQ ID NO: 3211 - DNA, 277 bp, Homo sapiens
  source 1..277: mol_type = unassigned DNA
aggggagcaaaacggagcccccgggggcacgcaggcttcgtttctgggtgttggttttgcttttggttttttcagccggtgcagtgacccggaacagcgcggccgcttctccgacgcccgcggctccccactgcgccgaggcgagcgccacggctaaagcccaagcctcggcgcccgctgcgcctgccggagttctgcttgtccgagcaggcagcggggctcaggcacggcggcgacgtcgaagggccagtcggcagacagggctgggtctctgcgg

SEQ ID NO: 3212 - DNA, 201 bp, Homo sapiens
  source 1..201: mol_type = unassigned DNA
caccctgctctcagcccgatcctccctgcgcccggagcctgggctcggcgcgcaggagactgcgtgcactctggcgtccccgacctctgccagggcgcacggggactccagagcggatcctctacgagttctaataggaggccagggagccgggacatcagagacaaattcctccgaagtccccctccggttccactgact

SEQ ID NO: 3213 - DNA, 247 bp, Homo sapiens
  source 1..247: mol_type = unassigned DNA
gccgccacagtcgccccgagctcgcgcgcagccctagttgccacgcggatcccctgctcagactgcgctgctgaagccggcgcttcgcttcatacgggccgcgccaactcggtcgctgtgcacggtcgggtgcgaaactcctccgcgggctcacggggctgccgaggcggggccgcagcggccgtcggggctggggctggtcccggcctgagacagcttcatggaaggccaggctcccggcccttgc

SEQ ID NO: 3214 - DNA, 201 bp, Homo sapiens
  source 1..201: mol_type = unassigned DNA
cgccgccccgcgcgccccggccatcgccgcgccttccccgggcgccagggaaggtggccaggtggcctctgcccgccgcgccctgcgcctcgcgccgcccgccctgcgccctgccttgcccggctgcgtccctccgggctcctccgccgccaccgggaagcgccgtccggctctgagcgctgcgcgggctgcgcgcggggg

SEQ ID NO: 3215 - DNA, 201 bp, Homo sapiens
  source 1..201: mol_type = unassigned DNA
cttgaagccggcggtgtccaggagcgcgccgtcccccgcgcagggccgcctgcgggcacacgccagcgcccctcagcccgcgtcgggcgccctcgcggacgcgcgcagcccccggcccgccaggcccggcccgcgcagcgcagcccgcggccaccgcgacccaccgggcgggcgggcggccgggcgggggcgggcctggcg

SEQ ID NO: 3216 - DNA, 201 bp, Homo sapiens
  source 1..201: mol_type = unassigned DNA
caggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccggtaggcggagggatcgcggagctcggggg

SEQ ID NO: 3217 - DNA, 356 bp, Homo sapiens
  source 1..356: mol_type = unassigned DNA
ctgatcgtgatgataagaaggctggggaggccaagagaaaagggaagagagagtgcagctgcaaacccttctccgggcccgagaagcaccgctctcctgcgtgttcaactggcatttgccaccaacatgtctgtttttatttaaatggcccagagcaaggctctgactaaactagcattcccacgccaacactcagcagcgcctctggtttttggcagattttttccttagctgtcaaagcaaaactatagaagcgtcctggtcttacttaaggcttgttggggctttttgccttcccccggagacccgaatagctcgcagatgtgcggtacctgcttatgttcgtgctccgtgtt

SEQ ID NO: 3218 - DNA, 201 bp, Homo sapiens
  source 1..201: mol_type = unassigned DNA
agccgacacgcgcgatgcgcgagaaagcgcggtgcaccgggccgctgtcgcggcaaaactgcagtacgtggcggcacacgctgcccacgcggccgtacacgcagcgcgccttgtgggcgtcccagtcctcgcggcggcacaggcgcgagcagtagtaggtgtagcagctgtggcaggacttgaagtagaggcaggcgttga

SEQ ID NO: 3219 - DNA, 281 bp, Homo sapiens
  source 1..281: mol_type = unassigned DNA
gggctccaccggggcgcagggctggggaaccggagctccgcccgccgacccggagcaccgcccacgcagacccgccccgggcgagggaggggccgggcgcgcacccgcggggagggcggcgagcggggatcagccgaagtcgggagaggggcgcttccacggggcgggaaactggcgcgcgactctgggggaagtgcaggatggggggacaggggcgctcccgcgggggtggatgggggaccatagcggggctggcggggcaggggccggcgcacgaggct

SEQ ID NO: 3220 - DNA, 222 bp, Homo sapiens
  source 1..222: mol_type = unassigned DNA
taccgacccctcgtgcagcggcttcgccccgccggacttcaaccattgcctcaaggattgggactataatggccttcctgtgctcaccaccaacgccatcggccaggtgaggcggccaggcgggccgcgggtctgggggcgggcagagagcggcgagggcggggcctcacgcccgctgcacccttctcacatccccagtgggatctggtgtgtgacctgggc

SEQ ID NO: 3221 - DNA, 237 bp, Homo sapiens
  source 1..237: mol_type = unassigned DNA
gcggctcggaggcggccatgatcatgcacatgaaggggcggccggtgcgccggtccgtggggtagatggtggtgggcgtgaagcgcctgttggcctcgacgaactcgcaaagctgctcgtagacgcgcgggaactcgtggcgcaggaagacgccgcgcagccgcagctcgcgctggatgtggatgaaggccacctcgcgcgcgcgccggcccgcctcgccgtcctgatccaggcccg

SEQ ID NO: 3222 - DNA, 201 bp, Homo sapiens
  source 1..201: mol_type = unassigned DNA
ggcctggaacagagacctcagctgacccacaaggacggggtttgagatctggggctctttgtcacagtggcataacccagcctgtactgactaatacagccccctgtgaaccccggctccaacattcaaatcaaggtactcggctgcttcattaagctgtcacacgttcattcaaaagcactgctagattgaggaaccagg

SEQ ID NO: 3223 - DNA, 364 bp, Homo sapiens
  source 1..364: mol_type = unassigned DNA
gcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagc

SEQ ID NO: 3224 - DNA, 201 bp, Homo sapiens
  source 1..201: mol_type = unassigned DNA
ccgggacacgccttagggaaaccgctcctgggcttggtagctgaacttagacgtcgagtgcagcccgcccggtgcgcgcggcgtcttactgccagatctcggaaatcagctgccagggtggggccgcgttttggcgacggccactcggccacccctgccgctcccgcctctcccaagagatttttctagcgggttaatttc

SEQ ID NO: 3225 - DNA, 201 bp, Homo sapiens
  source 1..201: mol_type = unassigned DNA
gcctcagaggggagccggggtggatctccatggaagggagacgcttgcgccagctcaggagtggagttcgtgctccaccggttccttaaactgcgagtacgaaatccccagaggggagctgagctggtgccccgcgtgcctctcactctccaccccccacccgcaggccagacctgcgctgcccaccccaggagggagcgc

SEQ ID NO: 3226 - DNA, 201 bp, Homo sapiens
  source 1..201: mol_type = unassigned DNA
ccgccccatcgatgcggagcgcgagctgcttattgtcttccatcatgctcaggattttggcctgggggcgagagaggtgacaaagagctgcatgatgcgcggggggcgcgcggccgggcacccccggctctacctgttgtgtcctccgcggcccggcttcgcccgcgccccgacccccaggcaccggcagcgccggttcct

SEQ ID NO: 3227 - DNA, 222 bp, Homo sapiens
  source 1..222: mol_type = unassigned DNA
agcgcacacacacagacacaggctcatatagacagactcggtcctaaaaatacgcactcgcagaggcaaaggctagcgcacaagcacgcacagacacaccgacaggcggcccccggacaccgcgctccctgccgcactcacggcccacgcaagggctcacacacggcctcacggaggacagtcataaaacacccagacacacgccacacacgcacgcgcgca

SEQ ID NO: 3228 - DNA, 201 bp, Homo sapiens
  source 1..201: mol_type = unassigned DNA
gttcatacatactagtgaaacggttaaatggcagtactaggtgctaagtgaccgtacaggcgtgttcttgtcagctgtgagcaagacaaggcagcttaccgctctcagggagcttagttctcatgggggtgtattcgtttgctagggctgctgtacctaagtatcaccaacccggtggcgtcaataacagatcttattgtc

SEQ ID NO: 3229 - DNA, 265 bp, Homo sapiens
  source 1..265: mol_type = unassigned DNA
ggcgggcgccggcggggcggccccccagtaagatgtgcgcggcgccgcggggcgccccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgcct

SEQ ID NO: 3230 - DNA, 242 bp, Homo sapiens
  source 1..242: mol_type = unassigned DNA
gcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccgg

SEQ ID NO: 3231 - DNA, 201 bp, Homo sapiens
  source 1..201: mol_type = unassigned DNA
tcctccctcgccttctctttgctccttcttttgctttgtggcctttctttcccttcccagagacacctgggagctgcccccaagctttggggcgccccgcggggccctgccaagggtgcgtgtgagagagggcggcggagccggcgccgggtgccaggggccgagggtgggagcgggagctcgtggccctgcgccctggag

SEQ ID NO: 3232 - DNA, 261 bp, Homo sapiens
  source 1..261: mol_type = unassigned DNA
cgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcga

SEQ ID NO: 3233 - DNA, 201 bp, Homo sapiens
  source 1..201: mol_type = unassigned DNA
ggggacccgcgcaggccagcgtgccggcccctcccagcccatcgctgccgccgccggggctgctccaagggagccaagcggagtgggagcgggtctgcgcgtctctgctctgcgcgcaggggcgggggggcccaggacggggcgccctttcccacccacatgctgatctaggatctccaagcggctcggcccaggacaccg

SEQ ID NO: 3234 - DNA, 337 bp, Homo sapiens
  source 1..337: mol_type = unassigned DNA
gtaagagcggtgcagccgagccggcgccccagaagccgagaggttacacaagtctacgcagagaggcgcaccggacacggtaattaggagcaattcacacgctctcgggcgcacggaaactacttgtcaggaaattttcaacgctcctcctcgcccacttttttccactcctttcctggcgcgccccctcccctcccagaggcacgcagtggagcttttggagtttcgaatctttcggacactgcagaatgcggggctccccgggcgcgggcccggccaatcagagcgccgtctgcctcccctggccaatggcaggcgccacattgttgtccaattc

SEQ ID NO: 3235 - DNA, 201 bp, Homo sapiens
  source 1..201: mol_type = unassigned DNA
aagttttgggtggcgcgcaaaggcgcaggcgagggccgccgcacagagccgcccaagttgtggccggagcgccagggcgacccctgggaaccccccaagcggaatcccccgagacaagcggctcttgctccctgacaccccagtcgaggccgagttgacgcgcagccatttaacccttcctgtcccggggaaacaacttca

SEQ ID NO: 3236 - DNA, 201 bp, Homo sapiens
  source 1..201: mol_type = unassigned DNA
atgagtcgagagggctgagcggagagtgtggtcctcggcggctggaggtaggagaatatgttgcgcccgcccgccgcggcgtgagaggctcgaggtgggcgcgccggggtaggggcggccgcgggcgcctgtccgtctagtgggcgctgcccggacctggcgaggtggtggtctgcaacactgtgcccgcactgcctactg

SEQ ID NO: 3237 - DNA, 201 bp, Homo sapiens
  source 1..201: mol_type = unassigned DNA
gcagcgccgcggcggccagcagcgccgggtagtggactcgcggtggcgcggcgccgggccgcggtgcccagggcgggagcagcagcacgaggcccagggcgagcgcccaggacagcgccagcatgcccgccgtgtggcgcctctggtacagcgcctggtaggtggcgggcgcccgggtgatgagcaggtagcggttcaggg

SEQ ID NO: 3238 - DNA, 201 bp, Homo sapiens
  source 1..201: mol_type = unassigned DNA
gccctaggagggaaggaggcgacggtgcccaaggacgtcggaagccggggatctccgcttccctcgggccccggctaggttaccagtgctggcccgcggcgcgggtgcccagttgcgcctgggacactgcgggcacggctgtggcggcaacggcagcggccgccgcgtcgccgacgcccggcaggactgagcgcacggagc

SEQ ID NO: 3239 - DNA, 386 bp, Homo sapiens
  source 1..386: mol_type = unassigned DNA
ggtggcatgtacgtttcacttaaaaagcagatcttcttctgcaactgccagcaagtggaaggatagcaaaccttatactacctcgagacctgtgcgctccgagcggtcctaactccgtcccgctcgctgttgctgttgctggtgctgctccggctgcagctgctgccgctccacgacctcggggcgctgaggcaacagggccccctccctctactccccatcccccccggctcctccacagaagcgccgtttccagtaactcctcgtgtacctcccacttctgccgccgtccatcccacccctctctcttctgtcccctccccaaaccgttcccaagcacacccttcgccgctggaagtgatcacaatgttgtttttcaacaagca

SEQ ID NO: 3240 - DNA, 201 bp, Homo sapiens
  source 1..201: mol_type = unassigned DNA
ccccccgccccccgcggcgcgcgccgctcccgggggctccgcgcccccgcgcccaggtccctcccccttggcgggcgctcacaggcggcgcgggcagcgcgagccccggagccccggaggcctgtgcgccctgagccggcatggaccccgagcactgcgcgcctttccgcgtggggcctgcacccggcccctatgtggcct

SEQ ID NO: 3241 - DNA, 201 bp, Homo sapiens
  source 1..201: mol_type = unassigned DNA
ggggcgacccggagctgcgcgccggcgcacgcgactccgctcgctcctcactccctgcctcaccaccagtcccaacctggctcccgcccgccgcgcgctcggggctcaggggagcggcgcggggacccaggtcccacggcggagagagcgcgcgggattgcgaagactggggccgagtgccgccctccctgcgccctggca

SEQ ID NO: 3242 - DNA, 309 bp, Homo sapiens
  source 1..309: mol_type = unassigned DNA
aggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccagg

SEQ ID NO: 3243 - DNA, 203 bp, Homo sapiens
  source 1..203: mol_type = unassigned DNA
agcgcacactgccgtcagccagccagccgccgtcgcactggtctagccccgaaaacttccaggcggcgtagaggtgcccaaccttggccaccacggcgccgcgtcgccggcacgccgcgtgggcttcagacagcgtcagccgcccgggcacgaagaacacttggcctggggaccacagcgggtcaccgaccgagggcagggtg

SEQ ID NO: 3244 - DNA, 388 bp, Homo sapiens
  source 1..388: mol_type = unassigned DNA
ggctcggcccgcggagtcagcgctcctcccgcgccgacctcgggctccgggcggccgccggggggcgccgggcgcatccttcgctgccaactccccgcccgtgcccccgctcgcgcctgggccccgccgcactccagcagaagccattacagagaacaaactaccttcttgtctccgagatgggtccccggggaggaaggcaaattgcctgcctcgtgcataataagccaggcgtggagagcagcgcggaggaggccgcggcagccaccgagcgggcagagcctcccgcccccacccgccgcccgcgcctgccgagccccctgccgagcgggcggcgcgcaggtccggagaatctcaaaaggcttggaacaccgggctgcttcccggt

SEQ ID NO: 3245 - DNA, 241 bp, Homo sapiens
  source 1..241: mol_type = unassigned DNA
agttttctacctagatcgcgccagtgcgtcccgggtctcaccagtccccatcaggcgttgccctccccgtccctacccagctccctctctccgccctcccgcgagtgcactcaagcgccctcgttccacccaccttcagcgcttccccaagcctggaggagcgcccagagcagcagaaacagcaggcaccccatatcgcccggcgtggggacctcgcggagcgccgctgcgcgccgccctc

SEQ ID NO: 3246 - DNA, 232 bp, Homo sapiens
  source 1..232: mol_type = unassigned DNA
cgttttccctctcagcgctcaggctgggggcggcgtcggtgccagtctagtccagggcgaagcttccagggccggctcgggccgggctgcgggacccgccgtggagcgcaaagtgcctgaagcccccgcgcgcattcggccctgtcttcaaaggccccttagaaatgcaagaggccaggcgcagaaacacacacggacggcagttttatgagaaaatgcagataaagagccc

SEQ ID NO: 3247 - DNA, 214 bp, Homo sapiens
  source 1..214: mol_type = unassigned DNA
gcctctctgtttccgcgccccctggaccagttctggtggggagctggaaggcaccgagtgcgtcccggccaagaagggcggatagccttgtgcgagcagcgttcggctggcgcggcgcggggtgtttcttatgctaaaggaaaggatggatctcttgtctgtctagggtccttactttttaaaactttcctaattgcggcactggaagggattc

SEQ ID NO: 3248 - DNA, 250 bp, Homo sapiens
  source 1..250: mol_type = unassigned DNA
cgcagcggggtcgccccactgccgcatccttactccgcgccctgcgcgcttacctgcccacgaagttctcgagcaccgagctcttgccggcgctctggccgcccaccacggcgatctgcggcagctccagcaggcagctctgtcccagcgccgaaaacgcgtcctgcagacggttcaccagcgggatcagctcctccatctcccggttccccatcttgcccgaggggccggcgaccagctggtccctgct

SEQ ID NO: 3249 - DNA, 201 bp, Homo sapiens
  source 1..201: mol_type = unassigned DNA
tggccggtgaagccccaggacccgtccgcttggggttaaggcaaggggtgcggcacgaggagcgcagggagccccgagtcccaggcgcagacccagctgcggacccgccgtacagccctggtgttgcaagcgtggaccgtgggcgtaaggccccggcgggaggcactcggcccggccgcggccgggtctgcagggtcctgg

SEQ ID NO: 3250 - DNA, 467 bp, Homo sapiens
  source 1..467: mol_type = unassigned DNA
ccgggcaccggcgggagaggggggagaagcggcgtggagaggatctggcaagggtttgcctccaaatccagattatgacccaacactttggacgcgaagcgaagatgggaaacggccgcttgctgagagggggcatttgcagtcctcccagaaaaggctggggcaggagagcgtgcggccagaggggtgggggtaccggagggggggtctcacctcctgctctatagccgggtctctcccgcgaggcgctgggaagcatgaggcatgcagcattcaaaatgttttttgaaaaagacggacttgaagcttttttttacaaacacgccattgtactcacttcttattcagagacgggctgcgcgctccgagctgcacgggcaggcattttccccggctttgttttacaaggtggggagagcggggctggacgcgggagggggcgggggggggagcgtgagaagaaacga

SEQ ID NO: 3251 - DNA, 201 bp, Homo sapiens
  source 1..201: mol_type = unassigned DNA
cgcacagctagcgaagcgactcgagggtcagcgaataagcgctggattcccgcaggctccggcgaccccagacccggccctccggcgaagacaggaaaacgtgtgtcgagagtcgctggagggaaccgtccgcaaatcgaagaagaaaccaaatcagcagcgaacacctgcaaattagtgccaagctgtgagcccctcgag

SEQ ID NO: 3252 - DNA, 232 bp, Homo sapiens
  source 1..232: mol_type = unassigned DNA
ccgggcgcgggggaggcgtgggtgctggggcgggcgagtccagactctccgtgggctggcttgtgggtgtctctccggaaacaaatgaggctgcaggagcggtgatcggtctgactgctcctgggggctccgaacccgtgggtggagagggtaaggcggaggccgtggccagcacttttccagtgacaatgtcgtcggggaccttttccttcacttcctgggagcaccccag

SEQ ID NO: 3253 - DNA, 222 bp, Homo sapiens
  source 1..222: mol_type = unassigned DNA
cacgatctcaggcccgctgatgaccgctgtggtatgaatgaggtcaccgcattcggagaggtggatgtccagatgtggactcaggaaatggcctcatcccgaaagtctcgggctagtgggcgtgccctctggccagtgcctccacgcccgcgccagaagggcagcaggccctcgtagggtccggcgtctcacccacccgtgtctcctttgctgtccctagcc

SEQ ID NO: 3254 - DNA, 239 bp, Homo sapiens
  source 1..239: mol_type = unassigned DNA
cagcgccgcgccccacgcccgtcaccgtcgccgccgccctagcacaccgcaggcgtgagtctcgccgcgaccgggagagccctcccagctgtgcgctctcgaggcacctggtcgggcggggaggcgtcgggtcggggcgcacaggggccaggcgggggcgctgctgcccacttcccgcctcccgggcgtgcgctccgccccggagcccgcacctcgcgcccgcgctccgcctggaagcc

SEQ ID NO: 3255 - DNA, 209 bp, Homo sapiens
  source 1..209: mol_type = unassigned DNA
gctcactcgccgcagcagctcactcctgctcgccagggagctcagggcagcccctgaagctgccagatccccccacgcaggcggcggcgctctgcactgcggagccgcgtcctgggggagcagtacccccagccccggcgccccgcagccagacagcccccctcagggtggcagcattccccggctagggtgcagggacccccggggcg

SEQ ID NO: 3256 - DNA, 380 bp, Homo sapiens
  source 1..380: mol_type = unassigned DNA
gtttagacagacaaaaccatttcatcaaagtgcaatgggagagaggaagaggagtaatgagaaggcatgtgagcggggagaaagaaaaagcccgggaggcgaaaacgaaatccacccccttgcgcccatttctgccagaggtttgcaggacgtgtctcaacctggcatcccgagtccagaacaaaagccacgggggctgcggcatgggcagggggaaggcgcgcggtggctgacgcggggcaggggccctggcgagcgcgggaggggcggtcagcagccgctcgcggggctggactgggagccccgtgcgactccgggtctggcgcctgggtcgggggtggttcccgggcctccctcgggggtcgccgaggcccggcctc

SEQ ID NO: 3257 - DNA, 394 bp, Homo sapiens
  source 1..394: mol_type = unassigned DNA
ggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcacgtaagggcgactcgctcccgggggcctcggccaggcacctgccgcatgcaccctccccgtggtggtggcatgagcgcgcgcggggcgcggggggcaggcgaggggatcctggcaggcgccgacgtcctaggtcggattcgggggcttctctgcctgcagtttcttgccttaatgaccgggctgcggggaggggagggcaggttccctttcaggctcttggtccctgccgacccg

SEQ ID NO: 3258 - DNA, 201 bp, Homo sapiens
  source 1..201: mol_type = unassigned DNA
cccggcttctccaccccggcctctcatggggtctccgggcttgtccgttgtgagcagcttcactttggggtgctggcgggatggctgctccgtgcagggcgctcgggagttcagatcccgtggaaatgtctggggcctcctcttgcccagaggggacagtgagcagccacgctgcgacatgtttgagggacccggacgaag

SEQ ID NO: 3259 - DNA, 557 bp, Homo sapiens
  source 1..557: mol_type = unassigned DNA
cgggggaaaggtcggcgttccagggcggggaggatctgggagtggagttcggagacaaaatcggggtcaggcagaggagccagagggaaagccagcaaacgcgagctcgggtgagagccaccggaatgcgggaacgcagcttagccgggaacagggttcccgacaggggtcgcccgtggccaggacgcggccgctgaacagaggtcgcgcggcggttcctgcccgagggacctcgtgggcgggggccacacggaggccgcgcacggtccccggggctggcgggggcaggtgggaggacctcctccgggcccgcgaacctgatctggcagcggccaggtgcctggaagcgtttttaaatgatagggttacaaagacatgttggccaggtttgtagttagcgcagcaacgtggtttgcaggagcgcagaacgaggctagacagggtcactcggacgccgtgctgtcagtgggtgggggccgggagcaagcggcactggcttggagaccccgcggcaggtgacccctcccacctgggcagcgaggctgaacgatggcgac

SEQ ID NO: 3260 - DNA, 212 bp, Homo sapiens
  source 1..212: mol_type = unassigned DNA
ctggagggagctgggggatcctggagggtgggaagtggctgattctcggtggccggacactcatccagagcctgatccgtactcgtgttttcttggaagcgccacaactgcggggaaggagtctttagaaaccgtgccagtttcaatatggcgggctaaggtggcttttaaaaactgaaaataaaggttttgaggtgggaaaaaacccagct

SEQ ID NO: 3261 - DNA, 201 bp, Homo sapiens
  source 1..201: mol_type = unassigned DNA
aatagctctcctcggcccctccagccctgcccaaggggcctggaaatgttcgcagcttcaagaaaggctctatttaagcacaggatggggtggggcgggcggggccaagattgccctggggattgaatttatctccgctcccagcgatccccggcggataaagcgcaagtttgtgcacacggtcgactgagccattggaaa

SEQ ID NO: 3262 - DNA, 201 bp, Homo sapiens
  source 1..201: mol_type = unassigned DNA
gggggagccaggggtcccccgcttggggacctccgtgctgggcatcccgcacgctttggacgcgcgcagcctcaccgggagcgaactttgtctcgcctgcgggtgccacggagaggggctgggaagccgagccagctctggcggcgactgggggcgtccctggctttctgggggggcgggggcgcgcattgttgtccagga

SEQ ID NO: 3263 - DNA, 294 bp, Homo sapiens
  source 1..294: mol_type = unassigned DNA
tttgaaagtttttgaagcggcccctttttctcctctcctctctccgcaggcagagttgtggtgtggctgggtggtctgcgtgggcgtccgggggattcgcgggcactcgggacgaggcgagggcgcagaaaacttggagcccaatcagcacggagttgagcttccgcgccccaaccttcaggtgaccccgcgcggcggcggcggcagcagcagtggcagcggcgaccggagcccgcagcagctccgagcgcctccgggaggacaggcggcgagctcggcgaatcgtcatctgcc

SEQ ID NO: 3264 - DNA, 244 bp, Homo sapiens
  source 1..244: mol_type = unassigned DNA
ggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagacta

SEQ ID NO: 3265 - DNA, 303 bp, Homo sapiens
  source 1..303: mol_type = unassigned DNA
cggggcagccggggccgggagagcgggcgcagcgcggcggggatcggagccgcgggcgccgggaaaggtcctcgccaggaggggagggaactccgggagcgcgagccagggggaggcgcgtcggaaagcgagagtgacaagcagcctacaagccgaaaagttcctcgcgggaggcgcgcgccgcgtgggctccgactcagccgctgcgcgtcgccgtggcacacaggctgaaaagtttgcgaagccacagaagccaggcccggcgctcagggggccttgatcctgttcccatggccccagacc

SEQ ID NO: 3266 - DNA, 286 bp, Homo sapiens
  source 1..286: mol_type = unassigned DNA
cgcggaggctggttctggtagtggctagggagtggagaaagcaaaccagagccggttcggttaccgactctgcgaagccccctcgaccccagcccagcgcgggagggtggcggaaggtggtgcaccgcagcgtggtccccgccgctgccgccgcggctttgcaaagtgtcagcgggggcgaaagcgagagtttaaaggaacaggaggcccattgaatttcctaccggagctttcaggggctctggctccccagtttgtttttgttttttcagctcggggatctgtt

SEQ ID NO: 3267 - DNA, 261 bp, Homo sapiens
  source 1..261: mol_type = unassigned DNA
gggaaccgagaagaggaagaagcgaacgcgagtaggagcgcagcgctcttcggacctctgaggctctctttgcaacttgccacactcgcagccctcacccgacactgaacaacaaccgcggggaggagaggccacttgcagccgaggctcgcaaactgtcggttccactcgggcagcgccaacccggtgcccgcggacggtgacttccgagccccagcgatgcgctccactgggttcaaaacagatctaattccacagcca

SEQ ID NO: 3268 - DNA, 201 bp, Homo sapiens
  source 1..201: mol_type = unassigned DNA
cactgaaaggcagaaatggggagtaggcacccagttcgcggtgggcagggttccaggaggcagctcccgctcggcgatagcccccggggcgcaactccccgcaggacgcgcacctgccaggacagccactaagaggatgcggaggttgggggccctctcggggacaaaatcagggcactccaaggaactctctgcgcgttc

SEQ ID NO: 3269 - DNA, 201 bp, Homo sapiens
  source 1..201: mol_type = unassigned DNA
gttggattgggtgcggttgtacctgtggagtgggtggcccggtgactgccacccgggccagtgctgccagcagatgtgcacatcctgggcgggggctggcggccgagtgtcactagtaggggcggcggctaggcagccattcgccgccttccaagcccggcgctgcgcgcagggcttggagcactcggtgctgagacgcga

SEQ ID NO: 3270 - DNA, 201 bp, Homo sapiens
  source 1..201: mol_type = unassigned DNA
caagctgcctcctgccttgggcttctgacacctttacagcctctgaaagggtccccggagaccccagagagaggcgggtgtcgaggggctacgagctcgcggctgacacccgcgctgcggaagagaatggcactgattgagggctctggggacctgggtcctggcgccttggaccttaggaccatgcacttcccggggcgc

SEQ ID NO: 3271 - DNA, 201 bp, Homo sapiens
  source 1..201: mol_type = unassigned DNA
cgcccggcccgcgggtcccaactttaccgccgccggccgaaccctgtccgcccgcggcgcgcacagccggcgcccgcgcacacgcgcgcacaaaccccacgcaacccgcggccgccccgtcccgccgccgccgcagcccgcctgccgcgcgcccacagcccggcccgagtcgcggggcccgagcgacagcgacggcgccgg

SEQ ID NO: 3272 - DNA, 201 bp, Homo sapiens
  source 1..201: mol_type = unassigned DNA
cgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggaca

SEQ ID NO: 3273 - DNA, 201 bp, Homo sapiens
  source 1..201: mol_type = unassigned DNA
ccccgaggtgagccgccgctgcgtccatctgttctcgcagctggattgtggagccgcgtccggaggagcgctggacacggacacccccaaccctttctccgactccgccccctggccccttgcacacacactcccgccaggaggggaggggaaggctcagcaactgcctggcctggctctgacccaccggcccctccgcag

SEQ ID NO: 3274 - DNA, 201 bp, Homo sapiens
  source 1..201: mol_type = unassigned DNA
gcgccgcccacgccacccgccaccccgggtcgcggccccggtccgggtccagtggctgcgccgccccccgccagcaacgcccgcgcggaatgagcgcgccgcgctgcccgcgcctccatccgcagggctcggcgccccctccccgcccgccgcccctacagccgcgcgctcattggcccggccagcccacggggagccgcg

SEQ ID NO: 3275 - DNA, 201 bp, Homo sapiens
  source 1..201: mol_type = unassigned DNA
gcggaaccccgcggccgagagccggccggcccagctgggcggggacacggcggcctcgggcttgtgctccagccccagccgggccccctcgcgccgctgcggctgctgcgcggtgcggtcgtgacaagtcacagcaaacttgccctccgcgccgttccaagccaccaggaagcgcaaccggtgcctctggggatcggcgaa

SEQ ID NO: 3276 - DNA, 344 bp, Homo sapiens
  source 1..344: mol_type = unassigned DNA
ctttgaccagatgaacggagtggccggaggtaagccgcgtgtcttcgcaggcccggacctgcgcggcccggaggtggtggatggggtgcagtgggtgtgcgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaaccggcgtgcgtgcgccccggcgcgcccagccccgggcgagcgcagggatgggggtggaagaggcgtccccccgggtttcgaggcttgcgtaggccctctggccggc

SEQ ID NO: 3277 - DNA, 201 bp, Homo sapiens
  source 1..201: mol_type = unassigned DNA
ggcgcttgcccgaggcgggagtcgctgggtcatgctcttgcccaccaggtcctccgaatccctggtagggcagcgtctgtccgtgtccccgacccctcccgcaggcaactcgcgcgaacctggggctcgcagagagcgagcgcccgcggacaccggctgaacagtctggaggctgcgcgagggggcgccgcggggagggat

SEQ ID NO: 3278 - DNA, 218 bp, Homo sapiens
  source 1..218: mol_type = unassigned DNA
cgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataat

SEQ ID NO: 3279 - DNA, 234 bp, Homo sapiens
  source 1..234: mol_type = unassigned DNA
cgctgctgcccgccaccgccgccgccgtccggctaccgcaccgcacacatcaattattcatcgcccgtctccagcttcccgggcgaagccaatcataggcggaggctccgctaatggggccgccgccgccgccgccgaggaggcagccagccgcgcgcccgggcgcaagcgacagctctccagggacggggatgggccgggggcgcgcggggggcgggggcgcacggggcgcgc

SEQ ID NO: 3280 - DNA, 201 bp, Homo sapiens
  source 1..201: mol_type = unassigned DNA
tgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccg

SEQ ID NO: 3281 - DNA, 201 bp, Homo sapiens
  source 1..201: mol_type = unassigned DNA
agtcagggccgggggcgcacgccggaacacctgggccgccgggcaccgagcgtcggggggctgcgcggcgcgcacctggagagggcgcagccatgcgggcggcggcggcgggggggggcgtgcggacggccgcgctggcgctgctgctgggggcgctgcactgggcgccggcgcgctgcgaggagtacgactactatggct

SEQ ID NO: 3282 - DNA, 235 bp, Homo sapiens
  source 1..235: mol_type = unassigned DNA
gcaggggtgccctgtccgcacgtacccacgacagtgagcagcatgttgtccagcagcagcgccaggaacacgatgaacaggatgagcttccgcgagcggcggctctcctgcagccagcggaccagcgccagctcgctcagggccatggctccggggctccgctgcgggcgcggtgcgcggtgaggacccaaggcggccgtggaccccccattctcccgtcccccaggccgcggaa

SEQ ID NO: 3283 - DNA, 201 bp, Homo sapiens
  source 1..201: mol_type = unassigned DNA
tttcccaacagggcgcgctggcccgcgagccggaggaacctccgcccaggccttgccaagcgcccacccggagcaggccgggggcagtgaaggatgcggcgggagcggcgcgctgcagttccgcgacgtggcacgtaccttggaagcgatgacccagatatcggtagcggtggatgagccaggggtagaaggtggacggat

SEQ ID NO: 3284 - DNA, 241 bp, Homo sapiens
  source 1..241: mol_type = unassigned DNA
agtccccggctcgaggctgcgtcaatccggcgccggatgctaatgatgaaatcaaaatgtcatccaagttaaatgcggggagtatacggcgattgggcgcgtacaatggcaaatgggattaggcaggcgaaggctcagccgagccccggccccgcagccgcctccgccaccgccccctcctcgccttccctcggattttggcgctttggcttcgggctataagagcccgcccgttattggc

SEQ ID NO: 3285 - DNA, 201 bp, Homo sapiens
  source 1..201: mol_type = unassigned DNA
gacgatctgggtgatctgggtggaaggtggtgcagcaggcaggcagtggggaggggcggggaggaaatctagggggagggggcgccgaggctggtgaggcgtcccttccgcgccagggacatgcaggcaccggatggctgcgcaggggttcctgcccgcctggctctgggtgcgcccgcccagccccggtgcaaatgcccc

SEQ ID NO: 3286 - DNA, 201 bp, Homo sapiens
  source 1..201: mol_type = unassigned DNA
ccgcctcgacccatcaggcgcgcagggcccgctcccgaaactcgcgcgggctctcgcagtcggccgcgcggcccttagccgcgaagagagcgtcgcgcacggtggcgccgccacagccgtgggccgccgcgcccaggtagcgctccagctgcccgcaaagctcctgcagcgccgcctcgccggggcccacgcgcgccggcc

SEQ ID NO: 3287 - DNA, 217 bp, Homo sapiens
  source 1..217: mol_type = unassigned DNA
tcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgg

SEQ ID NO: 3288 - DNA, 201 bp, Homo sapiens
  source 1..201: mol_type = unassigned DNA
ctacactgcgcaagagatcgcaatgaagtccgtagatctccaggctggagccgcagagcgaggtggcgaggtggagaacgcggggctgggcctggacagcggccctggggtcgtctggagtcctcgctccctcaacccggaaggcagcggactgacatctgcgccgaagtcgcgcgtaccccacggagggtcgggaccctg

SEQ ID NO: 3289 - DNA, 201 bp, Homo sapiens
  source 1..201: mol_type = unassigned DNA
gaggggtggtcctgccccacccagggggtgtcgtgggcaaaggccctggggccacctgcctggtgccttggagggcgtagggcaggagccgccgaggcccgcgggccactgtggggcgcggaacttcagaccaggcacccgcggctcaacttccgggccaggggacccgcgggggccttacgaacctgtttggcccatttg

SEQ ID NO: 3290 - DNA, 201 bp, Homo sapiens
  source 1..201: mol_type = unassigned DNA
acccggggccggaggcaggcgcgtaaccatggggaccggggcgggcgatggcggcgggcgggctcctgccgcagggtggggatggctcttccagccgggcggccgccgtcacactgcagagcgtatttaaagagacacctcgctccgcgctcgctccccagcaccagaccctcgcccgaaaacgccgccgggcggactgca

SEQ ID NO: 3291 - DNA, 317 bp, Homo sapiens
  source 1..317: mol_type = unassigned DNA
caccgcccgggtccccgcctggttacagcatcaggccacagtgcgctggttcttgatcactctcctggctcggtggccgccccccgccctctcccagtccgcgtcgctgttctgcctcaggccccggtgcggccccaagtcccagcccagggcccttaggtccctccaggcggcggtggcggcactcacctgggtcgcggagccggggtctggcacggtcccgcaggtggtaaatgaaatcctggcagctgtcgtgctccagggccccacgggcacagagctcggccagcagctgcagcgcctggtgacagagcgcg

SEQ ID NO: 3292 - DNA, 221 bp, Homo sapiens
  source 1..221: mol_type = unassigned DNA
atttacagcgacgggtaaccacgcgggaggagcaggtcaactcccgacagtggaggtgaagatgcgtgcgcctcgcgcaccttgtccctcgcgcgacgccgtccgcgccgcccgcggttcggtcgggagcggcagcccgtgctccggttccggttccggttccggctggcgtctgcacctgcgaccaccgtgagcagtcatggcgtactccacagtgcaga

SEQ ID NO: 3293 - DNA, 201 bp, Homo sapiens
  source 1..201: mol_type = unassigned DNA
gtgggcggccaccatcccctcagagcacctggtatatcgggttggggttcgcacccgcagggcactgcggggcggcgtccggtgactgggtggggtcgccgctgctctctccctcgctgggggcggcagcctcttgcctgcgcggaggcgactcagaaggcacgtccgccagcaggagggcgggcgccgcagggctctcgg

SEQ ID NO: 3294 - DNA, 201 bp, Homo sapiens
  source 1..201: mol_type = unassigned DNA
gccttcccgaaacggagacttgccatcttttcagagggcggggaagctcacaccactctctgctttatagtgtccgtttcgcctcgcttgctggcccttcgcttacccgagacattccaggcacggctcgcactggagagggccgcgctgctgctgcgaccgcacggcgcccggggcaggaacatgctcgctctcccctgc

SEQ ID NO: 3295 - DNA, 201 bp, Homo sapiens
  source 1..201: mol_type = unassigned DNA
accgaagctaggtggaagcaaatgagcctggatcctgaggcgcgcctggcttggagccgccaaacttgctagcgggcggcgggggaggtggctcggcagcgccgggtgctgcgctcgcatatgcgcccgggaaggcagccccggccgccccgcccccagcccgccccccaccgctggcgcggcggcggcggcgtggggctc

SEQ ID NO: 3296 - DNA, 201 bp, Homo sapiens
  source 1..201: mol_type = unassigned DNA
tgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgccc

SEQ ID NO: 3297 - DNA, 230 bp, Homo sapiens
  source 1..230: mol_type = unassigned DNA
cctcccggctgcagaacgcctctcgttgccggagaaggggctcagcaaaattgactcttccttatttgtttccatccataattgatggggagatgagaacgtaacacatctcagcaccgagctcttgtcgcctggcggagaccctgtccaagacgcttccgtaaagcatttccagtcggggaacaaagcacggaaagttgctgggtagagcggccgggaggagacaccgg

SEQ ID NO: 3298 - DNA, 201 bp, Homo sapiens
  source 1..201: mol_type = unassigned DNA
gacagtggcagaggcgaccgcccttccccccatcatccataccccagccccagatctctctcttttcctcccggtgacactaagtcccagaccggcggccgtacttggccttacagtgcaaaatgtgcttggcgaggaagtcgaggcggcgctgtagcagctgagcgtgggggtctgcaagggcggccagctcggggaagc

SEQ ID NO: 3299 - DNA, 201 bp, Homo sapiens
  source 1..201: mol_type = unassigned DNA
cgaaggtcaccggctgcgtcttgaagcgagactggcgcggccgccgcagccggccccggcccttgggcagcttggcgggccgcacgggctgcgggaactcgtcggccaggcacacgaagtgcggcatcaccgcctggtaactggagcagatgcccatcagctcgccgggcttggcggccatggcgcctccggcgtctgcgg

SEQ ID NO: 3300 - DNA, 201 bp, Homo sapiens
  source 1..201: mol_type = unassigned DNA
tgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgc

SEQ ID NO: 3301 - DNA, 201 bp, Homo sapiens
  source 1..201: mol_type = unassigned DNA
agccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggtgaggacgcgccgggggcgggggcgccaggcccgggtccaagggataggagctt

SEQ ID NO: 3302 - DNA, 201 bp, Homo sapiens
  source 1..201: mol_type = unassigned DNA
ttctgacgcggggctggggacgcagacactcttggctccggcagcccagcgcaacccctgaggtcgggcgccgcctcccgccttcagaaactcgggctccgagcgccgaattccagcgccttcgcccgtgggcacagggcgcgcggtgcagccacagggggcccgagacacgcgccccggcctggcccaggctggggaacc

SEQ ID NO: 3303 - DNA, 201 bp, Homo sapiens
  source 1..201: mol_type = unassigned DNA
cggcgactacctgctgggcatcaagcggctgcggcggctctactgcaacgtgggcatcggcttccacctccaggcgctccccgacggccgcatcggcggcgcgcacgcggacacccgcgacagtgagtggcgcggccaggcgcgaaggggcgggggcggggggcaacggccgccgggccaacccgctcagtcacactctga

SEQ ID NO: 3304 - DNA, 201 bp, Homo sapiens
  source 1..201: mol_type = unassigned DNA
gttgtaccaagttacaatcccacccacatggtgtgagaactccctgggcccctcctcctcagcaagacttggtatttcctgatatttaccagtctaatgcgtgggaaatggtgtctccttttaacttgcattttctctgattcatagaaagctgctcccagttccggttcatcgaccactcagctttccattttctgaatg

SEQ ID NO: 3305 - DNA, 201 bp, Homo sapiens
  source 1..201: mol_type = unassigned DNA
gccttcccggtacccgcagccccgacagctcagccttccccacctgaaagttccacctgaggtctccctcaactctgccctcctgcattcttggcgtcgcggggagtcaggggttaaaccccgtggcccgcgtggccccttccccctccgcagccccctcgcctccactcggcgccgcgcctggagcgtccgtcccggaga

SEQ ID NO: 3306 - DNA, 201 bp, Homo sapiens
  source 1..201: mol_type = unassigned DNA
ccccgggggtgccgagccggcggggggtgaggtggctgcgccggcggccgggctaggaggtgcgggcactgggggcgcgggaggggacgtggcaggccccgcgggggccacggcgatcccaggggccaggaaggtcccgctgcgggcacgcaatctgcctccgtccttcttcacggagccgtcccgggcaggcggcggcgg

SEQ ID NO: 3307 - DNA, 268 bp, Homo sapiens
  source 1..268: mol_type = unassigned DNA
agctggcgctggacaagccgggcaagtcgaagcggaaggtgaaccaccgcaagtacctgcagaagcagatcaagcgctgcagcggcctcatgggcgccgcgccccccggcccgccctccccgagcgccgccgacacgccagccaaacggccgctggccgcccctagcgccccgacagtcgcggccccggcccacggcaaggctgccccccggcgggaggcgtcgcaggccgccgcggccgccagcttgcaaagccgaagtctggccgc

SEQ ID NO: 3308 - DNA, 614 bp, Homo sapiens
  source 1..614: mol_type = unassigned DNA
atcggccggggctgctgccgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggtaaaggaaccggttccctcctttggtgtgggtctcccaagtttcaagatccagaacaacgggcaggatgactct

SEQ ID NO: 3309 - DNA, 201 bp, Homo sapiens
  source 1..201: mol_type = unassigned DNA
agatgcactttagctcagcgactcccactggcggaatcctcgcgctcaccgcgcgccgcgccaagatggtccaggccacctctactgcctccccgccagcgcccctcagccccctacacttgccctgcacacacactggcctgtagaggggattcgtcccgaaccgcccgggagtggggcctgagctcggagctggtgccc

SEQ ID NO: 3310 - DNA, 201 bp, Homo sapiens
  source 1..201: mol_type = unassigned DNA
gccctgcttcctttacaagaggctaagccgacaccacgcgagtgtgtacgcgctggggactgagcccccgaagcgaagccctgtcggaggagtttcaggcgggagtgggaacggctgggcgtggggtcagcaacggcgccacccggtagggtggggggagccaggcttgtcagagccagagcgcgtcaccgtcgccgcgag

SEQ ID NO: 3311 - DNA, 201 bp, Homo sapiens
  source 1..201: mol_type = unassigned DNA
gcactgcggagtagcgaggtagcgcgcaagcaagccagggcaggggccgggggcaggggcgggggctggagctatggccaggggtggctgctcaggccgcgtgagctgtcctccccactcgcacctggccgtcaggccacccggccatcagaagcctttactcacaccttgtctcttacctggaccgccggctggctgcaa

SEQ ID NO: 3312 - DNA, 201 bp, Homo sapiens
  source 1..201: mol_type = unassigned DNA
ggggaccggccgcagggcggggtttctcttggcggtgagtgagcgagaccgttaggctgaagcaccgggagactgtcctggcagctcctggccgccacccgcgccgcaataaaagcctctcgcggcttcccgcccagccagcttcgcactgattggtcgccgtgggagggacccgagttggctggaggcggcggccgagcg

SEQ ID NO: 3313 - DNA, 201 bp, Homo sapiens
  source 1..201: mol_type = unassigned DNA
aagccccggcgcgcggcgctcgctgggcggtgcgcctcttcccggcccctcactcaccgcagccgagccgggcactgtggggtgggtgtgcgtgcctgtcggggggtgtgtgcctgtgtcggggaggggtgttgctggggaactgttgctctccgtatcacggcggcagcgacagcatcgcccggcagttcgcagtacccg

SEQ ID NO: 3314 - DNA, 261 bp, Homo sapiens
  source 1..261: mol_type = unassigned DNA
gcgcccggcccaagcacggtgcgagcgtctcggggaggcggcgagcgagtcggtgcggagcgctccgtgcgtccgggtggttccgcgggccggcgggaccgtgcgcatttcaagcgcgtgcgggagtgtgcgaggcgctgtgcgagctagcggcgggcgcgccagggtgggaaaggcatcccgaacgcatcaggtgcagagaccggcacccaccgagagcggccgggagcgcacggcgagctccggtgtcaccgccggtcc

SEQ ID NO: 3315 - DNA, 201 bp, Homo sapiens
  source 1..201: mol_type = unassigned DNA
gtctgggttccaggctatcgcagaggacgtgcccccgggcgcgcagatggcgggagatgaggcggccgaactccgcgcccttgcgtggtggagcacacacgctccaacaagctcagcgtcacctgttcagccctctaacttttctccttctcgccccggggcggcttctctctccctttgccctggctgttgccctggccg

SEQ ID NO: 3316 - DNA, 201 bp, Homo sapiens
  source 1..201: mol_type = unassigned DNA
ggcccacgcactgcccgccggcccacgcgggagcctcgaggggcgaggcggaggctgggcgcagtccttgcagccagcagccacctccgcgcgctccgccgcggtccagctaattacctgctgcggcggcggccgtgccctttagggtgcattagtattcccgccgcgggcgctgccctcgcggcgtcggcaccgatgccc

SEQ ID NO: 3317 - DNA, 201 bp, Homo sapiens
  source 1..201: mol_type = unassigned DNA
caggcagtcccgcgtggcggcggccgggacagctgggcgcgctggcaggagagcaggcacagcgctccccacaggcaggatgacgcgggctccgcagcccgtcctcccacgctgccccgcatcactgcctcggccctgacgtgcgtgcgacagactcaccgcaaacagtccccagcgggagcacgaggccgggacaggagg

SEQ ID NO: 3318 - DNA, 201 bp, Homo sapiens
  source 1..201: mol_type = unassigned DNA
acacagctttaagggactgagcggcccggacgggatctgaaacctttggaggaccagccacgtccgcacagcccgcccatgcgcgctggcaccaggacccgcaggctgccagcggcgagtccccgccgcggttcctcagggcacccccggagaagggggcggccctgaggaatctcctgcactccggatgccctattttcc

SEQ ID NO: 3319 - DNA, 219 bp, Homo sapiens
  source 1..219: mol_type = unassigned DNA
gccgccgcctcctcgggagtcggagccgccgcttctccagtgggtgcagccggggtcccgacgggggtcgggcggccaccggggctggagctgcggccacggaggcttttgcgtttgcgccgcgccgagggcagggacagggactggggtgaggggctgtcccggaacgtccacagctggcgctggccctcccctgcctgacagcttcctggcccgggg

SEQ ID NO: 3320 - DNA, 268 bp, Homo sapiens
  source 1..268: mol_type = unassigned DNA
tcagccgccggcgaggccacccgggaggggcgggagccgcctgccagccactcggcagccctcctggggctcccctcgcgcgcccgcttgtttttcttccgctgcgcttcctcgcttgctggcgtctttgccttagcgggactcggcagccaggggccccagggggcggtgcagcaaactctcagcggtttgcgttcagcagaccaggttggggagccggcttggcgctgcagggaggtagagagcgggaggaagaggcagtggtagg

SEQ ID NO: 3321 - DNA, 201 bp, Homo sapiens
  source 1..201: mol_type = unassigned DNA
ggctgccctcgggcgcaccctgcggctcgggcacctgcagggcgggcagcggccggttctccatcatgttggccgccggcatgggggccgtcgcctctgcgctccccctgagccctccgccagcggcctggttcgcgtctccctctggctgttccccaccctcggccccgcggcacactccccaatcctggggccgaagga

SEQ ID NO: 3322 - DNA, 517 bp, Homo sapiens
  source 1..517: mol_type = unassigned DNA
cagcgcctactgccggggaagactcggacgaaaaccgaggcaaaccaaccattaaaaagtgcatccaataagaatttttccactcaggccctccgctgccgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacgttccctctaggacagtcagcaggtcccaggagcgcagcacgcaacagcgcagagcagacccagacttttcccggggtgagacccggaggcccgcgctctg

SEQ ID NO: 3323 - DNA, 226 bp, Homo sapiens
  source 1..226: mol_type = unassigned DNA
cgtcggggggtcctgcctcccgggaggagaaggaaccggccgcctccgcccttctccccctccaggcgcccccgggagggggccgctgggcggcggaatcgcgcctccgctcggggagccaccacgcggctttttcgcggaattttgacgtcatccacacgtgggggaaggggctgggagagcaagaggaagcggcgggggagggggccgcggctgggagagcgcg

SEQ ID NO: 3324 - DNA, 201 bp, Homo sapiens
  source 1..201: mol_type = unassigned DNA
accccggaggcagagatgagagcgcctcaaaacttttttcccctaccccaatctccgaggagtaggtgggtgcacagtgccggcggcggcggggacgcgcggcgcggagcctggctctgggaggcagtggccgcttcagcagccgaacctctcgcggctccagcctccgcgcccagcagcccgcggctcgcctcccggaaa

SEQ ID NO: 3325 - DNA, 212 bp, Homo sapiens
  source 1..212: mol_type = unassigned DNA
tgcgcagtggggcggaggaggtggcgatggccgggggaggcggggggactgctgtttatttgcagctgggccaactccgcggcgcaggcggcggcggagcgcggggagctcgcggcgggtccagctgccgcagcaccatgcccgagcccccctccgggcagacgccgcgcgccgccggggccccggtaggggaggatgccagacgcccggga

SEQ ID NO: 3326 - DNA, 388 bp, Homo sapiens
  source 1..388: mol_type = unassigned DNA
ggcagccgcagcctcctcgcgcgcctctccttcccctacgccctccgctcccgccatggggccaacgtggggctcctaagagttgccggctctcagcggcgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacaggtaaccgggaggg

SEQ ID NO: 3327 - DNA, 201 bp, Homo sapiens
  source 1..201: mol_type = unassigned DNA
ttttttctctcctgtctttcaagacacgcgcccgaaatcgaggggtgagagcaaagaccgcccatcaacttagcaccttggatttagagctttcaatcccgaaaggaggttggcattgcccgggtcatcgagagagggagggagaagagctgaggctgcaacggctcctgggctccctagaccgggtttggcatccaggag

SEQ ID NO: 3328 - DNA, 201 bp, Homo sapiens
  source 1..201: mol_type = unassigned DNA
ttacttcccctggaagcccatcagttgctcaagtgacaaccaacaccggagagccagggttcgcccaacaggagtacgcggagacaccccagacgacagcgcgtcccccccacccccaccccgccctccgggcgctccaggccagcgtccaccagaccccacgcctgggggactgcttgggctctagcgagagtgccacgg

SEQ ID NO: 3329 - DNA, 212 bp, Homo sapiens
  source 1..212: mol_type = unassigned DNA
aggtgcagagacagtggagatgaggccctgatgcccggctctggtttcacgcgggcagcgtcagctggtcggtgtcacggagttcccgcgtcctccgcccgctcagcccccgcggacccatccactggggttgctccgcagcgcgactctctctcatcccgggggagggctaagggcggcggtggggggcggggtgggggggaagcggcggg

SEQ ID NO: 3330 - DNA, 250 bp, Homo sapiens
  source 1..250: mol_type = unassigned DNA
ccctccgtgtcttccgcagggtaggtcacagtcccccagatctccgcccaggtggcaaagaagatggagctgggggccgcgccccggcggcgcggggcccgaaggcgaggccgcccagcccgcaccccaccccacgcacggcacacgccgccgcggcccctgccacgcacaccctcgcgctgctccgcccacgtgggcgccggggaggaggctcgagagatgggaagaaaggctggcacccaccctcctg

SEQ ID NO: 3331 - DNA, 488 bp, Homo sapiens
  source 1..488: mol_type = unassigned DNA
ctgcaaacactggaggaaagctgcgttgcctcaattaaatacgctcccccaaaatacggagatgcggggagtgggggcccgggaaagaaacttttaaagcggcagtgtccttttaagaaggggcaaaaaaatctgtttatggccaccctccttccgctttaccttttctcctcttgacagtttcggccctggctgcccgagtcgggggtgtgttttcggtccctctcagatctgggcggggggcgggaggagtgagcgacctgggaagtcccgggggtggagagggggcgctccggggtctgggggcgacgtggacaccttctttggagcacggcggtgcgtttgggatttgaaggaagggccgaaggaagcggggtgcgggcgggcgagctgttcgccaagttgtctggcgggcgcggcgaggggagatgcgcaagtttgcagaccgggggttcggagcccggcgcccaggctggcggggggcgtgt

SEQ ID NO: 3332 - DNA, 201 bp, Homo sapiens
  source 1..201: mol_type = unassigned DNA
gcagagctgcagctcctgcggctcctcctctcccgctgcccagccgagctttgggctcccagtccaagctctccgcaccgccgctgctgctgccgctaccgccgccgccgccgcgcgctgccagagccgcctcctcgcctctctcctcctcccccggccgggttcccccctccctctgctctccctcccttctcctcagcc

SEQ ID NO: 3333 - DNA, 364 bp, Homo sapiens
  source 1..364: mol_type = unassigned DNA
actgcgcatgtgggcttggggcctgcgcgcaccggaggctgcaggcgctggggagggtgtggggggctgtgcgtggggctgccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgaga

SEQ ID NO: 3334 - DNA, 220 bp, Homo sapiens
  source 1..220: mol_type = unassigned DNA
gtgtaatcttttggttaaaatgtcacagctaagactaaacccgaagaaaagaatgaaaccacgggaagttcttcagacagtcgccgcaaggttatgggccgaagtggtgcaggggcggcgcccggggaagcgactggcagagctgtgcgcactgggggtgctgcaggcgctggggagagtgtggagaggctgcgtggagctgcgcgctcggggtgggggc

SEQ ID NO: 3335 - DNA, 201 bp, Homo sapiens
  source 1..201: mol_type = unassigned DNA
gcggctgagctcgcggagctgggtgagtgtctgcggctgaccggcccgtgggagcagggagcgcacagccggctggtgctggagggtcacggggacttacggggcaccgcgggagccgccgagcgcagggaagccagcaggcatctgcagtgcggagcctgcaaggctgaggcaggagatcgctcgaggcggggagggcgg

SEQ ID NO: 3336 - DNA, 201 bp, Homo sapiens
  source 1..201: mol_type = unassigned DNA
tctgagggcccgggcagccacccgcacttccccgccacgcggagaaagccgagcacacaggccgcagggtgggggtccgcggggagagggtggaagcagcgggttctccgcgcctggggtggccgctgccccacccaggcccccgtctgccctctacccttccagaccaatcgctccctgcaggtgccaacgcggtgcccc

SEQ ID NO: 3337 - DNA, 201 bp, Homo sapiens
  source 1..201: mol_type = unassigned DNA
gctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacac

SEQ ID NO: 3338 - DNA, 358 bp, Homo sapiens
  source 1..358: mol_type = unassigned DNA
acccagggccactgcagctccggggcaccccggaggccacgacccgcgagtagatgtcccggaagaggctctccatgcaggctgtcaggtagatggcggcgtgctcgtggatgcgcagcgccacgcggctgtccaccatccagcgatacacgcggcccacggagaaggtgaggccgcagcgggccgacttgccgcggcccaggcggtcgccgccggcgctgctcatgttgtagagggacagtgcggccagcgcagccgccgtacagtgcgcggccaggccccaggacagcacgatctccatggcgctctggatctcgtacttggtgcacttggcgaagcgcaggctcaggcgctgcgc

SEQ ID NO: 3339 - DNA, 201 bp, Homo sapiens
  source 1..201: mol_type = unassigned DNA
agcgcttctccatggtcgcggcagctaatcgatgactgaaccgaacaaagagcagcggcgagatcaattcctaatacctatcgatgggcagcgggcggccgagccccggcgagccccggcagccgccgcccgccgccccagggcgtccgcctgcccgcccggggacctccccaatgcgcccagggcgcgcccgggggctcc

SEQ ID NO: 3340 - DNA, 328 bp, Homo sapiens
  source 1..328: mol_type = unassigned DNA
ctccttagccccgctggcctgggagccgggagcctcggaggagtctcccgccaagcttccttggctacgagcgcgcctggttctggtctgggagcagaccgtgcgcccgagtggggcacttgcccgaggtcggggactgtgaaccgaaagattccatctagccctgctgtcctcctggtattgcgatttgggggcgggtcactttacctctctgaattccgccccccgccttgcttatggaaggttgtaagcctctctggggtccgggatccctctttacctccacctttcgagcagagaaacaggcgatgccccctccctccctgcg

SEQ ID NO: 3341 - DNA, 201 bp, Homo sapiens
  source 1..201: mol_type = unassigned DNA
gaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacg

SEQ ID NO: 3342 - DNA, 319 bp, Homo sapiens
  source 1..319: mol_type = unassigned DNA
gggcgcacacacacgtccacccagacactccgcgcgctccctcgcgcttttgcttgcccgcccgccgccgcctgctttttccctcctgctttcgccggtcgccttctccttctttttttttttttttttttttttttttttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctcca

SEQ ID NO: 3343 - DNA, 201 bp, Homo sapiens
  source 1..201: mol_type = unassigned DNA
ccaagctcaactttacgccttcctcggtgcccgactctgcggccgaatcgcaactgcgagccgcaggtaatggcggagtctttggcactgccagctgtccgcggctgggggcccgaggctgggagggctccgctcccggaacatcgctccggcctggcctccaactttgcgaggagcctccttgcgctctcctcccgcggt

SEQ ID NO: 3344 - DNA, 370 bp, Homo sapiens
  source 1..370: mol_type = unassigned DNA
ctggaccctcggggtgcgggcccctctccttgtcctgcttttcagcatctttggcaattgcgcaaagttgcttgggttgcaatggtggggtgcagggggcgctcggctgctgcacctgttagtgctgggcccaggttgagaggcgacctccagcccccacaataatgtcccgggctctctggtttgggtcctcgcagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaaggtgaggcgcccccaccccgggccgccct

SEQ ID NO: 3345 - DNA, 201 bp, Homo sapiens
  source 1..201: mol_type = unassigned DNA
cccctccgccccaggcgccgccaagtcccagcactatgcgcccctccagatgtccgaaagcgcctctccagggcagcctatgtccctctgtgtccttcccgcgacgggccgggcccaccactccacacctcccgggtccttccatgtccatcaccgtgtgcctctccagcatcccccctcccctccaagttccaacatagc

SEQ ID NO: 3346 - DNA, 201 bp, Homo sapiens
  source 1..201: mol_type = unassigned DNA
gctgggcgcaggggccgccgcccgaggaccatgggtgggccagcgcctcgccgggctgctagctggcggggaccgccggcgcctgtgccgggccgcgcccgaggctgcgccgtccgtgccgcagcggccaatgcggcagcatccgcgaacgccaccgcggcgggccccgctggcccgggctgcggcgtgggggcgggggac

SEQ ID NO: 3347 - DNA, 201 bp, Homo sapiens
  source 1..201: mol_type = unassigned DNA
gtgcagcgacgcccagcccccgtgcggccagcgcgccgcgtcggcggatcctgcagcccagagagcccagggagcccagggaggggagcggggcgcgggcggggcagtgtcgcataaccgcaggcgcgccccgcgccgcccccgccccgggcccaccctccctcgccgcgcccctcccagctcacccacggacgagcggat

SEQ ID NO: 3348 - DNA, 263 bp, Homo sapiens
  source 1..263: mol_type = unassigned DNA
gcgcggcctcgcggggatcccgcgggcgggcgggcggccgggcgcgcgcggggcgggggcggcgcgcgcgcggggagcgtgtgggccgggcgggcgcggcggggaaagctgggcgcgcgagccgaggctgctgctcacctgcagccgcgccgctcacctgccgcggagtgcgcgccccgcgccctcccggcccgctccggagcccggccgccccccccttgccacagcgggcaactgcgccgacatgcgacacgagtagccca

SEQ ID NO: 3349 - DNA, 201 bp, Homo sapiens
  source 1..201: mol_type = unassigned DNA
ggcgggagaggagccccggccgcgtggaccctagcttgcgcggcaatcatcgcgccttgactctaggcccggctgctcagggaaggacagcccagggcgcgcccagcgagcttcagggggtacggaagtggttagggcagatttcagggtgaacaactaatattttacttaccaattcgttaaaaacaaagaaaacaaaac

SEQ ID NO: 3350 - DNA, 201 bp, Homo sapiens
  source 1..201: mol_type = unassigned DNA
tgccggggccgcgctcccgggcccgcgtcgccagcacctccccacgcgcgctcggccccgggccacccgccctcgtcggcccccgcccctctccgtagccgcagggaagcgagcctgggaggaagaagagggtaggtggggaggcggatgaggggtgggggaccccttgacgtcaccagaaggaggtgccggggtaggaag

SEQ ID NO: 3351 - DNA, 201 bp, Homo sapiens
  source 1..201: mol_type = unassigned DNA
aggggtcaggagcggcgggacagcgcgggaagagcaggcaaggggagacagccggactgcgcctcagtcctccgtgccaagaacaccgtcgcggaggcgcggccagcttcccttggatcggactttccgcccctagggccaggcggcggagcttcagccttgtcccttccccagtttcgggcggcccccagagctgagtaa

SEQ ID NO: 3352 - DNA, 201 bp, Homo sapiens
  source 1..201: mol_type = unassigned DNA
cgggcgccggcgtgaacccgcgtcccccggagcccagcgccgtgtcctcaggccccggccctgacctcagggcgctcaggtggaatggccccgcagctgcgcgctgctcccgcgcccccgccttgccccgcggaaatcgcccccgacagtcaacccgaccgggcgcgcggcgcccccggccggtccccgcccgaccccgcg

SEQ ID NO: 3353 - DNA, 215 bp, Homo sapiens
  source 1..215: mol_type = unassigned DNA
gaccctcccgcgcacacgcacatgcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacggtgagtgtgg

SEQ ID NO: 3354 - DNA, 201 bp, Homo sapiens
  source 1..201: mol_type = unassigned DNA
ccgcgtaatccctgaagtggtcggccagggcgcggttggcccagccgccgtaggcgtcctgcaggcgctggggcaggtcccagtggtacagggtgaccacgggctgcacgcccagctcccgcagccgctccagcaggcgccggtagtagcgcagcccctcgcggttggggacgcccgcgctgccattggggagcactcgcg

SEQ ID NO: 3355 - DNA, 201 bp, Homo sapiens
  source 1..201: mol_type = unassigned DNA
ggacgggagctgcggggagggcggccgggggactccgcagagcccgctccgcccgcagccgcggggcgccgagggcagggcgggcgctcagcttggccccgccgccccgcccgcagttcctcgaaaggcggccgccctgccctggccagcctggcccgacccgggggcgttgcgtgcgggcggccccggggctgctggcac

SEQ ID NO: 3356 - DNA, 201 bp, Homo sapiens
  source 1..201: mol_type = unassigned DNA
aactcaacacttcctctctcccttctggagtcactttcccttccggaatatgcaagctctgggtggcccagccctgccgccagactcagtttccaagtgcgggggaaggagatgggcgctctcagccgcgatcccctgggaaggtggccactcacctgcgctctgaaatagaagaacagggcgacgctgcagacaacctgg

SEQ ID NO: 3357 - DNA, 217 bp, Homo sapiens
  source 1..217: mol_type = unassigned DNA
attggctgaagttcccccagcgatttgcatgaaccgagagggagtgtcttctgccgccctcccttcaagagcgctctgactgcagcctcccagggaatgcgcggccgagggaatgcgcgcagctcacaggccctgggagtgagctggtgcccggcgacctggcacccgcgcctggatatggggcgtctacatcgtcccaggagcagcaccagctaca

SEQ ID NO: 3358 - DNA, 317 bp, Homo sapiens
  source 1..317: mol_type = unassigned DNA
agcaaaagcctctatttgcagcaccgggcatgttgtccgtttaacgcgctccggggatctgctggctcgtgctcccaacccaggggtggctatacgtctcgcgcctctgttcctgggtagactcccccatctgtgcattttggccccttcacttagcaaagagatgtgcgaagtgtgcgcctggagacgagccgcctcggtgacccccatccgcccgcagcggtggccctggttccccggatccgcgcccgcgccctgcgggtctcccgcgccgcccttgcccgccggaccacccgggctcagagggtcgctcgctt

SEQ ID NO: 3359 - DNA, 201 bp, Homo sapiens
  source 1..201: mol_type = unassigned DNA
gaggggaggcacggagcgggaggagggggacgcggagaagactgcctggccccgccggccccgccaacgtgacggtcagccccgccgagcgctcgcacccgctcacactcatgatcactcgcacactcgctccaatacgtgttaaggcgcgatcgcggggtccctggcagccttcgctgcaccctcccccccacaggggta

SEQ ID NO: 3360 - DNA, 201 bp, Homo sapiens
  source 1..201: mol_type = unassigned DNA
ccgcccaacacggagacgcggagtcccatagcggtggcagaaagtgagcaccaactcagcaacagggggaaggaaggggacgccgggcggccagtgggacgtgcggcagccgagggctgcagcctgcccctgcagcgcgcccgcgcttacctgcgatctcctggtaggggatgtccgccaggctgaatcccttggcaccgt

SEQ ID NO: 3361 - DNA, 201 bp, Homo sapiens
  source 1..201: mol_type = unassigned DNA
cagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacaggttggtcaccgccgccggtgcccgggaggctgcggcgc

SEQ ID NO: 3362 - DNA, 201 bp, Homo sapiens
  source 1..201: mol_type = unassigned DNA
agtgtgactgatgcattcattatttaataactccggggtgaaacttgaggtgaacggtttcaccctttcatactcaggaatggaactagtcctcggtaccgtgcacagtctgacctcacgctcgcacgctgggctcccggcctcctggcagtgcacttaagtgtaccccgcgtgtgcccggcggactcccgtgcacaccgc

SEQ ID NO: 3363 - DNA, 201 bp, Homo sapiens
  source 1..201: mol_type = unassigned DNA
gcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagccc

SEQ ID NO: 3364 - DNA, 221 bp, Homo sapiens
  source 1..221: mol_type = unassigned DNA
agtccaggtctgcgctcacacgcgcggcgctcacacgcgcggcgcccacctggctgcagtcccggccagggccagcgcgccgcggctgaagggggcgctcggactcctctggggcggcgcgcagccgggacagtctcgcatgacgcccgcgctccagcggccccgggacgcggcctcaccctcaacccctggcggtctcagcctcggtctttgtgtctcgg

SEQ ID NO: 3365 - DNA, 311 bp, Homo sapiens
  source 1..311: mol_type = unassigned DNA
gccccgccccgcatccgcacacaccttttccgccgctgccctgagcgcagcgacaagggcccccacacctccgcggcccgcaatgctccggggccaagccgaggcagggaggcgctcccgcagctcctgactttacaacccgcgcgcgtgtgcaccgagccgcgggcacaccgcgaacacacacacacacacacacactcgtgcgctcccgccctccgcccggcccgggctctccgaacttacctccgaggcgccccgggcgcagggcccgcccttctctgcgggtctccagcggctgttcggcagtggtc

SEQ ID NO: 3366 - DNA, 308 bp, Homo sapiens
  source 1..308: mol_type = unassigned DNA
ggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgtaagtgggcccagcccaggcagagcgggccgaagtgtgtcccggggaggcgcccacagacccgtcggtctccccgtccaggaatccctactagaggagaacgcggaaaaagccttctacggctcag

SEQ ID NO: 3367 - DNA, 201 bp, Homo sapiens
  source 1..201: mol_type = unassigned DNA
cgagaactctgcgggtccagaacgcccgcgcggacgcttctcttacggcgccggaagccggcgccgagtctgtcaccgggcatccctctgttgccttgacgacggcgggcgctgtaagagtggagaagctgcaggtgctgaggcgcggtgaaagaaaccctgggagccaagagcacgaggagctggtgtctgtgtcacatt

SEQ ID NO: 3368 - DNA, 201 bp, Homo sapiens
  source 1..201: mol_type = unassigned DNA
aggtgactccggccctggcgaggcgcgatccggctatgcgtgtgtgtgcctctccccggagaggaccccggccgccgagggcacgcggggcccagctaccgcccgcctcccaaccagttgctggctcgtttcgatggtgcaaattgtttttttttgctccccactaaatagcaacagtttggccacgctcaagtggaataa

SEQ ID NO: 3369 - DNA, 201 bp, Homo sapiens
  source 1..201: mol_type = unassigned DNA
gggacttggtgactttagcaccattttttccttttccttttttttttttgcctccccaccgtctgttgcaaccctgcaaagtctcggagtcggagagcgcgcctcgcttccagagcccccggacccggcgagtcagcgatcgccgagccggccaccatgcccggcagaccgcgccactaggcgctcctcgcggctcccacc

SEQ ID NO: 3370 - DNA, 630 bp, Homo sapiens
  source 1..630: mol_type = unassigned DNA
agccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccgg

SEQ ID NO: 3371 - DNA, 201 bp, Homo sapiens
  source 1..201: mol_type = unassigned DNA
gagggcggggcgggcggcggccgcgcctctaatcccggcgctgcgtgtgggagcggccggatcagggaattagcgctgtaacttcggattagtaacgctcgctaaatgagtgcctaattccgacccttcatgcttttcagcgtcgcggctgagtcctaggaggcctcctggccaggctccctccgcgctctggtcccattt

SEQ ID NO: 3372 - DNA, 239 bp, Homo sapiens
  source 1..239: mol_type = unassigned DNA
cccgtgaaccccgcccggggacaccccacagcagccgcgcccccaccctcctctccccaaaccgtcccgggcccctgtcgccgccaccttctgccaaaccgtccccatctctccagcggagctacagcggggcgcggcgcacacaaagggggtcggagggtggagagtacagaaggagggagagatcccgccagggctcgtggcacgggcctgggagcagctatttacccgatttcttc

SEQ ID NO: 3373 - DNA, 201 bp, Homo sapiens
  source 1..201: mol_type = unassigned DNA
gacgtcagccgcgcgggtcccccgagcccgcgccgcgcccagggacctggcccgccccctgcgcccccactctcttacccctcccagaaacacagcacgcgggccctccccatgcaggccactccctacggagccccaggccagctttggggcggtgaaacgaaggtgtcaaggcatagtactcctccgggaggctggaca

SEQ ID NO: 3374 - DNA, 221 bp, Homo sapiens
  source 1..221: mol_type = unassigned DNA
cagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgcc

SEQ ID NO: 3375 - DNA, 201 bp, Homo sapiens
  source 1..201: mol_type = unassigned DNA
gcggggaggggatggggtggcgggagaactgcccctccccccagccacaaacccatcaggttcccaaacctttcctggatcctcttctccgcgcccccgcgagcccgggatccaggggatggagaactcggggcggaggagcgccgagccaggcgggagggaggccgagccgtgggcgggaggcggaccggcgtggggctg

SEQ ID NO: 3376 - DNA, 246 bp, Homo sapiens
  source 1..246: mol_type = unassigned DNA
gccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataaggtgagtcctaagaaaaccca

SEQ ID NO: 3377 - DNA, 223 bp, Homo sapiens
  source 1..223: mol_type = unassigned DNA
ccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtca

SEQ ID NO: 3378 - DNA, 201 bp, Homo sapiens
  source 1..201: mol_type = unassigned DNA
ccagggcacggcgtcagcggattcacggagaaggagaaaagccccactgccgtgcagaagcctaggcccgggtgagacgcctgcgaaggctgccagcagcggaagagaaggggcgtcctccgtgctgcgcagcactcgcccgcggtaggtgggcgcggagctcagagctgggagccaaacgcaaacgctggcgagaagccc

SEQ ID NO: 3379 - DNA, 244 bp, Homo sapiens
  source 1..244: mol_type = unassigned DNA
gccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgca

SEQ ID NO: 3380 - DNA, 201 bp, Homo sapiens
  source 1..201: mol_type = unassigned DNA
tttgcccggctcgctgaaggctggctctgggcctgggggcagtgcccgcgaagggctgcgatggcaggccccgctgccacacggcatcgagggtccctccgcctcggcgccaggcgcacgcccttctgccacatccctcgcggggcgcgccgccagggccacctgccctttcaagccccgccaggcagccaagggtgagga

SEQ ID NO: 3381 - DNA, 457 bp, Homo sapiens
  source 1..457: mol_type = unassigned DNA
ttgagggaggggccgggccttcgggcctgcagacccgccaccgcgcgtgcgcatgcgtcggccgcgagcccccgggtgcaggcctgggcggctccggcccgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcgggggaggcatgggcccgggcaggcctaggaggaagctgcacagcccgaggcccgggcgggagtggcgggccgcgggcaagggaacgtatatttggaaggg

SEQ ID NO: 3382 - DNA, 244 bp, Homo sapiens
  source 1..244: mol_type = unassigned DNA
gcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctc

SEQ ID NO: 3383 - DNA, 206 bp, Homo sapiens
  source 1..206: mol_type = unassigned DNA
gagcgcagcggcggggcatggaagaagagggttgggggcgcgcgttacctgcaaaggttctcgaggtctccttccagccctggtggtaatcccgctcagcgccgcgccctcccccagatccaaacttttgctgggtcctccgggtggcggcggcggcgacggcggcggctgctggagccaagccctgtcgcccgcagcgtcggggc

SEQ ID NO: 3384 - DNA, 203 bp, Homo sapiens
  source 1..203: mol_type = unassigned DNA
agagagacagcatgagaacgcgcagagctgcaccccgcgggggccgggcgccagcagcaccgcgctgccccacccacggcgcgtctgctccccgcgctgcgcgcccagcggggcgccgagccccagaaactttagcacatggccggtccggcggccacggtggccgtagctgccctgctcttcgagcgccccccactgcttcc

SEQ ID NO: 3385 - DNA, 266 bp, Homo sapiens
  source 1..266: mol_type = unassigned DNA
cgtgaccactccccgccccacccccggggcggggtccgtcagaaaccccaagcgctcgcaatcgcctcccttcgtgggcgggatggggaaactgaggcccgaggccgccccgctggttggtgcaagaaccagcctgcaacccaagtcctgagctgttggcgccccgccccgtgcagttgaacccaacccacccggggctgtgggcagcgctctcttggggctgacacgttatcccgagcctgaggaccaagatcggagtgacctgg

SEQ ID NO: 3386 - DNA, 242 bp, Homo sapiens
  source 1..242: mol_type = unassigned DNA
cccgaacctccccaaacttggcggcccggggcgcgtgggggggacgccccgttacctgcgcggccataaaggagagatccatggtgtcgctgcagccagcgctcgagtcctcgctgctgccgctgccgctgcgggtcagccgcctgcacagttggcggggatcgggctgagcagcgagcgtccggagaccgcacggcgcactcggctgtctctgggcttctggctccagatctctactaggc

SEQ ID NO: 3387 - DNA, 201 bp, Homo sapiens
  source 1..201: mol_type = unassigned DNA
caaagcaaaacaggacaaacgaccgcggcgcgtcgacgcttggcgggtcacggtcacaaagcgggtctcagagccttcctcaggcggcggcaaagggggcgcccgaggtcaccggcaagagacagattactggcgcctcgggaaaacagagtggggaagggcgagactgtgtgcccatccacgttcgcgcgggtctgagct

SEQ ID NO: 3388 - DNA, 201 bp, Homo sapiens
  source 1..201: mol_type = unassigned DNA
acgctggcgaatgactatggaaacaacattcaacagcagtgttttctatgccaggtacacaaccgccttggcgtgggttgataaccatgcctatctcaccgcgtggcactgagccgaccgcacacccagggccccggtctccagggctcgcttactcgcttactgcgtgaagcatccatccccgcaggagccggagcagga

SEQ ID NO: 3389 - DNA, 312 bp, Homo sapiens
  source 1..312: mol_type = unassigned DNA
tggtcgtctcctccgcggccaggcgcatcctgcagcgcccagaccgccgcgtccccacccgcgtccccaaccgcgagcgctcgcctgggccgggccgggcgcccgagattcgggagagattaggggcccgcaaagcagaagagcagattcagaaagaaaaaaaaaaaagcgagaagtgcgagaaaaatatactgaattcagctaaacacacggcagatgaaaaaaataccttgctcagaagccaaaaacgagctcccgagccgtgagacactgttgcgcccccgccaggcgtgcaggccggatgttaggggg

SEQ ID NO: 3390 - DNA, 203 bp, Homo sapiens
  source 1..203: mol_type = unassigned DNA
gcgctggcagggggaggcttcggcaacgcctgggggcttcaggccagcctcctccgggctggaaggcaccgcacaggggcttccgccaacttcggtcctcgcgcggtcgggacacggccacacctgcccgcgggggtctgcctcccaggccgccgcaggccccccggagcctaagaggaccccacaagcagccaaagccagcg

SEQ ID NO: 3391 - DNA, 201 bp, Homo sapiens
  source 1..201: mol_type = unassigned DNA
tcccggggcgggcggcgaggggcgggagcccagagagtgccccgcccttgcccagtgctgggcggcgcgtggggggggtagggtccccgcttccccacgcggccccgcgcactccaaggaccccaacctgttaggtgagtccctgccccggggaggggcgctgggggcggcggcgaggatctagttgcgcgcgcgcatgcg

SEQ ID NO: 3392 - DNA, 283 bp, Homo sapiens
  source 1..283: mol_type = unassigned DNA
gtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgct

SEQ ID NO: 3393 - DNA, 201 bp, Homo sapiens
  source 1..201: mol_type = unassigned DNA
gaacgccttccagcccggcctggcactggcgccggtgctcttcatcctggccatcacggccttcagggacctgtgggaggactacagccgccaccgctccgaccacaagatcaaccacctgggctgcctggtcttcagcaggtgagttgggcgggcgggcgagcgagcgcgcggtggcgcagggcagggcgccccgggaac

SEQ ID NO: 3394 - DNA, 247 bp, Homo sapiens
  source 1..247: mol_type = unassigned DNA
aggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaa

SEQ ID NO: 3395 - DNA, 427 bp, Homo sapiens
  source 1..427: mol_type = unassigned DNA
cagcgcgcctcgggctccgcgcgccgccagctcctggcccgcccgccggccccgccgcgcccgccagccccgcagcggagcctcggcccggccccgggccgccgccaccacgccgcgcgccgtactccgcgtcaagaatggggcggccaagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggtaagcgcgcggcccgccccccagacccccggggtgtcccgggatccaggtccggtagccccctccccgacccgtgcgccctcctccccacccccaatcccctgggaaggcgcccc

SEQ ID NO: 3396 - DNA, 246 bp, Homo sapiens
  source 1..246: mol_type = unassigned DNA
ctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaaggtgcgggtccggcttcggttcatcccaaggggtcaccgggatgcgaagtccgggacgttcgccgccgcggtgaccccggcgggggcgcatcccggctgtgggccg

SEQ ID NO: 3397 - DNA, 384 bp, Homo sapiens
  source 1..384: mol_type = unassigned DNA
tggtggcggaatccccggggcggccggaggcggcggccggggagtcgagaagcaagtactagcgctccaggaccgcgcgcgccgccccgcgccgccccgcgccgcccctcggtccagagcccccacccccggcctgtgagcctgcggcgctggtggagcccggctccaggaagaggagctcacccggtcccccctgattggacagcagcgaggtcccaccgggcgcctccgcggcttaaaaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgca

SEQ ID NO: 3398 - DNA, 415 bp, Homo sapiens
  source 1..415: mol_type = unassigned DNA
cggggggggcaggggtcccgggccgcggggtgcgggggctgcgccaaaccctcgcggggcgtcccgggcgcacggagggctcggcgcccacccgcccgacggcgttccactcactggcgcccacggcccgcaggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgccca

SEQ ID NO: 3399 - DNA, 543 bp, Homo sapiens
  source 1..543: mol_type = unassigned DNA
cgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgca

SEQ ID NO: 3400 - DNA, 227 bp, Homo sapiens
  source 1..227: mol_type = unassigned DNA
tccagggcgcagacctcccactgcttcccgggtccctcccgggccttctttctgattctctcccttcccttctccgagttcctgctcacattcaggctgcgtctcggcctggctgccaaacagaacgacgttcttgcgcagagctgaccaggggtggcggcgggaggcaaggctcccggcaccggaaagcaaagcaaagaaaaaggcattgcagccatcgctcctgg

SEQ ID NO: 3401 - DNA, 323 bp, Homo sapiens
  source 1..323: mol_type = unassigned DNA
ccctgctccgcgattggcgggagccggagcctccctgaacccggcgcccacaccatgggctgagcccgtcggcgccgagggagttagtgcgacccggctcggcgcgcacggccaaggcacgcgcgctggcacacgcgggcgcggacacgcgcggacacacacgtgcgggacacgccctcccccgacggcggcgctaacctctcggtaagtccagcgccccacgcgacctgcccggctcccacgctggctacagcggctgcggggacggggaggaaggcagcggggtggccctaggggctcactctgcagggctcttccgacgg

SEQ ID NO: 3402 - DNA, 279 bp, Homo sapiens
  source 1..279: mol_type = unassigned DNA
ggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgcc

SEQ ID NO: 3403 - DNA, 261 bp, Homo sapiens
  source 1..261: mol_type = unassigned DNA
tctccgtcggtggaggtcgcggctggcggagaccgccaagccagaggaggggatccgaggtcccggctgggcgaaggttctggagggggagaagacggccgaggcgtggaggggcagccgcggcggggcgacccttacctgctcactgcggggcctgtccgtggggccggggcagactccgcaaaggacgcgcagcctgcaagtccgcggcccgcgcggcgcggggatggggagcgtgtgcgccgaggagcgcgcgccgag

SEQ ID NO: 3404 - DNA, 364 bp, Homo sapiens
  source 1..364: mol_type = unassigned DNA
tgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagc

SEQ ID NO: 3405 - DNA, 242 bp, Homo sapiens
  source 1..242: mol_type = unassigned DNA
cagggtggaggcggtgcctgactgcccctctgcgtgtgccctgggaggtgggtttgctctggggacagaggtgctggacgtgtaggagcagacatgccgcgcgctccgaggaagcgccggaaccaccagaagcacagggacgcgggtgccgagagtccccagcactgaaaacggggatctcctcttctgtaagggattttcttcccttgtcttaacccacttctctagactcaagggacgcc

SEQ ID NO: 3406 - DNA, 285 bp, Homo sapiens
  source 1..285: mol_type = unassigned DNA
cagtcccgggccggggtggctgctccatcctcgtggctcagggaggaggcgttgggtgcgtatgcttaggggtgtgcccgctgccagggctgcagcggccgccacctccaaccagctgcaagccgagctgcccacctgggaccgggccggcccggcgggcttggctcccggcgaaggcggcggcgttggtgcgcggcggctggggcgcgggacgcaggcagtgcgtggcgcggctggcgtcttcgggcgccgccaccgagcgagggtgcggccccgggcggccgt

SEQ ID NO: 3407 - DNA, 222 bp, Homo sapiens
  source 1..222: mol_type = unassigned DNA
cgccaccgctgccgccgcctccccgcggagtgacgcgccctgcagccaaccggggcagccgggggggaggtccgggaggggtcctgggcggagccgggccgcccccttatcccacgggctcggggctgcttctcccgaaaacttcagccctaattgtcctgggaatgtccgaggtagagaaagggagcgagggagcaagcaagaagctggaggatcagtgcc

SEQ ID NO: 3408 - DNA, 201 bp, Homo sapiens
  source 1..201: mol_type = unassigned DNA
gtagcgctccctggccccgcgcgtcgcccgggggtcgctggctcggtgcgtgtggccgcctcgccgcctggttggagcctgctccgcggcgcagggctgcgctccgagggtccgctggctcggtggcctggggtttgcccggctcagcggctcatggtccggcccccgcgccccagcccccgccgccgccgccgccgccgc

SEQ ID NO: 3409 - DNA, 298 bp, Homo sapiens
  source 1..298: mol_type = unassigned DNA
ccggctctgggtggcggcgtcggggcagcgcgctcggccgagccggggagaggagcgcgggagacccggagcggagcggcaggagagcgcggagcgaagcggcaggagcagctcacagccaggagcgctctcccgcccccaacgccgcgctcccccctccaaaacggtttaaaaaaatccaccaattgcatggccgcgcacccccaaaaaggcacccgccgccacctggtcccggtgaactccaggaggcggaggaagggcgcggggtgggtgcggtgacaccgtgggaggtggtccc

SEQ ID NO: 3410 - DNA, 272 bp, Homo sapiens
  source 1..272: mol_type = unassigned DNA
cactcactccgacccgaggctgtctacccggcctggcatgtcccggcgctcctggggcccctgtactccgctggttcctcgctgtggtgtcccgcagcccgaccatttctgtgcttctaggagcccaccctgggcggcagggaggcgttgcgtggggctcacgagttccacgctgtcatctccaccagctcctacctcccaggcgcctgccctcccgcactgtcaggttctgcctccgcagcatttggcagatctgagcccggtccctgtca

SEQ ID NO: 3411 - DNA, 201 bp, Homo sapiens
  source 1..201: mol_type = unassigned DNA
cttagtaacatctgcagggctggctccccggccgcccaccccgccagcctgggtttctgtgtggagtgcgtctctgtgcccctggccagccgccggtcacgtgcacttcctgccaggggctggcaggctcctcacttgcccaaaccagaaatacaaggcacagtggccttcagctgagggatggcactctccctcatgctc

SEQ ID NO: 3412 - DNA, 251 bp, Homo sapiens
  source 1..251: mol_type = unassigned DNA
tacgctcctcgcgtccgcccgcgtctgccctaggcctccaccgcggcttcctctgtccccggggccgccctgctccccacagaccccactctcgggggccgctcccaggacccccgcccgctctctcctgactcggtccctgcccgccccgcctcccttcctcgggctccctacctctccctcgccggccccgacctcgggggcgctccggacctgctccccgaatatctccagctccgccttcagcctgc

SEQ ID NO: 3413 - DNA, 249 bp, Homo sapiens
  source 1..249: mol_type = unassigned DNA
cggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcaggtgccgccgagcggagctccgagagcgggt

SEQ ID NO: 3414 - DNA, 249 bp, Homo sapiens
  source 1..249: mol_type = unassigned DNA
tctctagagctaacttttcagacctggaggtctccaaggcccccgcaactcagtgagtctcggggcaccaacaaatccccgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggac

SEQ ID NO: 3415 - DNA, 201 bp, Homo sapiens
  source 1..201: mol_type = unassigned DNA
ggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcag

SEQ ID NO: 3416 - DNA, 201 bp, Homo sapiens
  source 1..201: mol_type = unassigned DNA
atggcccaggcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccgtaagtgccgt

SEQ ID NO: 3417 - DNA, 251 bp, Homo sapiens
  source 1..251: mol_type = unassigned DNA
accgcgcagcccgcgccccactgccgaccggaccccacgctgttgcccccagcgctgcgcgccctgcgcggacccgcgctgctggacgccgccatcccgcgcctggggcccacgcgagccgcgagcccctgcctgctcctgcgctaccccgatcccgcgccctgcacccgccccgggcccgcgccccgcgcccgcacgcaacggcacccggccctgcacacgcggctggctctacgcgctgcccggcgccg

SEQ ID NO: 3418 - DNA, 201 bp, Homo sapiens
  source 1..201: mol_type = unassigned DNA
ggggccccgctgagctgagccttgcgacccggtttatgtgacgtgagttccacctcaatctaagtgtgaggaagcgaacagcgttctgaaacgcagaaacgtgcccattcgaattgttaacgcgagcgcagagcccactgacaaagcaaaataagacaaaccgggagtcagaaaactcagcgacccacaggatccaccgtg

SEQ ID NO: 3419 - DNA, 201 bp, Homo sapiens
  source 1..201: mol_type = unassigned DNA
tttcagaacccgcgggtcacccgggagctcctcccgcagtaccagccgaaagctcccagtgccgaggagggcgggcagctgccctccccgacctcgccccgcccgcgcggacgcccccggccccacgcggggaccaccccgggactcccgccggaccccgcgcgcccgcggccaacctgcgtgcacctgcgccccgcgcca

SEQ ID NO: 3420 - DNA, 201 bp, Homo sapiens
  source 1..201: mol_type = unassigned DNA
aggccgagtccgcacggcgcccccgtgcagccagcggtcagtgaccgcgcggcccgggcgctccccgcgcgccctagctccccagacggggcccggacgcggacgtcttctctgcagttctgctctgatcgctagggatgggctctgggcacccagcggctgagggtggggagcggccagcgcctgatgtccagttcctca

SEQ ID NO: 3421 - DNA, 337 bp, Homo sapiens
  source 1..337: mol_type = unassigned DNA
gtggccccgccccagggccgcggggaggcgcccccgtgcggggcggagttgtcaccgccccctccccaatccccggggactgtggccccttcttaagcccgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtcagttgcatctccaggcagcccttcggacacccggcgtcctgtgcccactaacgggcaccgatcccgggagccctgag

SEQ ID NO: 3422 - DNA, 201 bp, Homo sapiens
  source 1..201: mol_type = unassigned DNA
tgccctcggcgtcccacgtgtggcggcggccagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcc

SEQ ID NO: 3423 - DNA, 201 bp, Homo sapiens
  source 1..201: mol_type = unassigned DNA
ttctttgcggcgaggtcgcctgatgaattcaagggcaccagtgctccgcgagaactttctgtgggttgtgacgagaaccaagcggagcgcaaccctcaccgcacccggacaggatgcgctgcgcaatctgccgtagtttccctgccctaccccgggtggtccgaagctgtaaccctgccaattccctatcatacgccatgt

SEQ ID NO: 3424 - DNA, 201 bp, Homo sapiens
  source 1..201: mol_type = unassigned DNA
tcctgcagctctgtccagatccggaagccgccgaggaagggaggaaggcgggggtggggagagcgcgaccttaagcgctggcgggcggcgaggaggggccgcagcggcccgaggaagcgcctggaggcgtcaggggcgccgagtccccagggaggccgcgctctcgggaagtttcccatcggttgcccggagcaggatcgg

SEQ ID NO: 3425 - DNA, 1216 bp, synthetic construct
  misc_feature 1..1216: note = Description of Artificial Sequence: Synthetic polynucleotide
  source 1..1216: mol_type = other DNA
taaggtggggatygggaygygatyggggatggggaagggggttgtaggaggtttygtttgygttgtygtttttgttgggtatagygttttttattattygyggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagygattyggtyggygtygggtgygtgtgggygygtgggtgttaggttgggyggaagyggygtttttttttatgttgtaaattaagggattttttttygtttt

SEQ ID NO: 3426 - DNA, 365 bp, synthetic construct
  misc_feature 1..365: note = Description of Artificial Sequence: Synthetic polynucleotide
  source 1..365: mol_type = other DNA
ggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggtt

SEQ ID NO: 3427 - DNA, 201 bp, synthetic construct
  misc_feature 1..201: note = Description of Artificial Sequence: Synthetic polynucleotide
  source 1..201: mol_type = other DNA
tggygtgayggtttgtggggtttgyggggtgygttgttttyggatttgyggggggaggyggttgagttggyggygttygygggtttagtggtgagtgyggygtttttaygtttagttygaygttttyggagyggtygtygygtaggggtgggygygggtttttaggagggagggyggttgtgaaygygttttgtttttygc

SEQ ID NO: 3428 - DNA, 201 bp, synthetic construct
  misc_feature 1..201: note = Description of Artificial Sequence: Synthetic polynucleotide
  source 1..201: mol_type = other DNA
attaygtygttygtgtttattatttayggtayggaggaygaggtgatygatttttygtaygggttggygttttaygagygttgttttaaggyggtggagtygttgtgggtggagggygtygggtataaygatatygagttttatagttagtatttggagygtttgygtygttttattttttaggagttgtttagttagygc

SEQ ID NO: 3429 - DNA, 201 bp, synthetic construct
  misc_feature 1..201: note = Description of Artificial Sequence: Synthetic polynucleotide
  source 1..201: mol_type = other DNA
gggygyggygggygaggggttygggttgagttgygggtyggttyggatggygggyggygygggttggtygggygttttygyggttttgttgygtttygtgygtygtttgygygaggtgttygaggtgtgyggtygygatttygayggttttttgygygtggagygygtygyggygttyggattgygtttyggttagggyga

SEQ ID NO: 3430 - DNA, 201 bp, synthetic construct
  misc_feature 1..201: note = Description of Artificial Sequence: Synthetic polynucleotide
  source 1..201: mol_type = other DNA
ggygtttttttttygtttttggtttaggttyggttygygggtgtagttttttttagggttttttttttttttygggtygygygttygtttygtatygyggyggtttttyggtagtgtttgtttttattggaygtatagtgatygtgaygggtayggggygygagtttttattattataatgggtgtgtatggygyggggyg

SEQ ID NO: 3431 - DNA, 201 bp, synthetic construct
  misc_feature 1..201: note = Description of Artificial Sequence: Synthetic polynucleotide
  source 1..201: mol_type = other DNA
tttttttttaattgatttaattttttaattttagtttttygtttttggtatyggtttttttttaagtttttagattttaattttggttttygattygtttygttatagtttgggaagygggagaagtagygygygtttttttgyggatttttttttagggaagattgtggtgttagttgtttagggggattagggggttat

SEQ ID NO: 3432 - DNA, 201 bp, synthetic construct
  misc_feature 1..201: note = Description of Artificial Sequence: Synthetic polynucleotide
  source 1..201: mol_type = other DNA
agtttaggggtagggggtttagggtagttagatttttttaggtttaggaagagtagtttttagygttyggttgttaggtaattyggttttyggttttttayggyggttttttyggtgtgttttattaagagygatagggttggtgattygaggggygygtgygyggtygttagtttgggatttgtayggattttttttttt

SEQ ID NO: 3433 - DNA, 213 bp, synthetic construct
  misc_feature 1..213: note = Description of Artificial Sequence: Synthetic polynucleotide
  source 1..213: mol_type = other DNA
gttttttgtttgaattaaagtggttaggtatttagtttgtaagatgaataaatgaaggaaagaaggaaygaatgaataagggtttattttgtagagygttygygttttagygygtattaggtatattagtgttaaaggtgttgggggtygggtttagygttyggygyggttggaatgggggyggygaggagttttttttagttagtygtaggg

SEQ ID NO: 3434 - DNA, 201 bp, synthetic construct
  misc_feature 1..201: note = Description of Artificial Sequence: Synthetic polynucleotide
  source 1..201: mol_type = other DNA
gggaggyggtaggtagggggygttgyggggygaggtaagtgtagttygtygttgtttgtttgygagtttggggttgygygtygttttttatttagttgygygattygagygtygygtttatygygtttygtgggttttygygtttygaagggtygggattyggtttgagttttttttggttttyggtgtaagtygttgggt

SEQ ID NO: 3435 - DNA, 201 bp, synthetic construct
  misc_feature 1..201: note = Description of Artificial Sequence: Synthetic polynucleotide
  source 1..201: mol_type = other DNA
yggggtattyggtygtgtygtygtygtygttttagttgtygtttttgttttygttttygygatygttgttagagygtattattygygaggaggtggagggygaaagtttggatttgtgtttgtagtagttttataaatagttaagtagttgggtttggttggtggtgggttygyggtttttatygygtyggtttyggaygc

SEQ ID NO: 3436 - DNA, 201 bp, synthetic construct
  misc_feature 1..201: note = Description of Artificial Sequence: Synthetic polynucleotide
  source 1..201: mol_type = other DNA
aaggggggtttggttygttagygtaggggattygagttgggtaggatatgtgagatagttatagttttttagagattaygataagatttaattagtygygygtggttttyggygtyggagygggttagtttagttyggtttagttyggtttygygtagagttttygtygttttygygtatagagtygggtgttttttgygg

SEQ ID NO: 3437 - DNA, 324 bp, synthetic construct
  misc_feature 1..324: note = Description of Artificial Sequence: Synthetic polynucleotide
  source 1..324: mol_type = other DNA
ggtgggggtttgggagayggtygaagggggttygggtagaagtttygyggtygggtyggyggagggaagggggyggtygygttygggattyggtttttttyggttttatttatttgtttygaagagtggttttagttttgygtttttttttgygattttatatatagggatagttttaggtatagttttagtagtaggagtatggyggggygagggygygggaygttyggggattyggygggataygttttgtagygtttagggttttagttattgygggaygttttyggggtygtttatttygyggttttagttyggatttyg

SEQ ID NO: 3438 - DNA, 201 bp, synthetic construct
  misc_feature 1..201: note = Description of Artificial Sequence: Synthetic polynucleotide
  source 1..201: mol_type = other DNA
tygyggtgttgtygygttaagygaaggaggaggagggttyggygattttggggaygaaygttttggaygtttygttygygtttttttttygygttygtygygygtttgtttgttyggtttttttttygtttttttttyggtygttygggttaaaatttaaggttaggtttttgagggttygggttttttagtygttttttt

SEQ ID NO: 3439 - DNA, 330 bp, synthetic construct
  misc_feature 1..330: note = Description of Artificial Sequence: Synthetic polynucleotide
  source 1..330: mol_type = other DNA
ggattttggygtttttttaggttgttgygygygggttggggatygtgtatygttttgygygttagaygatgtattttttggaayggtagttgaggtaatgyggggtgtgaagtggyggygggtagaggggttygtaggggttgggattygygtgtttttttttgtttyggtgyggagtaygatgtgttygggygggggygaggaygttygggaggggttgggttgygtaygttygyggggtygtygtagatgggyggtttggaggygttgtagtttttgggaaatgggagttttygttttgttttttttgttgtttggttgggttgggtt

SEQ ID NO: 3440 - DNA, 293 bp, synthetic construct
  misc_feature 1..293: note = Description of Artificial Sequence: Synthetic polynucleotide
  source 1..293: mol_type = other DNA
tttagtattttagtttttaagtttttttgagtyggggttgygttttygttgtttttttyggtygtygttttttggygttagagggatttygyggttygtaygggtttgttttyggtttygttyggagggtgtgygggttttygtttygttggtttygtttgtttattayggygygtttaaatttaygyggttygyggttttttgygtgttttgtygatttygggtygtaggaggggttagtttygtyggtttttaygyggggtttgygtyggtagygttaygggttggaaygc

SEQ ID NO: 3441 - DNA, 201 bp, synthetic construct
  misc_feature 1..201: note = Description of Artificial Sequence: Synthetic polynucleotide
  source 1..201: mol_type = other DNA
ygttttygtttyggtttttygtyggtttggygggyggygaygtggggaggggtygtttagaagtyggggtygttygggtyggggaattttttygygtygaygtttattttttaygggtygtattygtygaggggtygaaaggggttttagtggaggaygyggtgggagttgggtttygttttagttgtygaygtyggyggt

SEQ ID NO: 3442 - DNA, 201 bp, synthetic construct
  misc_feature 1..201: note = Description of Artificial Sequence: Synthetic polynucleotide
  source 1..201: mol_type = other DNA
tatttygttaaagtyggataaagygtggttagagtgyggtttagttttttagtttgyggttyggggaggagggtagygygggygygggttgggggtggygyggggyggygtttaggatttyggtgtaggygagagtgyggyggatttgttttaagaggagagygaggyggatttgttttaagaggagagygtggggygtyg

SEQ ID NO: 3443 - DNA, 226 bp, synthetic construct
  misc_feature 1..226: note = Description of Artificial Sequence: Synthetic polynucleotide
  source 1..226: mol_type = other DNA
atggygatgtttttatttttttyggtaggtttttttaattaaaaagttggaaaygggaattygtaaataaygatttagggttttaaattatttgtaaagaygygatggggaggggaatatttgygygttttaaaattttaatttygaggtttttagtygygtttgattygggagtygggtgygtttttagtgttygygtaygaattyggygttttggtagtttyga

SEQ ID NO: 3444 - DNA, 363 bp, synthetic construct
  misc_feature 1..363: note = Description of Artificial Sequence: Synthetic polynucleotide
  source 1..363: mol_type = other DNA
ttgtaagggattatagttataatttattaggtaattatatttatygtattgtagaagttatgaatttggygggygtgggggggaaggggaagaagttyggygagattagaggggaaattygaaaaagtaagtttttgyggtagtagttaggaaatattygttaggaattggttgygattttaattttagyggttygaagttttagtttttttatttttatygyggtagagtygttttygtagatatttttygaggagaatygyggtttygagggygttaggtgagtygygtygtttygagttttygggttayggtaggtygatttaggygttttyggttygttygtgttttygygttygggtg

SEQ ID NO: 3445 - DNA, 201 bp, synthetic construct
  misc_feature 1..201: note = Description of Artificial Sequence: Synthetic polynucleotide
  source 1..201: mol_type = other DNA
yggttyggtgggggtttyggygagygggagggyggttggggatttyggtygygtygggygyggggttygggattygggagatygygyggygtygaagttaygygttagttttattgtttygygygtttygttttaggtttygggtttttttttygtatttygtaaagtygagattttttygtagttttttatttygagagg

SEQ ID NO: 3446 - DNA, 201 bp, synthetic construct
  misc_feature 1..201: note = Description of Artificial Sequence: Synthetic polynucleotide
  source 1..201: mol_type = other DNA
tygygttttttygttagtygtyggttaggagtttttyggtttttgagtaggaygygttaaagggagttgggaggtttagtagtttttagygtygttttttygggtgaygtgaygttttttttggagygygggttygttttygttaagtttttatygtaggtttttatagtygagttaygggaagatgtaaygtygggygag

SEQ ID NO: 3447 - DNA, 267 bp, synthetic construct
  misc_feature 1..267: note = Description of Artificial Sequence: Synthetic polynucleotide
  source 1..267: mol_type = other DNA
ygyggggtgggggygygggagtygttttttgttygtttygygygtatgttttygtygtatttgtttygtttagtgttttatatttyggggagtygggtggygttgggttygtygaggtyggggtttttttatgggagggaggtggttgyggyggaatttttagatgygtttttttttgtattygttttttgggaaggatttttttaaattttggttattttttgtttgttagtttgttttttggtagygaagttttagtagtttatt

SEQ ID NO: 3448 - DNA, 707 bp, synthetic construct
  misc_feature 1..707: note = Description of Artificial Sequence: Synthetic polynucleotide
  source 1..707: mol_type = other DNA
gyggtggygtyggyggttgtagggggaygagttagygtygyggygttgggagttagttgagttyggtyggygagyggaggyggtagygtaggtagagyggyggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgygttttggattttggagatgttaattttagttyggatatttgggttgtgttattyggattattygggtygtatagagtatgygtgattttttttatttttt

SEQ ID NO: 3449 - DNA, 201 bp, synthetic construct
  misc_feature 1..201: note = Description of Artificial Sequence: Synthetic polynucleotide
  source 1..201: mol_type = other DNA
ggatttaggattttgtgttygygtttttggagtygttggagttyggatttttgtaattgttggtattttgggggtttggtttagygttttgttgtttattygttttttttygttgtttyggaattaaagttttyggtttttttygttttygygygtttatttatygtygtyggggagyggttyggttygtatttagtatta

SEQ ID NO: 3450 - DNA, 201 bp, synthetic construct
  misc_feature 1..201: note = Description of Artificial Sequence: Synthetic polynucleotide
  source 1..201: mol_type = other DNA
taggtttygygtttgattttttagtttgygtagygggtattyggtygggaagaatttttttagtaggyggtttagtattaygtttaygygttygygttygygttygygttygtggtygygygggttttagttttaygtagygtttatagatygtgagttygtagggtagtgttatyggtttgtgtagtagtttygggtagt

SEQ ID NO: 3451 - DNA, 201 bp, synthetic construct
  misc_feature 1..201: note = Description of Artificial Sequence: Synthetic polynucleotide
  source 1..201: mol_type = other DNA
tattgggatttttatataygagttggtatatattagttatatayggttaattttagagggttggttttttgttttgggaygtttttaggttttygggtygyggtgyggagaatttaggtgggtgttyggtaagttatttattaggggttgttttttygygattttygttataagygtagggattygggggtygygttggtt

SEQ ID NO: 3452 - DNA, 201 bp, synthetic construct
  misc_feature 1..201: note = Description of Artificial Sequence: Synthetic polynucleotide
  source 1..201: mol_type = other DNA
gaaaattgtaaaatttgggagttattttgttttatttttttgttgtttggggatatttttygygagtttgttyggtttygaagaaggagtagaggggattygtaatttagtttttagagtttygttaggaaaggygygagagatttattggtttyggtaattttgtttyggygttyggayggagttygatgtttgygtagt

SEQ ID NO: 3453 - DNA, 203 bp, synthetic construct
  misc_feature 1..203: note = Description of Artificial Sequence: Synthetic polynucleotide
  source 1..203: mol_type = other DNA
agtttagagtgygtygagtatygtttyggtaggtggaggggttgygggaaataaaataatttgggtaggaatttgattggtagtaggtttatttttggttygyggtagggaatttaatggagatgaagaatggtggggaagggggggyggtgtttttttgggagtttaaygtaygtttttttattttgttattttttggagat

SEQ ID NO: 3454 - DNA, 201 bp, synthetic construct
  misc_feature 1..201: note = Description of Artificial Sequence: Synthetic polynucleotide
  source 1..201: mol_type = other DNA
ygygygttttttygygygtttttyggattygygtttgtttattttttyggttttgttgyggtygaggttttaagtyggttatttygtgtttaggtaatygygggggyggyggyggyggygtgaggagygggyggttgttgtttyggggttttttggttygagtttttagttttygattttyggygtttyggygttygatta

SEQ ID NO: 3455 - DNA, 201 bp, synthetic construct
  misc_feature 1..201: note = Description of Artificial Sequence: Synthetic polynucleotide
  source 1..201: mol_type = other DNA
gggtttttagtttggtttttaggygyggtggyggyggtgggataygygttaggygtttagagaaggatatgggataatggtttagttygaggaygttagaygtygtygttygattyggggaaggaagtttttgtagtyggttygggaattygaggyggggagggaggttagttttggaggtgygttgtygttttaaaataa

SEQ ID NO: 3456 - DNA, 208 bp, synthetic construct
  misc_feature 1..208: note = Description of Artificial Sequence: Synthetic polynucleotide
  source 1..208: mol_type = other DNA
gygtygygtygtygttyggtttttygaagtygttttttgtyggygygtyggtygtttgygttayggygggygttatttatttygggtagagttttttgttygtgtagygygttttgggtttttagygttgatttaygttygtagtaggtgaggaaggygtagtttggggaggaaagtaagygttaagaagggttagtggggygttttc

SEQ ID NO: 3457 - DNA, 201 bp, synthetic construct
  misc_feature 1..201: note = Description of Artificial Sequence: Synthetic polynucleotide
  source 1..201: mol_type = other DNA
gtaggggggttttatttattaagttatgttttattagggygttaggygggygaagtaaaggtagggatggygggyggggyggyggyggaggtggaatgggygttttttttttttatttggttttatttatttatttagattagaaaagygagtyggtttggagggagttygttyggggattygagygygtatttattagtg

SEQ ID NO: 3458 - DNA, 201 bp, synthetic construct
  misc_feature 1..201: note = Description of Artificial Sequence: Synthetic polynucleotide
  source 1..201: mol_type = other DNA
gygtttygtttttygtttyggyggttttygtagtttygtygtygttygygttygygttttggagtygygttataaagggttygygygtagtygtygtygtygtygtygtgygaggagttaggatggttttggtttaygtyggttatttygtgtttttagtgtttggttttgtgygaaatagaggtatygtttttttttttc

SEQ ID NO: 3459 - DNA, 595 bp, synthetic construct
  misc_feature 1..595: note = Description of Artificial Sequence: Synthetic polynucleotide
  source 1..595: mol_type = other DNA
aggaggttaggaaagtttattatatgygttggtttyggttgtygtayggtatttttatggttatygggatgatgagygtatttattttgggttygtggattgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttygttygggggggagggggatggagtgygygggtagtttttttttttyggttygygtttygttygtttygggttgygttggtttygagygtygagagttagg

SEQ ID NO: 3460 - DNA, 201 bp, synthetic construct
  misc_feature 1..201: note = Description of Artificial Sequence: Synthetic polynucleotide
  source 1..201: mol_type = other DNA
tatygtyggygtygaggyggygtttatgtttaatygtygtygttatygtygtygtttgtttttgygttygttttygygtttgttgttttttygtygtygtygtygtygtygttattatagattygtagatatatagttaagatttttgatttttaatattaatttttttttttggggaggggaggggayggagggaagggg

SEQ ID NO: 3461 - DNA, 269 bp, synthetic construct
  misc_feature 1..269: note = Description of Artificial Sequence: Synthetic polynucleotide
  source 1..269: mol_type = other DNA
ggtgtgatgttttyggtggataatgtttttygttttttgtttyggggtttagatagttggtgtttaagygtttataatgtagagttttttgtatttttttygggtygttatttgtttatttgttttatttaggatatttttttaaataatttttaagtggaaaaattayggttttttaggagatttattygggaaygaaygtgygtggggtagtttaaatttttgagtttagatttygtttttygyggttagatggtgyggtyggtggg

SEQ ID NO: 3462 - DNA, 201 bp, synthetic construct
  misc_feature 1..201: note = Description of Artificial Sequence: Synthetic polynucleotide
  source 1..201: mol_type = other DNA
ttagtttgttatygtayggyggtygggatygtagtttttgggtgygtagtgygtttttygttgygtttttttagagygygggtttygtgtttgtgttyggygygaygygatttttttgttagtygggtttygygtgtttttygygtttttygtagttttygygtagttygtagygttttttagtttygtttygyggtygyg

SEQ ID NO: 3463 - DNA, 267 bp, synthetic construct
  misc_feature 1..267: note = Description of Artificial Sequence: Synthetic polynucleotide
  source 1..267: mol_type = other DNA
gtaggagtttyggyggtttgtaggggyggtggygyggygttgggygygyggtygttagatggtagygtagtttyggttyggttygygggaggyggttaygygygggggaygyggggygyggygygttgagygygggtgtygaggttggagggygyggtygggttttygagtttttttttygyggtatttttgtttttatttttaaatgttttgtaagttaggagttttygtaggaatygttgtatttttatttttttttaaatttta

SEQ ID NO: 3464 - DNA, 287 bp, synthetic construct
  misc_feature 1..287: note = Description of Artificial Sequence: Synthetic polynucleotide
  source 1..287: mol_type = other DNA
ggyggtgtgtagagtggggtttgggttttttgtttttaagggtagttgggtgggtttygtgtttttttygagtggatttggtttyggttttaaatttagtygagggtyggttygtttttggggattygyggatgtygygagggggygtygygttattgaaggttgggaygggggyggtgygyggggyggygtyggagttygggatgtyggttttagagaygtygygtttygtttygaggaggtygtyggtygggtaagyggagttyggagttygyggagtttggatc

SEQ ID NO: 3465 - DNA, 201 bp, synthetic construct
  misc_feature 1..201: note = Description of Artificial Sequence: Synthetic polynucleotide
  source 1..201: mol_type = other DNA
ggtttgtttygagygyggygggggygtygggggygtyggtttttattttgtagggtatyggyggygggaggaggggtyggygtttaygggttttygttttygyggygtygyggattaggagttggaattgttgygggagtgtttgggagtygtygtgtttgttyggttgygtaaggtggttttygygttggtgttaggtyg

SEQ ID NO: 3466 - DNA, 201 bp, synthetic construct
  misc_feature 1..201: note = Description of Artificial Sequence: Synthetic polynucleotide
  source 1..201: mol_type = other DNA
gygtttgttygygttttgtttaggtggtttyggyggtttyggygattttttgygagygttgttgtttttgaaggygttgtagggtttgygygtggagtggygygggygggattygygygggtygggtygggtatagygtagygygggggttatygtygtygaygggtygtgygygttgygygagtttagygtagattttyg

SEQ ID NO: 3467 - DNA, 286 bp, synthetic construct
  misc_feature 1..286: note = Description of Artificial Sequence: Synthetic polynucleotide
  source 1..286: mol_type = other DNA
tttagggggygttttygagtygygtttygygttygtttttaggagggttttygygagtyggttgtatatttygaggyggtttyggttgtataatttggagygagttgtttygtttttttattttgggggygaagaagggtyggggagtgggggaaagygggaggygtygyggtttgggaggttttygygggttttagygtyggtygtattgyggtttttttygygygtygtygtygtygtyggttttttttygtttygttttygyggttttyggygtttttygygc

SEQ ID NO: 3468 - DNA, 244 bp, synthetic construct
  misc_feature 1..244: note = Description of Artificial Sequence: Synthetic polynucleotide
  source 1..244: mol_type = other DNA
tagtagattttggygtggggtatttgagattttygttattgaaaaggygttatagaaatgtaaggaattatgattttaataaaattgttttatttaggagygagtttttgygttgtttttgtygtyggagttygggtttgttayggtaaagtttgtaattagagaaaaatattagttttgttgagggttagaatatattattggttaatgtgtgtggttttttttttaaataatgttaagtatt

SEQ ID NO: 3469 - DNA, 201 bp, synthetic construct
  misc_feature 1..201: note = Description of Artificial Sequence: Synthetic polynucleotide
  source 1..201: mol_type = other DNA
gtgggtyggggatttygttgttttgtttttttagygggaaattgattgtttgagttttggaggataaatagagatattggggggttaaygggggyggtygygggyggggttttaggtttttatttatygggttgttgagygygtaygtagttattygagggaagattttygtygttyggggtttyggagaggggttagaat

SEQ ID NO: 3470 - DNA, 372 bp, synthetic construct
  misc_feature 1..372: note = Description of Artificial Sequence: Synthetic polynucleotide
  source 1..372: mol_type = other DNA
gtggtattagygaatgtggtggatttyggtaggtttggggtaggggaattttyggtaatattttttagtatygaaggtaggatttttyggttattttygtyggttggaatttttttaagtattgttttgagtttatttttaaatgaaagggggaaaaatttaaattagattagaatttgaaatagttgaaatagttatygatttttagtttgtttttaagtttggtagagattgtgaaagttttaattttttygygatgttagttayggttygyggyggttayggagttattttagtatttygygatggatagtgattttyggygtggygygagttttttgyggtttttaygygggtttgggyggygggttt

SEQ ID NO: 3471 - DNA, 201 bp, synthetic construct
  misc_feature 1..201: note = Description of Artificial Sequence: Synthetic polynucleotide
  source 1..201: mol_type = other DNA
agttagttttataatttgygatygatttttttttgtttagttyggttttagttttttttagttataagatggtaatagygtygatagtygggtttygyggygttttgttttttttttgttttggtttggagttttttttgggtagttttgtatttatagygttgygttttttttagattgtgtagggagtaygggagggtt

SEQ ID NO: 3472 - DNA, 247 bp, synthetic construct
  misc_feature 1..247: note = Description of Artificial Sequence: Synthetic polynucleotide
  source 1..247: mol_type = other DNA
gttttyggggggttttggygttttagttgtggattttttaatattygtaggttatagagttatagaggttggatttttagtagtagaggatatagaagaaygaagaygagaygtagagttttaattgtagttagagataaaggtttygttatatttyggaagtygttttgtttttttttgtttygtgtttgattggayggtttttagtttagygtttttgattggataatttttaaggttttgtttt

SEQ ID NO: 3473 - DNA, 201 bp, synthetic construct
  misc_feature 1..201: note = Description of Artificial Sequence: Synthetic polynucleotide
  source 1..201: mol_type = other DNA
gatttggygyggtttttgtttttygttgtygtygaagttttaattttygtttgtttgttttgtgttttttgtaygtagaagtttagtttgtgtggttttgygatttgygggtattgggagatttatagttaagaygttagggttttttggaagtttagaaatggtgagagtgtyggttygatatttygagagagggaaygg

SEQ ID NO: 3474 - DNA, 201 bp, synthetic construct
  misc_feature 1..201: note = Description of Artificial Sequence: Synthetic polynucleotide
  source 1..201: mol_type = other DNA
ggygttttagttgtggattttttaatgtttgtaggttagagggttatagaggttgggtttttaagagtaggggatataaagtagggaagaygagattaagygttttagttgtagygagagataaaggtttygttaaatttyggaagtygttttgttygttttagttgygtgtttgattggayggtttttagtttagggttt

SEQ ID NO: 3475 - DNA, 235 bp, synthetic construct
  misc_feature 1..235: note = Description of Artificial Sequence: Synthetic polynucleotide
  source 1..235: mol_type = other DNA
tttggtyggattgygygtttagggtttttygygtttgttagttttygttttgygggtattttttttagtatygggagygygyggttgttygttttygtygygatygtggygttagtttttygttttttttgtttygttttgagtatttgttttgygtttttygttgtaattttttatttttygtttggattgygggtttgggtgyggggtgttgtaggtttgtaggggayggggt

SEQ ID NO: 3476 - DNA, 201 bp, synthetic construct
  misc_feature 1..201: note = Description of Artificial Sequence: Synthetic polynucleotide
  source 1..201: mol_type = other DNA
atttygygttttttagttyggagtttatttgtataattggattttttttttttgtttttttttttttttttgaaatttgtttgaaaatttaagtgaaaatygygaygatttgtatatttaaaagtaagtgttaagtaagtgttttgyggtggtttyggygygtttyggggtgagygygtaaagtygggagygaggtgtygc

SEQ ID NO: 3477 - DNA, 201 bp, synthetic construct
  misc_feature 1..201: note = Description of Artificial Sequence: Synthetic polynucleotide
  source 1..201: mol_type = other DNA
gggygyggttttgggagygggggaaggtgaggggaaatgggatatgatggtattaataatygttattaaagayggtgggagtaataaaggaatgygttttygagaygtygtttagtttyggggtgttttttggygyggtygyggtgtaggaaygygagtttygtygtygagtttttygtygtttgygttygttggygyggc

SEQ ID NO: 3478 - DNA, 201 bp, synthetic construct
  misc_feature 1..201: note = Description of Artificial Sequence: Synthetic polynucleotide
  source 1..201: mol_type = other DNA
gttygggygygtyggttggggttttggygttttygtaggtttygaggtygatagtttyggygagggygggygtttygygttttagtatyggttgtttgagygtttttggagtagtaaattttagatttttttttttttttttttttttttttttttttttttttttatttttttttttttttagttttttttttttttttt

SEQ ID NO: 3479 - DNA, 201 bp, synthetic construct
  misc_feature 1..201: note = Description of Artificial Sequence: Synthetic polynucleotide
  source 1..201: mol_type = other DNA
tttgttttaaaagtttatagtatgttttttttttttttagatygggagatagtgattttatttatayggtaagattaaaagttttygttygtttagtttgygggtttgggttgggtttagaygttttttaggatgtagatgygtygtygttggttttttyggttataaagtygtttttagygttttttygygygtaggagc

SEQ ID NO: 3480 - DNA, 201 bp, synthetic construct
  misc_feature 1..201: note = Description of Artificial Sequence: Synthetic polynucleotide
  source 1..201: mol_type = other DNA
gggygaagygatttagygygaggattagtttttaattaattygtttttagttttgggygttttttttagtagttagatgggggttttagaggtyggtgygyggttatatggtttygggttaggtagggggtygtggggaygtatttgygttaggygtatagtatttttgggygygggaygggygaagygtygtgggtttta

SEQ ID NO: 3481 - DNA, 296 bp, synthetic construct
  misc_feature 1..296: note = Description of Artificial Sequence: Synthetic polynucleotide
  source 1..296: mol_type = other DNA
tgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygg

SEQ ID NO: 3482 - DNA, 201 bp, synthetic construct
  misc_feature 1..201: note = Description of Artificial Sequence: Synthetic polynucleotide
  source 1..201: mol_type = other DNA
agtttaygggttagtttggyggggttygayggyggyggyggtggyggtagygttygatttagyggtattagtttgggttaygattagygttayggtagttygygtttyggtygttyggattygygtttyggtttygggtygttttyggtgggtagygttygttttagygtttttagtttyggttttyggggttyggtyggc

SEQ ID NO: 3483 - DNA, 201 bp, synthetic construct
  misc_feature 1..201: note = Description of Artificial Sequence: Synthetic polynucleotide
  source 1..201: mol_type = other DNA
atttattggttgaaagtttygtttattttagggtgattgagagygttttttttttttgtgttgtttggaaayggattgttygtttagtaatatttgattaygttttttattggttatygttttyggaagttygttttttygttttyggaattttygtaggygttgggtttgtagatggygtttaggtatatagtggygagt

SEQ ID NO: 3484 - DNA, 266 bp, synthetic construct
  misc_feature 1..266: note = Description of Artificial Sequence: Synthetic polynucleotide
  source 1..266: mol_type = other DNA
gaaagataaaagggaaagygtttttaygaaattygtttayggataygatttyggggttatatttagttagaygaatgtttggtaaatgatagttattttaygttagatttttatagttttttataygttatttttattgttttagggaattataagtataggtatygtttygttyggygtttttttttaaagattggggtattaggatygygggtttttatttttatttagtataaagagttyggygtttagagttagyggttttt

SEQ ID NO: 3485 - DNA, 201 bp, synthetic construct
  misc_feature 1..201: note = Description of Artificial Sequence: Synthetic polynucleotide
  source 1..201: mol_type = other DNA
tygtaggttatttgtgtgatttyggtgygagtggaggttggtatygtttagtgygaggttgttatttygtgtgtttgtttaygttttgtgtgattgggtgygaggaagttaatggtatygtggaatgtgaggttgtgagttgaggygggagygggygattgttygttgtattttgttgggtygatattygyggtttttttg

SEQ ID NO: 3486 - DNA, 228 bp, synthetic construct
  misc_feature 1..228: note = Description of Artificial Sequence: Synthetic polynucleotide
  source 1..228: mol_type = other DNA
tagagtttaggatattttaggttttttttgattygattggaatttattttttaygtttttttggttttaattaatygttatttgtatgtataaatggaaaygatagggtagagggttagtagttattygygtttgggttygtagtttygggtaygttgtagtttygtattyggttgtttaygttygggattatttattgtgttttttyggaattgtttagygtgtttt

SEQ ID NO: 3487 - DNA, 248 bp, synthetic construct
  misc_feature 1..248: note = Description of Artificial Sequence: Synthetic polynucleotide
  source 1..248: mol_type = other DNA
agattttagatatttattttaaatttaggttttagygttttgtaggggatttttattttggggygtttatttttgattttttttttgggttttttygttayggtygagtttaagtggttgaagygyggaygaggatgygyggggtttyggtttttaattgtattataggtygtatttaygaatttggttyggtatagttattatygttygggtttttaggttttagggttgtagaagtttagtttygg

SEQ ID NO: 3488 - DNA, 387 bp, synthetic construct
  misc_feature 1..387: note = Description of Artificial Sequence: Synthetic polynucleotide
  source 1..387: mol_type = other DNA
gaggyggttatygtagyggtygttaaygagtagttgtayggaggtgtagaagaaggaggttattgttatttttttgataagttgggggygtgggaggtttygggagttygaagtygtttygagygggggtgggyggtgagyggattttygggtgttgattaggtgtttggtggtagagtagggaaggggggaayggaygtygattttagggattttttattygtttaygttttttggygttggttataygtygtygttttagtattaattggaggtttttagtggaygagtagtygttygagggtagtygtttgagtyggtagatagyggttagttggggtagyggttygaattgttttygtaataygttttttagtatttyggttt

SEQ ID NO: 3489 - DNA, 203 bp, synthetic construct
  misc_feature 1..203: note = Description of Artificial Sequence: Synthetic polynucleotide
  source 1..203: mol_type = other DNA
ygttgtttttttgtgygttatygggggtttgttttgggtttgttygatatygtggttgttygtttatttgagygtaggtttttattttgtgttagggtygygygtggttttygtttgyggtttgttgggtttyggygttataggtattgyggtttyggygttygtaygygggggattgggygggggttggagagtttaggtyg

SEQ ID NO: 3490 - DNA, 203 bp, synthetic construct
  misc_feature 1..203: note = Description of Artificial Sequence: Synthetic polynucleotide
  source 1..203: mol_type = other DNA
gttgygtttygttgtttagttygggyggtttatygttttttttgtttgggtggaygtatttttgtttttygtttttattggyggtagttttygtggggygygygtggggggygttggggtttttagttttygtttygagttttttgtygyggygttgttagtttygggggtttgggttttatttygttttggttttgttygta

SEQ ID NO: 3491 - DNA, 312 bp, synthetic construct
  misc_feature 1..312: note = Description of Artificial Sequence: Synthetic polynucleotide
  source 1..312: mol_type = other DNA
gtygggggggygttyggggyggyggyggtggyggygggygggggtaggtygggttgygaatatatttygaagttgtygtygtagtagagggttatgtyggyggtygtgggyggttgyggygyggtygyggygaggggygagyggggttggtttygtygttygggygagagtatttttttgggggttaattttgyggtttygtttttattygygttgggygttyggtgtttygggtyggggtygggygggtgttagyggagygtttgttagtyggttttttataatygagttyggygyggttttttttgggtc

SEQ ID NO: 3492 - DNA, 407 bp, synthetic construct
  misc_feature 1..407: note = Description of Artificial Sequence: Synthetic polynucleotide
  source 1..407: mol_type = other DNA
tttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygaga

SEQ ID NO: 3493 - DNA, 295 bp, synthetic construct
  misc_feature 1..295: note = Description of Artificial Sequence: Synthetic polynucleotide
  source 1..295: mol_type = other DNA
gygttygtttygygygtttttgtatttttygygtygtttttyggggtttygyggygttygtaggtygygtygttttgtygtttttttttygtggtttttayggttygttygttttttagtagttttggggtgttyggggyggttttgtaagygggagagagyggygaggyggyggygtygagtgyggggggatgyggagtygtgttyggttttgtygtatttttyggtygttygttygygttyggtttygttyggttttgttygggttgtaygtatttttttygyggtttagaat

SEQ ID NO: 3494 - DNA, 435 bp, synthetic construct
  misc_feature 1..435: note = Description of Artificial Sequence: Synthetic polynucleotide
  source 1..435: mol_type = other DNA
tttggttyggtttggttagttttygyggtttttgttygggttgaygtttaggaatgtggtygaygagaagttttaatagtayggygtggttttttagtttyggtgagtattygtygtggggaagggttttggggatttattggaggtygyggttygtagtagttaggggtygagttayggttayggaygttttggtgtttyggttygtgtygggtttttaggyggaggaggygttygttgggtttagattttygattttagtttyggtttttyggygtttgggttgygyggagtttttgtttygygtttyggatttttaygygtagtttttaygygtttygagttggagaagtygttagttygtttttttagggygtgtygttygttttttgtttttttgtgyggggtatgtgaaatgtgtggggttagaattgt

SEQ ID NO: 3495 - DNA, 410 bp, synthetic construct
  misc_feature 1..410: note = Description of Artificial Sequence: Synthetic polynucleotide
  source 1..410: mol_type = other DNA
tttttggagggaagttygtygggaagttgaagatagtggttatygttttyggttattatttttygggattyggattttaattttgygttatatttttattygtttttagtygtgttttggttgygtagttggaaaggttgagtagtttattgttgtttttttgttyggttttggatatatygtttgaatttttgggygtttttgttgttaagtgggggatagtattatttattggggaggaaaattttaggaatgtggattttggggttaygtaggggttgggaagtgaagggtagggaaygygggyggygttyggggtttgygggtaggtaggyggtttggtygyggaggttttttygagttttgygtttttttagagagggaggggtttatatyggttggtatagtta

SEQ ID NO: 3496 - DNA, 392 bp, synthetic construct
  misc_feature 1..392: note = Description of Artificial Sequence: Synthetic polynucleotide
  source 1..392: mol_type = other DNA
ggagttygttgggygtgttyggttyggttyggtttygtygtaygttygtttttttggtttggttgaggatttyggggtttggaygtgttaaygttattttygygygtygaagttgtgayggtttattaagtagagatttgygaggtatatagagagggaatgaggyggaatygttygggggttygttgatattgtagagtttttygtagtatygttgttttaaatttygtttttttaggygtgygygtatagygagttagaggaggtttygtttygatttggggtttttygyggtttttagttygggggttygggttttygaagagatttttggtaatggtagaggttttaaagtttagatgttaagtttygygatggggyggatgttttta

SEQ ID NO: 3497 - DNA, 203 bp, synthetic construct
  misc_feature 1..203: note = Description of Artificial Sequence: Synthetic polynucleotide
  source 1..203: mol_type = other DNA
agagaagaygttaggttgaggttttagygattttaggtattagtttygaaggagggyggggagatygtaaaggggaagtgttyggagggttaayggttttygygtattttgygtttttttgaagygygtygttttttygygtyggggattgggatttgtttttggggaattygtttagaagayggyggyggattggggtyggg

SEQ ID NO: 3498 - DNA, 398 bp, synthetic construct
  misc_feature 1..398: note = Description of Artificial Sequence: Synthetic polynucleotide
  source 1..398: mol_type = other DNA
aaaattgygggagtttatttattgygtttaggtggttagtttttgagttttttttattygtggttttttgtyggtatgtaggtatgtataagtatatygtygagtaggaggatttaaygaatttagtttgtggatatgttttaatttttattttygttttttttaggtttgtttaggtgaggatgatgggagggaaaagyggtgtatagtygtaatattggtattttgtaagagtygtyggggtattgatatagagggatatygtattggagatgyggtgtttayggagatttattgygygyggtgaaatattttaagtatygygyggaataattgggtttagtttttttatttyggattttttttaggattataygttattttttattttygaattt

SEQ ID NO: 3499 - DNA, 286 bp, synthetic construct
  misc_feature 1..286: note = Description of Artificial Sequence: Synthetic polynucleotide
  source 1..286: mol_type = other DNA
tgtagagtttgaattttatygtttagaaggaaaggtgagtgggggattygggygggaggtgaggtttgtyggtagyggtttttaggygtgttgggtagtayggttagtagaggyggygtttggttttggatgttgtagyggagaygttaaggagattgaatgtagggagygaggygtagyggtygyggagggtggggtygttyggaaatttaggyggygttagttttgtagtatttgtaggtygggggygygtataygaggggtaygtgggtgtggaggaatyggc

SEQ ID NO: 3500 - DNA, 267 bp, synthetic construct
  misc_feature 1..267: note = Description of Artificial Sequence: Synthetic polynucleotide
  source 1..267: mol_type = other DNA
ggttgttaaggaggyggggtggttagygyggggggtggaggatgggggtaggaygygggagggaagggtagggggtggggggygaggtttyggggattagygygygagagtgtttagttgggaaatgtagtttygaattaatatygtatgttttataattagtttaygagtygatgtggggaaagttatttttagatggggaagagtagttyggatttttttaaggaygttttttagttagattagggaggggagaaggagatgggg

SEQ ID NO: 3501 - DNA, 260 bp, synthetic construct
  misc_feature 1..260: note = Description of Artificial Sequence: Synthetic polynucleotide
  source 1..260: mol_type = other DNA
tagagtygtttgtatttgttygtattttttgggaggttgygatgatygtagttagggtggtygagygttyggtttattgtattyggyggttgttttgtagygtttttggtatttagggaatggtttgtaaattttaatgtattatagattagtttttatygtggagtaggaaaggygtttattagttaggggtaatyggttttgtagatttgggygggggygtagggggaggggyggtggtgtaaatttatygtgatttt

SEQ ID NO: 3502 - DNA, 239 bp, synthetic construct
  misc_feature 1..239: note = Description of Artificial Sequence: Synthetic polynucleotide
  source 1..239: mol_type = other DNA
gaaggtaagttttaaatttttgtttggaagaygggttgtygyggttgtattattagtaggaggaggaggagaagaaattatttygygatattttattttgygggtgttttgtygttgtygtttttgttgtygtygattygagttygygggttygaatatygtagyggtggggayggtgggttyggygggygtygggaggaggatattagyggagttttgtattttygtgtttygtttat

SEQ ID NO: 3503 - DNA, 846 bp, synthetic construct
  misc_feature 1..846: note = Description of Artificial Sequence: Synthetic polynucleotide
  source 1..846: mol_type = other DNA
gttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatt

SEQ ID NO: 3504 - DNA, 526 bp, synthetic construct
  misc_feature 1..526: note = Description of Artificial Sequence: Synthetic polynucleotide
  source 1..526: mol_type = other DNA
tgttgttttttttyggygttttgtttttttataattggaagtygygaaggyggttattgygttgagtygttygttttgttggttaagtttgggygattygygyggaggagggtygggttgattgtygtygttgagttgttttyggaygggagygtttgtttayggtatttattttttttagyggtggaaatgtggagaagtaagtgggaggyggtgtygggaattgattttttttaaaayggtyggygtygttgttttgaaatgggyggttaagtgtttgtgggattaagggyggttttagagatgttyggaaaatygttgttayggttagagtgyggygtagaygyggtagagttggaggtgttygyggtgtaggttgttgtttaygtygtttaggttaggtgttgagggtttagttygygtttyggtygaattatttttagtttygttgagttatttygttygttyggtttttatygtatyggttagaggaaagttttygyggtttttaygtttttttatagtt

SEQ ID NO: 3505 - DNA, 201 bp, synthetic construct
  misc_feature 1..201: note = Description of Artificial Sequence: Synthetic polynucleotide
  source 1..201: mol_type = other DNA
gtttygttyggggatttagggaggagggagagaggagggagggagtgggtagtttgggygtaygttatyggttttygtaygttyggtatttttygtggygyggygagttaatgggatttgtatattygaggtgtaatagtattattgtattaattattatttttattttaygtttagattgtttatttatttgygggaaat

SEQ ID NO: 3506 - DNA, 523 bp, synthetic construct
  misc_feature 1..523: note = Description of Artificial Sequence: Synthetic polynucleotide
  source 1..523: mol_type = other DNA
tgttttgtaygygtgtgtayggttygtaygaggyggtygggttygttagttttttgattatagyggtygygttagggttatyggggttygyggttgtagtygtagttgttgtagtygttgyggttgtygttatttggtaggaggtatagggtatgggtgagggaggttgyggtagyggttaygagttgttgaggaagttagattgtaggtatttggggggygttaggtagtygtagtygtyggtttyggygttygttaygtygtattygtttgyggygttttyggtttygaagagttttttgtygggttggaagtgygygggyggyggtyggaagggtttttttatgyggyggyggygtyggtagttgtttttttygaatatgttttygtaggtygggtttagygtttagtagttgtttttgygttygtygtygttttygygyggtattttgatgaagtattygttgaggttgaggttgtggyggatgttattttgttagttttttttatttttttygtagaa

SEQ ID NO: 3507 - DNA, 276 bp, synthetic construct
  misc_feature 1..276: note = Description of Artificial Sequence: Synthetic polynucleotide
  source 1..276: mol_type = other DNA
gttattttttttttttygtgaygttaygggtygtttyggggtgagygtttgagtygtttygggttygygttagtgagygyggttgttgtyggygagttagyggygtagyggygggaattygaggtygagygtygyggyggtagygttagaagygtatttatygggtayggygaggyggtttayggtgyggtaggtatygggaggygagagtyggygyggatagtaggyggyggttgtagttygttggyggttgttgygaggatgttgtttgggygg

SEQ ID NO: 3508 - DNA, 357 bp, synthetic construct
  misc_feature 1..357: note = Description of Artificial Sequence: Synthetic polynucleotide
  source 1..357: mol_type = other DNA
aggagggaggtagggtaggtttgagggtgaaagyggtaaggatttaggtttaagttggatttgtttatttttttttgtygtagtttttttggtttttgtgygttttggattttygaagttagttttttgygtagyggattagagaggtttattygyggaygttaatttaatttttgggyggggttygggggttgagtagaaggygaggtttggggagtayggataattttgagggttgtttgtgtyggggtgggagygtagtgggtgagtttygagttttggtttagggayggttagagtagggygttggygygtygtggggataagtaggtgtttgtttttgtttgggggaaggat

SEQ ID NO: 3509 - DNA, 278 bp, synthetic construct
  misc_feature 1..278: note = Description of Artificial Sequence: Synthetic polynucleotide
  source 1..278: mol_type = other DNA
tygggygttgggtagttttygtyggtygtygtyggagtttttgtgtttaygtygggggygtygttgtaggtttaggagaagattygtgttttygagtagtygtttttaaaaattaaataaattaataagagaattaattaataggtagygttgygatygttaggagygyggagygygygaggtttagyggttttttygttaagtttttgttatyggygygyggtygttygygttgyggtagyggyggyggygyggttgattgyggyggtagygyggta

SEQ ID NO: 3510 - DNA, 336 bp, synthetic construct
  misc_feature 1..336: note = Description of Artificial Sequence: Synthetic polynucleotide
  source 1..336: mol_type = other DNA
gtttygtatgtggggtataatgaaataagagtagtttyggttagaggtttagtaaagyggaaagayggtttygttygtatattttttyggaaaattgaagygttttttttgatttttaaggttagaaagatttattatttttttygagagggygtagttatagatttattagagagggygggtagggtgtyggaagttagagaayggygtttygygtttttttatygttttagggygtagaggtgtttttagtgttyggagaggttggtagtgtyggtttygagggaagygtggagyggayggtygataggggatttttgtttaaattttattatt

SEQ ID NO: 3511 - DNA, 311 bp, synthetic construct
  misc_feature 1..311: note = Description of Artificial Sequence: Synthetic polynucleotide
  source 1..311: mol_type = other DNA
ygygtgttttgttttygtagtggtttyggygtttaggaygtygttggttygygttttttttyggaatgaaggtgtttygtaggaaggygttggtgttgtgygygggttatgtattgttgttggtgtttattatgtttaattttttggattataagtggtataaggagtygttgtagtagtgtaatttygatgggtygttgggtgtygtagygggggtagtyggaggtagttgggggygtttagggtygttttyggtygggtygtttygtgtttatgttygtttggattttygtattttttatygttttttc

SEQ ID NO: 3512 - DNA, 201 bp, synthetic construct
  misc_feature 1..201: note = Description of Artificial Sequence: Synthetic polynucleotide
  source 1..201: mol_type = other DNA
tataggtaatagagataaggttaggaggtaaagtatatttatgtgtaaatgagaygygttagggaatttgtaattttttgtattttygtttttgatgtttygatttttataattatagaattttaggtagaggtygtygattttttygttttygttaagagggattyggagtatygaagttttttagtyggtgtyggygtt

SEQ ID NO: 3513 - DNA, 201 bp, synthetic construct
  misc_feature 1..201: note = Description of Artificial Sequence: Synthetic polynucleotide
  source 1..201: mol_type = other DNA
aaaygtttttttagaaaataagttattaatygtaygagagaaggagaggaaggtagtaatttaattttttgyggttygyggttttgaagattaggaggttygttttagtagggtgaggtttatagaatgtatygygtyggttgyggttttttaggggtyggttattygagttttggaatttygagaggygygaagtgggag

SEQ ID NO: 3514 - DNA, 481 bp, synthetic construct
  misc_feature 1..481: note = Description of Artificial Sequence: Synthetic polynucleotide
  source 1..481: mol_type = other DNA
ygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtygtygttygttgggtttttaggggtttgaaygtttaggggtygyggygagtttattyggagygagttaggtgagtaggtygttatggygatgyggtttygg

SEQ ID NO: 3515 - DNA, 280 bp, synthetic construct
  misc_feature 1..280: note = Description of Artificial Sequence: Synthetic polynucleotide
  source 1..280: mol_type = other DNA
taggttttttggggttatttygygaggtagtygagggygtaattygggygtttggggtyggaggyggaattaggggtyggggttaggaggtaggtgtaggyggttgttaattygtttaatttgttgygygggtggtygtttagagtygygggtttgyggggygtttttygtygtygygtygtygtttttttaggttygggagggggygtttagggtggagttttatttatgggttgaggttttgggygygyggagtygtygtygttttttyggttggttt

SEQ ID NO: 3516 - DNA, 252 bp, synthetic construct
  misc_feature 1..252: note = Description of Artificial Sequence: Synthetic polynucleotide
  source 1..252: mol_type = other DNA
yggagttttagttaygaattatttaatattygtaggttatagagygayggaggttgaggttgtgatygaattatygaygtttttttgaggggtgaaagtayggtygtggagattttaatygagtttaygttggygtaaaaggtaaaagtygygttagatttyggatgtygttttttttttttyggttgygygtttgattgggtagtttttaatttagygttttgattggataagatattaagttttttaygt

SEQ ID NO: 3517 - DNA, 239 bp, synthetic construct
  misc_feature 1..239: note = Description of Artificial Sequence: Synthetic polynucleotide
  source 1..239: mol_type = other DNA
ttatttgygtgttgttttygggtttygtttygtttygtttyggagggatttttaggtygggtttagatttaggagttatttggggatttyggggtggttgygygtygagggggygttagyggggaygtgagttggygtygagatagtttyggttttttagygttagggttattgttaggagattttyggttagtatttaygtggggygttttygggagttygaggggtttatygtttgt

SEQ ID NO: 3518 - DNA, 405 bp, synthetic construct
  misc_feature 1..405: note = Description of Artificial Sequence: Synthetic polynucleotide
  source 1..405: mol_type = other DNA
aagtttgyggagygggtygygtttttggttygttygggttttaagtttygygtygtygttttggyggggayggtgtagtaggyggygggatgyggyggggyggtagtttgagygtttyggatggttygyggyggggyggtttgtaagagygaygygyggttgttgttggggygggaygygttgyggtyggygttygttttgttggttttygtygtgttgttgggygtygygttyggtttyggtttyggtttttggtttggttgtygygygggtygttagygtaygygatattaggtgggtyggtygagtagatagyggyggggyggggagygyggggygygtggtttttgggttttgygggttyggagtttyggttttgygattttttgagtttggttgggaatt

SEQ ID NO: 3519 - DNA, 237 bp, synthetic construct
  misc_feature 1..237: note = Description of Artificial Sequence: Synthetic polynucleotide
  source 1..237: mol_type = other DNA
ygygtayggtggtgtaggagtttyggtagtttagygtgaggaagttygagygtttgttttgygygtygtygtygtygttattatygtgygttttygggttygagggtayggyggtygtygtttygygtagtagtagygygtygttgttattttgygagaygttgttttttaggtygttttggtagttttygtygttgagagagttttgtttggtgattttgggygatagtagtttga

SEQ ID NO: 3520 - DNA, 204 bp, synthetic construct
  misc_feature 1..204: note = Description of Artificial Sequence: Synthetic polynucleotide
  source 1..204: mol_type = other DNA
ygatyggggyggtttygtttagggttyggggtagyggyggygtyggyggygttygagttttatyggaggagagaygygygagagaggagtttygtyggtgyggyggyggtaatggagaggtaagaaggagttgttgtttttttggggygagggyggggaagtgtgagagagatttgygagaggttttagggttgttgttyggtt

SEQ ID NO: 3521 - DNA, 224 bp, synthetic construct
  misc_feature 1..224: note = Description of Artificial Sequence: Synthetic polynucleotide
  source 1..224: mol_type = other DNA
aggattttttattggggttgagtttttttygtttttaatagaatttttaaatataagtagtttttttttgtttttaggagtttaygaaaygttgttatatygagygaatgtaaygygtatataygtttatattygaatagtataagtaagagatyggttgggtgtggaatagaggygtatatygygtaaygtatttatagtatgtataygygygtatttygatt

SEQ ID NO: 3522 - DNA, 278 bp, synthetic construct
  misc_feature 1..278: note = Description of Artificial Sequence: Synthetic polynucleotide
  source 1..278: mol_type = other DNA
gttttttattyggygttttttaggatttttaaagaygttygtttagatttataggtatttatttgagtttttttgtttttttataatttygattttttttygtttttttttttttttaaaaaaaaaatttaaataatttttaaataatatttaataggaaagaagaaggaaaaggagygtataggaagggyggaggyggtattygggggggattgtttttagaggaggtygttgtgagtyggygaygygaggttgggggagtgggaggtaaattygtt

SEQ ID NO: 3523 - DNA, 232 bp, synthetic construct
  misc_feature 1..232: note = Description of Artificial Sequence: Synthetic polynucleotide
  source 1..232: mol_type = other DNA
ggtggggtaaaaagtaagaygaaatttatttagatagttttttygatttttagaggatygatatttttttygagggttttaatagtggtygtttagggttygagggtaayggtygaggygttaygyggggtygyggttygttttggttayggaggatyggatttgttgygtttttgtgagtttgttttatttttatttattyggtgtttttyggtaygtygatttgtttttt

SEQ ID NO: 3524 - DNA, 331 bp, synthetic construct
  misc_feature 1..331: note = Description of Artificial Sequence: Synthetic polynucleotide
  source 1..331: mol_type = other DNA
aaygygtttyggattttatttttgtaygtgtagttgtttttggggatgagggttatttagtttttgtygygggtyggggyggygaatttggtgttggggtygtaggttaggyggtygtgggtygagttggttatgattattttttygygggygttttgtttgggygagtgtttttygtagygttygtatttygtttttttygtgtgtagtttygygtygtygtygttygtygtttyggtttyggggttyggygygggttyggygtaggtgatgtttaygaaggyggtgtattatttttttttttyggttayggtaaagtttaggtagagta

SEQ ID NO: 3525 - DNA, 231 bp, synthetic construct
  misc_feature 1..231: note = Description of Artificial Sequence: Synthetic polynucleotide
  source 1..231: mol_type = other DNA
gyggttatggtggtttygggaaygggttyggggagggagggygygggaggayggygagtygggggtatyggaggggaaggyggyggygtagatygtggttygttttyggggtagaggagggggtgttaggygggattggggagaggggaaggggggtttagttttgatygggatttatygtttttttygyggggygyggggttaggygygtagatgygtttagggygtagt

SEQ ID NO: 3526 - DNA, 201 bp, synthetic construct
  misc_feature 1..201: note = Description of Artificial Sequence: Synthetic polynucleotide
  source 1..201: mol_type = other DNA
ttygtagtggttttttttgtagtttttttgggtttygyggttagtagtgtagttygtggagtygyggttttgttygttttttttgggtggttttagtgygygggttgatatttatttagtyggggaaggtgaggygagtagaggttggtgyggaatttgtygtttttagtagygtyggygggttaagtttagggtygggta

SEQ ID NO: 3527 - DNA, 201 bp, synthetic construct
  misc_feature 1..201: note = Description of Artificial Sequence: Synthetic polynucleotide
  source 1..201: mol_type = other DNA
agtttaggagttyggggygttygyggygggtatgaggyggygtyggyggttgtagtaagaggayggtatttttttygagtattatygttatttygagttgygygaggygttygtgttygtgtggttgtagtgtatygttattagtaggatttatayggtggggygtagtttygagggtygggagtttttggttatygagtt

SEQ ID NO: 3528 - DNA, 219 bp, synthetic construct
  misc_feature 1..219: note = Description of Artificial Sequence: Synthetic polynucleotide
  source 1..219: mol_type = other DNA
yggttggyggtgtttyggygttttatygggygyggtttttttaggttygggggttyggygttyggyggtattttttygtaatgggagtggtttaggtyggyggygtygttggtatattyggggttgtaggatagggttatgttgtagtyggggggygatatttyggggtggtygatgagttagttatggaagtaggggttttttttatggttgtagygg

SEQ ID NO: 3529 - DNA, 284 bp, synthetic construct
  misc_feature 1..284: note = Description of Artificial Sequence: Synthetic polynucleotide
  source 1..284: mol_type = other DNA
gygggaggagggyggyggggyggttggyggyggyggggttygggagygtygyggygtaggattttttagagygygtygggttgagyggyggyggyggyggyggygggygtaggggtagggtatgattgaygygttttttgtttgygtttatgtgagagaaagyggtygagggagggagygtgtygagttygggttgttttttttttttattttttttyggaagtygtttttttggagtttttygtttttttygtttttttttyggyggttttatttttttyggt

SEQ ID NO: 3530 - DNA, 429 bp, synthetic construct
  misc_feature 1..429: note = Description of Artificial Sequence: Synthetic polynucleotide
  source 1..429: mol_type = other DNA
ttttttttygggtygygatattgattygttaaygttaatgggggttygygattgttgyggggaygagggygtagagtagttttygttaygggtyggtttaygtaggggtygagaaagtggyggagaggyggtggtygaggtttaggggygagygygggttgagttggtttttgttgygtttaygagygatatttattttttygttgyggaygtttygygggygttaggttgggggttttgygatygatttttttygttttygaggtatygtygggttygtttggtaggtagygygtttygygagttggagggtygagtttygyggggtygtggggygtgtgggtgaaggygatatttyggatgygggaygtatgaatggtggtagagtaggggtygggattygtttatgggttgggagagagatgtttt

SEQ ID NO: 3531 - DNA, 283 bp, synthetic construct
  misc_feature 1..283: note = Description of Artificial Sequence: Synthetic polynucleotide
  source 1..283: mol_type = other DNA
ttygttattattgtttaatygagaattagtaaygtttttygtyggtttttattttaygtyggaatggatttttagaatttattgyggtygtaagatagttygtaagagttggttaaaatgtttttaggtgygtgggggtttyggggttttagttggagttygatattttgagattggyggttygagggttgtagggtygtttygggygtgygtttatyggttttgtatttttgggtagtygagtgtygyggagaaygttttattttttttatygyggtttttt

SEQ ID NO: 3532 - DNA, 241 bp, synthetic construct
  misc_feature 1..241: note = Description of Artificial Sequence: Synthetic polynucleotide
  source 1..241: mol_type = other DNA
tygtttatatygttttttttttgtaggtgaggaatggggtttgtttygtttggaatgtgtttttgtygggttttgtttgatttttattttttagtygggaygygygagttttttygtttggttgagttaaaaagggatygygygtatttygtygttttttattaygaagygtagatataggaggttgtagggttagtgttgyggagaattttagayggttttatagtygtygttattygyg

SEQ ID NO: 3533 - DNA, 244 bp, synthetic construct
  misc_feature 1..244: note = Description of Artificial Sequence: Synthetic polynucleotide
  source 1..244: mol_type = other DNA
tygtygtttttatttyggggygygtaggtygaggaggatttygttgattaygaagagtttgaggatttttygagtttgttagatattygtagtatygtttyggaygattttttttattttttygaggaygaggaggagtayggygtygagagygyggagagygtttyggagggygtttyggaaagygtttyggagayggygatttttttgygygtygtttgygttaataaygtggggttgttgc

SEQ ID NO: 3534 - DNA, 225 bp, synthetic construct
  misc_feature 1..225: note = Description of Artificial Sequence: Synthetic polynucleotide
  source 1..225: mol_type = other DNA
ttagttygggaagaggygtgygyggygtygttyggttttagggtaaggttttgattttgtttaattgtagtatttttygtttttgttgtttgagygyggtygygggataagggatgttggygggyggtaggggygagygtygygggygagaggyggttttygaygygagtgygtagygttyggttyggyggttttttygagttyggygagygtagygttttttgt

SEQ ID NO: 3535 - DNA, 249 bp, synthetic construct
  misc_feature 1..249: note = Description of Artificial Sequence: Synthetic polynucleotide
  source 1..249: mol_type = other DNA
gagtttggggtygtygyggygttyggygtygagygttttygagttgygtttygygygyggttygygttatttgtgtygtygtygttttagtygtygagggygaggtttttttygyggygygyggtagttttagtttttatttaaatttyggyggtyggttygggygttyggttagtgagggagygttygtttygtygtygaaatyggtttygggtgyggagtatgtttagtgtygtygygagagyggyg

SEQ ID NO: 3536 - DNA, 255 bp, synthetic construct
  misc_feature 1..255: note = Description of Artificial Sequence: Synthetic polynucleotide
  source 1..255: mol_type = other DNA
gtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtyggg

SEQ ID NO: 3537 - DNA, 243 bp, synthetic construct
  misc_feature 1..243: note = Description of Artificial Sequence: Synthetic polynucleotide
  source 1..243: mol_type = other DNA
ttagtagygtygtygttttttagygtygatgttttagtyggyggggyggttgaggggtgagggggaatttygygggygggggygagggagygtgtgtgygygagygtgtgygygygygaggggagygygtgygyggtgaggaygygygtyggyggttggggygggggygggggtyggggygtttttgtgggaagggaggggtgaaaggtygttggttttyggtaatayggtttaggtaaaygt

SEQ ID NO: 3538 - DNA, 201 bp, synthetic construct
  misc_feature 1..201: note = Description of Artificial Sequence: Synthetic polynucleotide
  source 1..201: mol_type = other DNA
tggagagaaatgagttggagagttatatygagttaaygygggatayggttttyggttygggtygggttaggggtgggaggyggttttttatygtaggyggygggatttttatgygtygagggatttaagtttttattttatttataygtttattyggygtyggggygttgyggtttygttttaygagtttagagtaggtyg

SEQ ID NO: 3539 - DNA, 208 bp, synthetic construct
  misc_feature 1..208: note = Description of Artificial Sequence: Synthetic polynucleotide
  source 1..208: mol_type = other DNA
gtyggatatttttttttaggattattygtattttatagtygygttaaaagygttttatttttttgtttttygtygygtaggttttttatygaygttygttyggaaggygagagtttttaygtggttyggygyggygyggttttyggggatygygagtaataaaagttyggttygtagtttttgtttttygtttttttttttaattttt

SEQ ID NO: 3540 - DNA, 257 bp, synthetic construct
  misc_feature 1..257: note = Description of Artificial Sequence: Synthetic polynucleotide
  source 1..257: mol_type = other DNA
tttagtttttygtaagtatttttttygtttttttattttttttagtttttagtygtygtygttttygtagtttyggtttygygttttttygtagtttyggygttygtttattygttaggtaggyggtggtgtygatttatttgagtagttgtttygygtttagttygtygygygtagtggygtgygtyggttggatggtttggtttatgattatttygtygggygtyggtygttttatggttagggygagagygtta

SEQ ID NO: 3541 - DNA, 350 bp, synthetic construct
  misc_feature 1..350: note = Description of Artificial Sequence: Synthetic polynucleotide
  source 1..350: mol_type = other DNA
gaayggtttagtttaggttttgygttagagtatygtattygggggyggayggttttgtagttttttagttttttttygtattaattagttgaygttygggygtattggtttttttygttttygttygtaygaaagttttgttygaygtttgtagttagtatygttygtattgtttagggagggtttgygtygagatttagtggtygagtgagttatagagtygttggttttggggaygttgttttttatygttttttatygttttttttttttttgtattttatttyggtatttygtattttttttttygttyggtttygygtattttgtttagattttataagtatttt

SEQ ID NO: 3542 - DNA, 216 bp, synthetic construct
  misc_feature 1..216: note = Description of Artificial Sequence: Synthetic polynucleotide
  source 1..216: mol_type = other DNA
attaaattaggggttgggagtttttagattgaaatgygttttttattattaagagggagtttaygyggtygyggggggtygaggtagttagtyggygtygyggttttggggagttygtgtaggggtgtgttttggtgtgaaatttggtaggattttgtttgggtttgtatgtagggaggggttagagattttgaaatgtattagygggtagggtgg

SEQ ID NO: 3543 - DNA, 269 bp, synthetic construct
  misc_feature 1..269: note = Description of Artificial Sequence: Synthetic polynucleotide
  source 1..269: mol_type = other DNA
ggtattgttgttygaaygaaygaaygaaygaaygaaygaagyggtttygtttaggaaaaatatttttttgaygygaagttayggttgaagtttygggttaygtagaggggttagtaattttatgggtggtggggttttttatttttggaygtagyggggagtagygggyggtttttttttttgtttattttttttgggggtgggggagttttgtgttattygaygttgygaggggttgttaygggttttttaggttgtgtttttygygg

SEQ ID NO: 3544 - DNA, 258 bp, synthetic construct
  misc_feature 1..258: note = Description of Artificial Sequence: Synthetic polynucleotide
  source 1..258: mol_type = other DNA
agatygggtttttgttygttttttttttgygtttygggatgaggtagagattgaatagtyggygagtaaattaayggtatttagaaagttatgtyggattyggygtttagygtttaagygttaattygttgaaagttttttagygaaattttagggaygatttggatttygttgagaggaattgtttttgagtgagatggttttagaggtttggaggagyggattggtaagtatygggagggtagtgggagttttgtt

SEQ ID NO: 3545 - DNA, 224 bp, synthetic construct
  misc_feature 1..224: note = Description of Artificial Sequence: Synthetic polynucleotide
  source 1..224: mol_type = other DNA
tgtgttttttttttttttttttttttttttttttttygtygtttttttttttttttttattttttttttttgttygttttttttttttttttygyggtygyggttyggatagaggttatttagygttttttygtagtttttyggagagtatgtgattaggtygttagtagygtygygagtgttyggtaatggtagggatggtgttttaaatatttttggaagtt

SEQ ID NO: 3546 - DNA, 256 bp, synthetic construct
  misc_feature 1..256: note = Description of Artificial Sequence: Synthetic polynucleotide
  source 1..256: mol_type = other DNA
ygttatttygygttagtgtttgagttgtaattgtaaattgygygttttggtaygagtagyggtgggggygggtgggggaaggagygagtgattttttaggygtttttygttatttgatattagttaggtagtttttagggttagagygttagygtygaagttaggtttattygggaagttatttyggtggtygyggggtgtttatgttagtattagattttttttyggaaggaggagyggggygggttatayggtt

SEQ ID NO: 3547 - DNA, 310 bp, synthetic construct
  misc_feature 1..310: note = Description of Artificial Sequence: Synthetic polynucleotide
  source 1..310: mol_type = other DNA
gggaaggggygttaatagggttattatttyggggtttygttattttttagtygttttttttttyggagattttgtttgttaagagttttgttttttgtttygtttagggttggggttyggtgggaattttttygtgttygaagggaygatttygttagagagtttttygatttttgtatttatygtttttggtaggaygtggagttgttyggaagttatttygggttggtttttttattygtgtgttaygatttttyggygggtttttgtygttygagtgtttttatygttagttttyggagyggyggag

SEQ ID NO: 3548 - DNA, 410 bp, synthetic construct
  misc_feature 1..410: note = Description of Artificial Sequence: Synthetic polynucleotide
  source 1..410: mol_type = other DNA
aggataattgggaygggttggatttatatttgatattygggaaatttttagagygtgtggtgtttttgttagyggtagttattggtggagttgaggttatygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattygygygtaygaatygggtagtgtgygygtgtgtgtgttygygtgtgtgagygygtgtgttagygtgygttttygygygggygtgygtttgggtggattttt

SEQ ID NO: 3549 - DNA, 274 bp, synthetic construct
  misc_feature 1..274: note = Description of Artificial Sequence: Synthetic polynucleotide
  source 1..274: mol_type = other DNA
ttggggttagttttttttttttatygtygtygtttttttatttatttygygtttattttataattatttygtttggttttttttyggttttatttttatgygtttttattatttttttaaatattgtagtaagttgtagtaaggygggtaaatatygatagygygygtgggggygggyggygggygtygyggggtttatttttttttyggttttttygygttttygtygtttttygygttggtttttatygtatgagtagygttttttyggttt

SEQ ID NO: 3550 - DNA, 201 bp, synthetic construct
  misc_feature 1..201: note = Description of Artificial Sequence: Synthetic polynucleotide
  source 1..201: mol_type = other DNA
tttttggttggygggygtttygtyggtygtyggttttttttttgaaattygtyggygtatatgaggtygttgttttygtygtaggygttggyggttttttygyggtgttygtggtgatgttatgtttygttattaygygggaggagaggagggyggygtygtygggttttgggtgaagagyggygtagyggyggyggyggc

SEQ ID NO: 3551 - DNA, 265 bp, synthetic construct
  misc_feature 1..265: note = Description of Artificial Sequence: Synthetic polynucleotide
  source 1..265: mol_type = other DNA
ttttygtggtaggyggtagygagttgggttyggggtygggttgagttttgggatygygttgygtagttttygagtygttygttatttggttgyggtygygyggttatttgtttttygttttyggggygtygtttagtttygygttaggygttttttttagygttygtygttttttttyggygagattattygggygygtttygttygtyggttttygatgtaaatagttgggtttygtaggyggttggtttygygtttttyggtt

SEQ ID NO: 3552 - DNA, 201 bp, synthetic construct
  misc_feature 1..201: note = Description of Artificial Sequence: Synthetic polynucleotide
  source 1..201: mol_type = other DNA
attattattattttaagtgtttgttygttggggattygtygtygtygtygtygtttggtttgttttgttttggggttttgygyggtttttttttgtttttygttttttyggaagaggygttygtttttaagtaygtggagygygtttygttygtagtygtygygttgttaggagygygttatgygtagttgttttttgygt

SEQ ID NO: 3553 - DNA, 362 bp, synthetic construct
  misc_feature 1..362: note = Description of Artificial Sequence: Synthetic polynucleotide
  source 1..362: mol_type = other DNA
tttggyggggagtttgggtagygtygattaaagttyggagyggtagtttyggggygygggaygyggggtataygggtttagttgttygaygggagttygaygygygtttttyggygggtyggygggttyggaagtttygttgttygggtygggtttttaagttygtagtygttttgattaaaataggtatygygayggyggyggtaggyggyggtagttagggttggggtygtatygygtaygygtatgygttygtygtttygygtttttyggygggyggagttyggygtygyggttaggattttttatttygttttygygatttygttgygggtttgtatattygaggattyggtttgaaa

SEQ ID NO: 3554 - DNA, 298 bp, synthetic construct
  misc_feature 1..298: note = Description of Artificial Sequence: Synthetic polynucleotide
  source 1..298: mol_type = other DNA
gttttygttttttatygttttttttygtttygtagttttygagtggygttagtaygttygtygggtatgggttttaaatgtttattagygggagtttaggygtttttgttttggagygyggtygggagtaaaatygtaggagtgggagggtagygagttagttggatttygagtygyggagygygttggttttgtttygtttgatgattttagagygygggtttaagygtygtttatgtagtatttttgagtttyggggaaggagagttaatgaaaaaatatttaatygttttygttg

SEQ ID NO: 3555 - DNA, 295 bp, synthetic construct
  misc_feature 1..295: note = Description of Artificial Sequence: Synthetic polynucleotide
  source 1..295: mol_type = other DNA
gagyggygyggagagyggtaggggygaaatttygygggttagatgttygagggygyggyggygttgttaggttgtygttgttgtttttgygggtttygagygygttttygtaggyggtattgttygyggygyggygtgtgtatygagygagtgaaggtatgtgtggygggygyggttggagttgtygtygtygtygtygtygtgttagtaggttttaatgtttgttattttttaggaygttggtagtagtagtagttyggagttttygagttttyggtaggtttgygtgtttttt

SEQ ID NO: 3556 - DNA, 203 bp, synthetic construct
  misc_feature 1..203: note = Description of Artificial Sequence: Synthetic polynucleotide
  source 1..203: mol_type = other DNA
ygaaggtatttgggatttttagaygtaggatgtttttgatygttgagtaaatgataagggaggygyggtygyggtattygtttatttagygtaatygtttygygyggggagatttyggttgggtttttaggttggatttyggtagtygaaygttygttattyggttaggaagttagggagygagygtttgygyggtygtattt

SEQ ID NO: 3557 - DNA, 215 bp, synthetic construct
  misc_feature 1..215: note = Description of Artificial Sequence: Synthetic polynucleotide
  source 1..215: mol_type = other DNA
ygyggatyggtyggtttgggtttttgtagagtagattttgtttgygttttttaggaggagtgggtggtaggattggggttttttataggttttggggyggyggygagattggtayggttyggggtygtaggygygtagttaygtttttggaagttygtttyggttttygtttttaattygttttttyggggttttatggygtgaggtttggggtt

SEQ ID NO: 3558 - DNA, 201 bp, synthetic construct
  misc_feature 1..201: note = Description of Artificial Sequence: Synthetic polynucleotide
  source 1..201: mol_type = other DNA
ggaggttgtagtygttygagtyggttygggtgggggyggggtgggggyggygyggagggtayggagattayggyggygttattygggatatttagggtttygaggttttgggyggtttttaygygagatygtaaattatgataataggtagttattygaggttaaataaaaayggagtgggtttttygygygtygtygttt

SEQ ID NO: 3559 - DNA, 340 bp, synthetic construct
  misc_feature 1..340: note = Description of Artificial Sequence: Synthetic polynucleotide
  source 1..340: mol_type = other DNA
ggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggg

SEQ ID NO: 3560 - DNA, 201 bp, synthetic construct
  misc_feature 1..201: note = Description of Artificial Sequence: Synthetic polynucleotide
  source 1..201: mol_type = other DNA
agggtttagggygtagggygggtttygtaygtagggygggygygygggtatttttgtggttaggygatttyggttygttttttyggagtttagggattttygaggttggygygggttgttygygataaggtgttagtagtttygggttygygaggagtagtttttattygyggttttygagtttagttttgttttttygtt

SEQ ID NO: 3561 - DNA, 236 bp, synthetic construct
  misc_feature 1..236: note = Description of Artificial Sequence: Synthetic polynucleotide
  source 1..236: mol_type = other DNA
tttgagtagtgtatttttttaaaggtaaagagagataagggaggaaatatagtatttaaggtgattagtygattggatattgttgatggtatatttttttygtttttaattaatygtataaaattygtaatatttygygttttygyggggtttttygygtttttggttyggttttttyggtygtttttagtaggygtttygtttttygygggaattttgggatttggtygagygtt

SEQ ID NO: 3562 - DNA, 251 bp, synthetic construct
  misc_feature 1..251: note = Description of Artificial Sequence: Synthetic polynucleotide
  source 1..251: mol_type = other DNA
gttttttagtttttygygtatttttttgygttygggtttygtygtttygtttagtgttggttaygggtygtgttattagtttgtgygttttygttattygygggtyggggtatttggygttttgtgtgggtggygggagyggggaygtttyggtgttyggggatygtagygygttggygtttaattttgtygtygttygttttggagtygggaggttttagtygtttaagtgtttygggagatttaggtat

SEQ ID NO: 3563 - DNA, 201 bp, synthetic construct
  misc_feature 1..201: note = Description of Artificial Sequence: Synthetic polynucleotide
  source 1..201: mol_type = other DNA
tttygttttygttttattttttattggygtaggtttaggttatygttgttaggatttttygttgtygtygtttttygttttttttatttagattttgagtygtttattttagtyggtgtaggtygyggggtygtttttgatggtttgggtattttttattttygtttygtttaygattatygyggttgtttgagttgttta

SEQ ID NO: 3564 - DNA, 206 bp, synthetic construct
  misc_feature 1..206: note = Description of Artificial Sequence: Synthetic polynucleotide
  source 1..206: mol_type = other DNA
gttttygagtgygtagygtgygtttttagtttttgttgygtttttaggtttggygygygattygagygtagygggtaaagttggaggaatttggyggyggyggagygggygtaggtttagttygataaagttygggggttygggtyggggtygttgtygtagttygtaygttgtttygtgttttygagaggttttttttttagygt

SEQ ID NO: 3565 - DNA, 201 bp, synthetic construct
  misc_feature 1..201: note = Description of Artificial Sequence: Synthetic polynucleotide
  source 1..201: mol_type = other DNA
ggtygtygtttatttygygtatttygttttttggaaatttagtagtyggggggygaatatygyggygtttttatgggaatttggtttygggtttagagygygggtagttggtagagtttggggggygyggyggyggtagtagtaggttggagggygygyggygggggttaaggggatttggtyggygttyggagtyggagt

SEQ ID NO: 3566 - DNA, 203 bp, synthetic construct
  misc_feature 1..203: note = Description of Artificial Sequence: Synthetic polynucleotide
  source 1..203: mol_type = other DNA
gttgtaattttgggtttgggattgyggggaygggaygggtgggaagyggttaaaggygtagyggtttttggttagagtygtagaggtttgagaygtgggtygygtttyggtttaggagatttygyggtygygttttaatttttagtttttygattgygattgygattygggaaaaygtttaygtttttggaaaggaagtttta

SEQ ID NO: 3567 - DNA, 216 bp, synthetic construct
  misc_feature 1..216: note = Description of Artificial Sequence: Synthetic polynucleotide
  source 1..216: mol_type = other DNA
ttggggggttgggagaaygaaaatattagttgygtttttaatatttaaggaaggaagtggtagyggggayggggagaggatgggaaggggatgttgattgygagttggggygggaygyggtgatgggaggggatygggtygggaatgygggaggygaggggagygaygggatttgtygtttyggyggtygggtagttaatygattygtttttttta

SEQ ID NO: 3568 - DNA, 335 bp, synthetic construct
  misc_feature 1..335: note = Description of Artificial Sequence: Synthetic polynucleotide
  source 1..335: mol_type = other DNA
agtgtyggagygttyggtggtygtygygtygygygtttggagggatgttaaygtggagtyggygtygagttygttyggygtgygtgygtgtgtgggagygygygagttttttgaygyggggattagttatgaatygggggtgtgtgtttgtttttagagatttggtaaggtgyggagttttttagaagtgyggttaagyggtagyggagayggygagttaggaattttttttygygtttttagttttttagygtggyggyggaattttyggagaaagtttgtaaatttttagygggygyggygaggaygtygggttatttagggggygggtgggc

SEQ ID NO: 3569 - DNA, 230 bp, synthetic construct
  misc_feature 1..230: note = Description of Artificial Sequence: Synthetic polynucleotide
  source 1..230: mol_type = other DNA
gagagaaagtgagaagggagagaaaagyggyggttgagtaaagygggagtyggygygggyggtggggtttgattyggaygtygygtattyggtttygtttygygtttagygtttygtttattttttggtygygtttgttttygygtttttttgtttttttttatttattagtagttttgttgataagygagaaaattgataagtgagaaaagtygtttgttagygttygg

SEQ ID NO: 3570 - DNA, 224 bp, synthetic construct
  misc_feature 1..224: note = Description of Artificial Sequence: Synthetic polynucleotide
  source 1..224: mol_type = other DNA
tagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygtt

SEQ ID NO: 3571 - DNA, 211 bp, synthetic construct
  misc_feature 1..211: note = Description of Artificial Sequence: Synthetic polynucleotide
  source 1..211: mol_type = other DNA
ggttaattttaggtatagtttattygagttaggygaggtttagaaaggtttgattygtttggtagttttaayggatttgttttygtagtygttgattagtygttgaygagyggatttttyggtygttatggygattgtgaaatgtagggtggagygtatgygttygaagttattygygygggtagtttttgygtgtttttttgygtgtttt

SEQ ID NO: 3572 - DNA, 205 bp, synthetic construct
  misc_feature 1..205: note = Description of Artificial Sequence: Synthetic polynucleotide
  source 1..205: mol_type = other DNA
ygtgtaattygattttttttgatttataagttttgagtgatagttttgatttggtttaatygygggagggaggggaaagagaaagaaagaaatttttagtygtaygttttttttggtatttaatygattttttggaaaaaggttttatttyggtttggtgtttygtgttgggtggagaagtttttygtttygatttggtatygtt

SEQ ID NO: 3573 - DNA, 398 bp, synthetic construct
  misc_feature 1..398: note = Description of Artificial Sequence: Synthetic polynucleotide
  source 1..398: mol_type = other DNA
tttygttygtttygygtttygygtttyggygtttygtygttygtygttygttygtttyggygtygtygttygygtttyggygtttygggtyggygaggggygygttygyggtygyggtygttgtatggygttgagatggygggggygtygygyggyggaggyggyggyggaggyggygygggygagttygggggygtygagygggyggtygggataagtygtyggygygggtttygggygtgygaygaggagttygtttgtttagagttggaggygttgtttygyggttataygttgyggttggagtaggyggttaygttgaaggygttggtygtttttagtttgttggygggygygttggygttggtygagttgttgggygygtyggggttygygtt

SEQ ID NO: 3574 - DNA, 290 bp, synthetic construct
  misc_feature 1..290: note = Description of Artificial Sequence: Synthetic polynucleotide
  source 1..290: mol_type = other DNA
atagygggygtttttagatattggggaaagtgttttaygatgtttygagtttttttagtttygttagyggggygagygtgagggtgtttygatygattagyggtttygggtgtagggtggygggttyggyggygygygttttttttttttttttggyggttygtaygtgtygttygygtygygtttttaygggttaygygygggtttygtagygtygyggtygagtygggttgttyggttygyggatatagygtyggtygtygtatttygtgyggggtygyggygygatg

SEQ ID NO: 3575 - DNA, 307 bp, synthetic construct
  misc_feature 1..307: note = Description of Artificial Sequence: Synthetic polynucleotide
  source 1..307: mol_type = other DNA
ygtgaaattgtttaattaagtgygtagttatagaggaagaggyggtttttttaatatggyggggtttttgttttttagttttygggttttgattttagttygygtttttattgttttatttttttygtttttggagtttttyggtgattttattatagtttttgttattttgtgatttgtaggtattgggagatttatagggaggayggyggaatatttggaggttgggaaatggtgagtgygtggagtgggtgtttygagaatggggaagaggttgtttgaattyggtyggaatyggttgyggtgg

SEQ ID NO: 3576 - DNA, 212 bp, synthetic construct
  misc_feature 1..212: note = Description of Artificial Sequence: Synthetic polynucleotide
  source 1..212: mol_type = other DNA
agtgttgttaggyggaggttygttagaaggtttygtagttgttgaggyggggtgggattgygttttaggggtygygttgaagttggygtygygattattgygtatygatttygtttattttttgttygttttygggagttttttttgttttaggayggttttttattttttaaattatgttygttttttatttyggatttatagttattttt

SEQ ID NO: 3577 - DNA, 375 bp, synthetic construct
  misc_feature 1..375: note = Description of Artificial Sequence: Synthetic polynucleotide
  source 1..375: mol_type = other DNA
tggtttttgagtagtatygtttagtgtagttttygttaggaaaagtagtagaatygatagttttagggggygagyggggtttatggtgtagggggtygggyggttygttgggtaaggygttygagaaagygtttggygggaggaggtgygyggttttttgttttaggyggttygggtgttygttttatgyggggygagygttyggtygattttygtyggggyggagtttgaggggtggttgatttatgtayggggattgttatttygtygttttygygttgtaaattgtgtaagagggagaggaatttttygttaagttgaaaagttgaatttgttttttaaatttttttttgtagtttagayggggaygttttg

SEQ ID NO: 3578 - DNA, 201 bp, synthetic construct
  misc_feature 1..201: note = Description of Artificial Sequence: Synthetic polynucleotide
  source 1..201: mol_type = other DNA
ggggttgttygtaatatgtagggaaatgagtatttygttttgttttttatttttttttagtttttygtggtgggtgtataggaaaaagaagggygaaaagygggggtaatagttagtygtygygygygtttttagygtygtttttagtaatagygttaggaggaaagtttgtygggtttagttattgygttttatgtygtc

SEQ ID NO: 3579 - DNA, 356 bp, synthetic construct
  misc_feature 1..356: note = Description of Artificial Sequence: Synthetic polynucleotide
  source 1..356: mol_type = other DNA
ttggagaygtygggayggaggagttaygyggagagaaggygagaagaaggyggaygggagyggaaygggttygggagygggtttgggagygggttttygtygagaagtttygygggagayggyggtttttaaagttattttgggtygygggagygygggatyggggttgygggygtygagagygygtygtttgtygttttygtgygtygtygtygtttttgygygaygtttttyggttaggtttgggaaagygttygtttygttttatatttttttaaagtttygggygtygygtttttttygtygtygttataygtgtttyggtygttttttygttttygygygtygtttygttc

SEQ ID NO: 3580 - DNA, 265 bp, synthetic construct
  misc_feature 1..265: note = Description of Artificial Sequence: Synthetic polynucleotide
  source 1..265: mol_type = other DNA
gtyggtttttttgtttgagtyggttgygtttygygtttttyggggttygtagtttgttagttygggyggttygtattygttttgggaattygttygaggtygygaatygttaggggttttygygttttttttttatttaggttttttgtttttttygtygyggtygttyggtttttygyggtagygatagagttttatttgtagaggattttaaaatgagattaagygaaagtggaattggtagattygagtggtgtttggaaat

SEQ ID NO: 3581 - DNA, 697 bp, synthetic construct
  misc_feature 1..697: note = Description of Artificial Sequence: Synthetic polynucleotide
  source 1..697: mol_type = other DNA
gattttagtygtaygttgtgygaggtttgtaatattygttttagtygttaygagatttatatygtgtataagyggtattattgygtttygygttaygattygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayggtttgttgttyggygygtttttggtyggttygggggtygaggttyggaygtyggtygatygyggtttttygttygttttygttttygtygttttttygt

SEQ ID NO: 3582 - DNA, 226 bp, synthetic construct
  misc_feature 1..226: note = Description of Artificial Sequence: Synthetic polynucleotide
  source 1..226: mol_type = other DNA
tgggaggagygtagatatttttyggtgatagggagggttttttatttggttgttatttggaagtttatagtggtttyggygggtaggygggygggtagagygygggttygaaygtttttygygtttgyggyggygtaygtgyggyggyggyggyggygtyggyggygygggygggatttattgggtggtygygygygttattygygygttttttgygygtttttgt

SEQ ID NO: 3583 - DNA, 201 bp, synthetic construct
  misc_feature 1..201: note = Description of Artificial Sequence: Synthetic polynucleotide
  source 1..201: mol_type = other DNA
ttttttttatttttttaatttttagtaggatayggaatttyggygtttttygaaagttataaaagaggggtayggaaattttaagttygtygtgttaattyggagaaygtaaattygaggtagagygtgygtygtgyggggatgtgggtgtygaggatttygaagygttyggtttttttygygatttttattttttttaga

SEQ ID NO: 3584 - DNA, 201 bp, synthetic construct
  misc_feature 1..201: note = Description of Artificial Sequence: Synthetic polynucleotide
  source 1..201: mol_type = other DNA
tatttygttatttyggyggggtaagttyggattttattagggtaggttygggaggttatttagggtagaygattygaggtagagygttttaaaattttgtygtygtaygtttagttagagygtygagygygtttgtttttttttygttattttttagttttttattygtygattaaatttttgggggattatatttttaag

SEQ ID NO: 3585 - DNA, 215 bp, synthetic construct
  misc_feature 1..215: note = Description of Artificial Sequence: Synthetic polynucleotide
  source 1..215: mol_type = other DNA
ttgttttttagttagaaygtgaatgtattgttgaygtatattgttttgggagaagattagygtgatgtagtgtttttatgtattagygtygtttttttttygtygtttgtttygyggggttaaygtyggygttttttagygtygygtyggtyggygtygygtagtttygygttttyggtygttygtttttttttttttttttttttttttttttt

SEQ ID NO: 3586 - DNA, 252 bp, synthetic construct
  misc_feature 1..252: note = Description of Artificial Sequence: Synthetic polynucleotide
  source 1..252: mol_type = other DNA
tgaaygtgtgygtgtgygygygtgtggttgttttttttagttttagtttygaaygtaaatattttatygaggtatagggaagtygggagtagtygaggaaygyggagggygtygaattagagtttgyggggtttgatagttttttttgyggygtttaaggtgggygtaatgtttaataaaaaggtyggaaaatggggatygatttygaatattttttttttttatttagtttyggagttygagtagyggygg

SEQ ID NO: 3587 - DNA, 203 bp, synthetic construct
  misc_feature 1..203: note = Description of Artificial Sequence: Synthetic polynucleotide
  source 1..203: mol_type = other DNA
ygtttyggyggtygyggagggagygtaggyggygtygttgtaggggtygggygggttggyggyggyggyggyggyggttgtaggagygygggtaggttygygygtygttggtaggggtagtaaatggtagttttttttygtagtatttattygyggttgtatygtatyggggtattgtgggaaatttygtttattttttygtt

SEQ ID NO: 3588 - DNA, 201 bp, synthetic construct
  misc_feature 1..201: note = Description of Artificial Sequence: Synthetic polynucleotide
  source 1..201: mol_type = other DNA
yggyggtattyggygtagaggttttagygyggggagtygggtttagtttyggtttgttagygtygyggttttagtttattygaggtyggtttggggggttygtagggygygyggagygtygagtgygygtygggttgggtttygtatttyggtgtaggagygygggygyggygyggyggagygtttygtatggagtyggtt

SEQ ID NO: 3589 - DNA, 201 bp, synthetic construct
  misc_feature 1..201: note = Description of Artificial Sequence: Synthetic polynucleotide
  source 1..201: mol_type = other DNA
gttgaatatygttygggtttagtttttatttygyggtttggtgaagttggttttygtgtttgtttgggaagtttttgtttggggataatygttaggttttygagtygttttttttttatttttygttgygtyggtaattttattttttygtttttattaayggatyggtatttaaattaaagtttagttttttggggttta

SEQ ID NO: 3590 - DNA, 201 bp, synthetic construct
  misc_feature 1..201: note = Description of Artificial Sequence: Synthetic polynucleotide
  source 1..201: mol_type = other DNA
tttygtttttyggtagagtttttgttygygttaatttatttattaggttttgttygygttaygygygtttttggtaggtttggggyggggaaaggygaagygttgggtaygygagggtttgtgtattttagtttttaygaygtttttggttttttttaggttygtygttgtygtatttaatttttttttttygggggttat

SEQ ID NO: 3591 - DNA, 213 bp, synthetic construct
  misc_feature 1..213: note = Description of Artificial Sequence: Synthetic polynucleotide
  source 1..213: mol_type = other DNA
tagtttatttaatattatttatgtattttgtgtaaggaattgtgggatttygttttayggtaaataatatggaaattttaaaaatagygatttttttgtgygtgtttatttaygygtttyggggtgatttggyggggttgtygtygggtgatttatatttttgaatygygaagygatagggaaagygygggygagygtaggagaygyggtygg

SEQ ID NO: 3592 - DNA, 385 bp, synthetic construct
  misc_feature 1..385: note = Description of Artificial Sequence: Synthetic polynucleotide
  source 1..385: mol_type = other DNA
ttattttttgtttgtttaagtyggttggttttygtgattgattyggaataatagagtagatgtttgygtgggaggtaagttttatttaatatttgttttgyggygggaaggtttgggtgtttatagatagagttggagtttttyggtgggtggtatagataattagttggggttgttttatatgtaatttaattataggggaaataggtttaaatatygggtgataagtagygtaattgtttygggtgattttgtaattttttttttattaattttttttataaygtatatgattgttataagggttaattaaaaagagygtgagtggttttatgttatatgtagttggattagaaagtgttgagtatttgtttatgygtgtaag

SEQ ID NO: 3593 - DNA, 278 bp, synthetic construct
  misc_feature 1..278: note = Description of Artificial Sequence: Synthetic polynucleotide
  source 1..278: mol_type = other DNA
ggtattgyggtttagttttygttyggggattygygggtygattgtggttttttttggggaagtyggggygyggggaggygtttygggtattttagtygtayggggtaygttygttttyggyggggtttttygtttygttgtgggagtggtagtgggtgtyggggtggagaaagtaygygtggygyggagttttggggaygyggygttttattygttttggggagtttyggattttttttagtttttaggttygtatgtttttttttttttagtgtttt

SEQ ID NO: 3594 - DNA, 248 bp, synthetic construct
  misc_feature 1..248: note = Description of Artificial Sequence: Synthetic polynucleotide
  source 1..248: mol_type = other DNA
aygygagtygttagyggtgggatttatygaygatttttyggggygataggagtagtttygagagttagggygagygttygttttaggtggtyggatygttygtygygttygygtygygttttttgtaggtaaygggagaygttttygygtagygygagygttttagygyggtygttygttttttttttygagggataaattttttttaaattygattygagtttttggattaaattygtttgygtyga

SEQ ID NO: 3595 - DNA, 216 bp, synthetic construct
  misc_feature 1..216: note = Description of Artificial Sequence: Synthetic polynucleotide
  source 1..216: mol_type = other DNA
tataatataagggagagaaagtaaygttttggttttagaaatttttatygttaaggttagttttggttagaygtatagttaaagagtttttttagtttagyggatgaatygttygygagtggtattttttaaaattttggttttattttttaagatgtttttttattgygtaatttagaaagtattyggatygtygttatttattagyggyggyga

SEQ ID NO: 3596 - DNA, 201 bp, synthetic construct
  misc_feature 1..201: note = Description of Artificial Sequence: Synthetic polynucleotide
  source 1..201: mol_type = other DNA
tgaggtgttttttttattaattttaggtatyggtttttggtggaattgtttttagattgtttgagtttttagggttaagttttttttttattttttagtayggagttttatttagaattgtatttygaaagtttaaagtttatttatggtttttagagataggygaaggygaggttttttaygggaygttttggtaggtgt

SEQ ID NO: 3597 - DNA, 208 bp, synthetic construct
  misc_feature 1..208: note = Description of Artificial Sequence: Synthetic polynucleotide
  source 1..208: mol_type = other DNA
ygagtagttagggttagygagygattttagtagtagggaygyggtygtgygagagttygyggataggygagggggattttaggggagtagttgttgtttaygggttaygggygatgtayggagtggagaagtgaaygtggtttataggatttttgttyggaaggtggagagygttataggggaattttttygatttttgttygtttyg

SEQ ID NO: 3598 - DNA, 201 bp, synthetic construct
  misc_feature 1..201: note = Description of Artificial Sequence: Synthetic polynucleotide
  source 1..201: mol_type = other DNA
ttaggagttyggatttttgtttagttttttggyggagttaagttygagygtatagatttttygagttttagyggttagggggtattgtgtgagyggttgaygttattttttygttyggtygaaattaggyggygggattttatatagttgaggagagggagtygaggtygtgatttagggttggygaygattaaattaagt

SEQ ID NO: 3599 - DNA, 364 bp, synthetic construct
  misc_feature 1..364: note = Description of Artificial Sequence: Synthetic polynucleotide
  source 1..364: mol_type = other DNA
gtygygggtgaggtttgtggttaatttygygttgtygaggttttattttttygagtttagtttgattttaggtygtttttaggtyggtgtttagttgaggygggaaygttgtagtttggttgagygtgatttttaggttttgtgaggaaaagtygagygygttatatygaggygttagtygtttattttattataaggtaaaagatttatgttgttttagttattttaaagttgggagatatattgtattttttattagatttygaatgtttttagtgtttgtaattttttaagaagtttttagagtagatagtttttggatygtgggtattttttttyggggayggggattttgttgatygtt

SEQ ID NO: 3600 - DNA, 213 bp, synthetic construct
  misc_feature 1..213: note = Description of Artificial Sequence: Synthetic polynucleotide
  source 1..213: mol_type = other DNA
gtttagtttttttttagtatgtaaagttttttgttttttttyggagttggyggaggyggtaattttttattttygtygtygggggtygggtagtagygggygygygggttagygtttagtayggygggtagygtygygttgygtatygtygtygattatgagygaggatagtygyggagatagtygygtygagagygttaaggatttggagaa

SEQ ID NO: 3601 - DNA, 201 bp, synthetic construct
  misc_feature 1..201: note = Description of Artificial Sequence: Synthetic polynucleotide
  source 1..201: mol_type = other DNA
ttttttygttayggtaatttaattggaggtagaagtyggyggggyggtygagyggggyggggygggagygyggtygtygygagttayggtggggagygggygygggggattttggygggtttygggtagygyggttgtatttatttgtgttataattgyggygayggggggttgaggaatyggtttttttaaaagtaaatc

SEQ ID NO: 3602 - DNA, 201 bp, synthetic construct
  misc_feature 1..201: note = Description of Artificial Sequence: Synthetic polynucleotide
  source 1..201: mol_type = other DNA
ttttgggyggttgtagaggtyggtygttyggtttggtttattttttttaggaaattttatattggagaggtaagggygattttaaaatgtatygttgagtygttaagttgttatttttttttatttttttttgtttttttaaattgtatttaaaaaaaaaaaaaagttaattgtatagagtggttgggygygatgggtggg

SEQ ID NO: 3603 - DNA, 296 bp, synthetic construct
  misc_feature 1..296: note = Description of Artificial Sequence: Synthetic polynucleotide
  source 1..296: mol_type = other DNA
ttygggatygygtttyggtygttygagtttttygygttygtygttttttatttyggtygggggtttatttgggagttygttgttttyggttagtygttygygtgtgtttagggttagtagtaygtataagtgttagygtayggtygtygygtttatgtttaatgygggtttygttgggygtgygggygtgyggggygyggggattygatygatyggtygttttygtaggygttgttygttgttygtygtttygttatygttygggttttygagtygtttagttagttyggttgatg

SEQ ID NO: 3604 - DNA, 201 bp, synthetic construct
  misc_feature 1..201: note = Description of Artificial Sequence: Synthetic polynucleotide
  source 1..201: mol_type = other DNA
ttttgtttggyggtttttgygttyggggttgttgagttyggggttygttttgaggtygyggttgtggtttttggttttttyggttygygttattgtygygyggygttygttgtattttgttttttttgyggtttygtatgtttttggtggaatttagttyggyggaygaygaggaggatgagatggaagtttgttggaaat

SEQ ID NO: 3605 - DNA, 297 bp, synthetic construct
  misc_feature 1..297: note = Description of Artificial Sequence: Synthetic polynucleotide
  source 1..297: mol_type = other DNA
ggggagggaggygyggygygggaggaggaggggygtagtygyggagttagtggtttygtttggaygygttgttttttagatattttyggagttttagtygygyggatygygygttttygtygttttgtttttaaatttttgtygtagtttttttttaagttagygaatttattttttaaaattagaaattgaatttyggtaygggaaaggagttygyggaggagtaaaattatagtagagtaagaagagttttagagagtagttttttyggagtattaatttygtgtygggagtgta

SEQ ID NO: 3606 - DNA, 268 bp, synthetic construct
  misc_feature 1..268: note = Description of Artificial Sequence: Synthetic polynucleotide
  source 1..268: mol_type = other DNA
tygygttygggaggggyggttgtygttygyggggygttygyggtgttygggtttgggtagygaggaggtgaygtygttttygygggatgagttygggaggyggaggggyggaggaggtgttggyggyggtattgagyggyggyggygtagggygygygggtttttygygtygattttatygatttaaggggyggyggyggtggyggyggttgagygattttgggtygggygygtgatgaggaggggtyggygttagatttygttgtac

SEQ ID NO: 3607 - DNA, 201 bp, synthetic construct
  misc_feature 1..201: note = Description of Artificial Sequence: Synthetic polynucleotide
  source 1..201: mol_type = other DNA
ttgagtagtygaagggataattagatagttatagatagatagayggttagttygagtttygggtaggagagaggttgygaggagtagtttatgtttgtttygtttagttttygygttttygggttgtttttttaatttygattygygtaygttgygagttttyggygttgtygtttagtyggaggggtagtttygtttttt

SEQ ID NO: 3608 - DNA, 201 bp, synthetic construct
  misc_feature 1..201: note = Description of Artificial Sequence: Synthetic polynucleotide
  source 1..201: mol_type = other DNA
ygygattagtattttttygttaygaatttgagagataagaagygaaaatagggtgtgtgggggatggagagagtttyggggaggtagttgygttttygtaygttttaatttaaagaagagagggaaggaggaagygaatttattgtttagtaygagtygyggagyggtttaatttagagygggtagttgyggaygagttgg

SEQ ID NO: 3609 - DNA, 201 bp, synthetic construct
  misc_feature 1..201: note = Description of Artificial Sequence: Synthetic polynucleotide
  source 1..201: mol_type = other DNA
ttttgtgygagtaaagtygggagagygagttttaagtatttggtagyggtgtttttagtaggygtygaggaattyggttatttatttttggtgaattttgygtttattgaggtattygaggtayggatgtgttygtttagtattyggagaygaaggagagagagyggggatatgygttttagttttgttaggttttagggt

SEQ ID NO: 3610 - DNA, 201 bp, synthetic construct
  misc_feature 1..201: note = Description of Artificial Sequence: Synthetic polynucleotide
  source 1..201: mol_type = other DNA
tttttttttttygygtatttygtggttygattygagggygtygaatayggyggygtttattagtaggtaggtgaaggtgtagaygatgagggatagagttygtaygttttgtttttttatggtygttagtaaggagtyggygyggggggtatgtttygtaggtttatagtygygygygttttattgtagygttyggyggtc

SEQ ID NO: 3611 - DNA, 302 bp, synthetic construct
  misc_feature 1..302: note = Description of Artificial Sequence: Synthetic polynucleotide
  source 1..302: mol_type = other DNA
ygtttattygggygygygggtgygtagyggggttttygtygggygtyggtyggtgygygaagtttgttyggtttaatttttaaggygygggagyggggygyggttttaggayggtagggatygygatggagyggtttygggggyggtygggggayggygyggtggyggtyggttagttygttttttygggggyggygggygyggyggyggyggygggaggggtttygygggtttygyggagtagyggggyggaygygggygtatgagtygygygggggtyggggtttttyggygttygggyg

SEQ ID NO: 3612 - DNA, 201 bp, synthetic construct
  misc_feature 1..201: note = Description of Artificial Sequence: Synthetic polynucleotide
  source 1..201: mol_type = other DNA
tyggtggtygygttygtgaaatggggaygygggttttgttttyggattttttttagttttygatttttygtatttgtttygagatttaaygtgttyggttygtagygtgttgggtttgyggygttagggtggttygagtttygagattatttgygtttgyggatatagtygyggggtttggtatgaagggttttagggagg

SEQ ID NO: 3613 - DNA, 220 bp, synthetic construct
  misc_feature 1..220: note = Description of Artificial Sequence: Synthetic polynucleotide
  source 1..220: mol_type = other DNA
gyggggygggygattgtygggtttygggttagttttygtttttygtttygttttygatygttyggttttttygttyggygttttttygggttgygtttygyggtttttggyggyggyggyggygggygtagagygyggtatgggygttygggtygyggggtttggyggyggygggyggaygggygygyggttgygggygtaggtgyggggyggygggtyg

SEQ ID NO: 3614 - DNA, 347 bp, synthetic construct
  misc_feature 1..347: note = Description of Artificial Sequence: Synthetic polynucleotide
  source 1..347: mol_type = other DNA
tatygtttygggtgyggyggttttaagyggagatttgagygyggygggtygagttttttaatttgttggygttgttttttttttttyggyggtgygygggyggygttttaaaggggaggattttgyggygygggtaagaggyggygggagygygyggttygggagtgtggttgtagtgygtygggatattagggtttygygtttygtatttaagaggttttygygttttaatttttygygttygygygttygyggatttaggtygaggatygaaaggggtygttygagttttyggggtyggygtttagagagtttagtaaggtyggtygttttgtyggtgtgtygtc

SEQ ID NO: 3615 - DNA, 201 bp, synthetic construct
  misc_feature 1..201: note = Description of Artificial Sequence: Synthetic polynucleotide
  source 1..201: mol_type = other DNA
tggtattaggtttttttatgggtatyggagtaggyggataggggtggggtttygygagygatayggaagggttagtgtggyggagyggattttgtggaggyggggttattgtgtttttgagaagggttttygggggtggagtttattaaggttgygggggygtggttayggagyggagttaataaaagyggggygtgtayg

SEQ ID NO: 3616 - DNA, 201 bp, synthetic construct
  misc_feature 1..201: note = Description of Artificial Sequence: Synthetic polynucleotide
  source 1..201: mol_type = other DNA
ygttttggtatygggggyggyggygtagaggtygggaggaagaaattygggttttggtttaggtygggtttttatttttgygattygygagaggtttaggygggaaaggyggygagtggygttagyggtttygaaagtaaatttggttyggtgttattgttygagggtygtygggygygttttttaattttttygagtttg

SEQ ID NO: 3617 - DNA, 225 bp, synthetic construct
  misc_feature 1..225: note = Description of Artificial Sequence: Synthetic polynucleotide
  source 1..225: mol_type = other DNA
agtgygtaygttgtaggaattayggttaygtttygtygtttaagggttataagygtttttgtatgtggygygattgttagtgtaagaagtgtaatttgatygtygagaggtagygygtgatggtygygtaggtgggtgygggygtgygggagttygggtttagttttagtttttttttttttttttttttttagatggagtttygttyggttgtttaggttgtag

SEQ ID NO: 3618 - DNA, 318 bp, synthetic construct
  misc_feature 1..318: note = Description of Artificial Sequence: Synthetic polynucleotide
  source 1..318: mol_type = other DNA
gttgttaatttattygggagttyggggtatgaayggttayggttttttttatttgtatatgggyggttyggtgtygtagtygttaygggygtttttgtagygtaygtttaagtgygygygttgtygtaattatggygttttgttttggtttaagggttataagygttattgtygttttaaggattgtatttgygagaagtgtatttttattatygagyggtagygggttatggttgygtaggtggygttgygtyggtagtaggttaaygagagtttggagagttttattttygattygttgygygttttgttagggtt

SEQ ID NO: 3619 - DNA, 265 bp, synthetic construct
  misc_feature 1..265: note = Description of Artificial Sequence: Synthetic polynucleotide
  source 1..265: mol_type = other DNA
aggaaggggagygtagtttgtagattgaagttagtggygttgygttgaatgtaattgygygygttygtygggtgagttagygatttgagttaggygggggyggttygatttttttygtttagtttgggttagaggaagtygaaagyggttttagtaaggtgaggygttygaggttgtagaagatygagtagaattttgtagagttygggatgtgttgggttaggtygttgaggatttgattggttttttttttttttttttttat

SEQ ID NO: 3620 - DNA, 259 bp, synthetic construct
  misc_feature 1..259: note = Description of Artificial Sequence: Synthetic polynucleotide
  source 1..259: mol_type = other DNA
yggaggggaggtygyggagggtygggtggaggtttttatygttagttttaaggtttgtagtatttttttttggtttttgtttttagggtygatgtgttttygagygaagtygtygtgtttgggtagaaggygttttaggaggygygaggttttagtygyggygttgttttygtygttattgttgttgtttyggtttygyggygtttagtayggtttygattttttagttaggyggyggtygttttygatttygyggttt

SEQ ID NO: 3621 - DNA, 201 bp, synthetic construct
  misc_feature 1..201: note = Description of Artificial Sequence: Synthetic polynucleotide
  source 1..201: mol_type = other DNA
gayggggtatyggtattaattagyggttygtttyggggttttygyggttaaggygagaaygtaggattaggagtattgttgtttattttttatygtaattygtatatttygggattaygtaayggyggatggggygttygggagyggtttttgtaggggagagtaataggttttygygttttggaggtttggtttgygttt

SEQ ID NO: 3622 - DNA, 323 bp, synthetic construct
  misc_feature 1..323: note = Description of Artificial Sequence: Synthetic polynucleotide
  source 1..323: mol_type = other DNA
ttttygygattttatyggggaaatatygyggatagtygggttagtagygttyggagtttattttaggtttttaaatttgtagtattttttagagygygygygttyggagygggatttgtttgttttagtgtaygtygyggagygaattatygggttggygggggtggaggggtgtaggygtgggggttgygggtygttygggttttgggttttttttgtygtygtygtygtttttygttttyggttaggagtygygygtgaygyggttygtygtaggagtttygaaggygyggygtyggygagttttttttyggtaggygygt

SEQ ID NO: 3623 - DNA, 201 bp, synthetic construct
  misc_feature 1..201: note = Description of Artificial Sequence: Synthetic polynucleotide
  source 1..201: mol_type = other DNA
agtygttttygtatttttygttatagttttygtagtaatygttttagtagtygtagttttagtagtygttttatttyggtaagatgtaggaggyggyggtygtggyggyggyggyggyggyggtygyggtagtygyggtgggtagygtgggaygtttgttttagtttttattttaygggttgggttyggtygtygtygttg

SEQ ID NO: 3624 - DNA, 355 bp, synthetic construct
  misc_feature 1..355: note = Description of Artificial Sequence: Synthetic polynucleotide
  source 1..355: mol_type = other DNA
gygaatataattgttttagttataggygaggtttggttaaggtgtgggygtatttggggtaggttttgagaggtttagygttyggtggtgyggatagaggyggggtatygyggygttygtygtygttttttygtaggtgattatttttttgtaggtgttttygggttttaggtggttgygtgtttgygttatggttgatattttgggygagyggtatttggtgatttgtaagggygygayggtggaggtygaggyggygttgtagaataaggtggtggtattgtatttygyggyggttyggtgygygtygagtygygattttaygtygttgttttgygatttttatayggygttg

SEQ ID NO: 3625 - DNA, 201 bp, synthetic construct
  misc_feature 1..201: note = Description of Artificial Sequence: Synthetic polynucleotide
  source 1..201: mol_type = other DNA
ttygygyggagygattgtgaggggttttgttggaatttggtagygyggaggtttggagagaagttttatgttggtttttatttagtyggttygtttttttygagttttggaagttttatttagtygtgtatttaatggttttataaagttgattataagttttagygtatttttgaaggagttaaaagygaygtaggtgta

SEQ ID NO: 3626 - DNA, 290 bp, synthetic construct
  misc_feature 1..290: note = Description of Artificial Sequence: Synthetic polynucleotide
  source 1..290: mol_type = other DNA
gatattttgtggagtaggtggtttaggttgtygggtttatygtygggygttttgygtagygtttygtyggatattaagtagggagtygtygtyggggtygygygygtygtygaaattttgttttygtygtygtttatygataggttgtggagaaggttatygatygatgttatygagttatttttgaagyggttatatttggtgygtggaagtatgttttttygtgggttygttgtattygttygggygttgttggtgtyggtttyggygygggttgtygygtatagtag

SEQ ID NO: 3627 - DNA, 201 bp, synthetic construct
  misc_feature 1..201: note = Description of Artificial Sequence: Synthetic polynucleotide
  source 1..201: mol_type = other DNA
tagagattgtagttttygtygggttggatgygagttttttaggttagagtttagaagygygttgggatttgggtttggtttttgggtttgtgttttttttygtttggttttaattgttygtatttaagattataataaaaaggtttaggaagtaaattttttggaygyggaagggtyggttygygggttttygtygagtga

SEQ ID NO: 3628 - DNA, 201 bp, synthetic construct
  misc_feature 1..201: note = Description of Artificial Sequence: Synthetic polynucleotide
  source 1..201: mol_type = other DNA
agaggtyggttygtygygygggagatattttttttaaagtggaagygttgygtgggtagtagygygggtygggttttyggattttagtttttgttgttttygagattttygtttygygtygtatttttygagtttagygttttygggttgygttgggygtagtggttttyggttagggygtagtyggtttgggygttagag

SEQ ID NO: 3629 - DNA, 288 bp, synthetic construct
  misc_feature 1..288: note = Description of Artificial Sequence: Synthetic polynucleotide
  source 1..288: mol_type = other DNA
ygatgtagtttagaattygygatttagttyggtttattatagtttttagtagygatattygtagttttygattttttagatygagtgagtttaattaagtygttattygygtgttagtagttgggygtttygattttttagatygygtgagtttagtaaagyggttaggygygygtttgtagttyggygttagttyggatttygggagtygttttygagttygygtggayggtagagggyggttgtagttygggygtaggygtygttggtttgygggtttttttgggt

SEQ ID NO: 3630 - DNA, 212 bp, synthetic construct
  misc_feature 1..212: note = Description of Artificial Sequence: Synthetic polynucleotide
  source 1..212: mol_type = other DNA
ttatttttygttgygggaaggggttgtttggttgtttttgggggtttttagagttattttggtttygggggattggaggaggaggttatttattttgygtygtttttaattygtgtattattatttattaaatagagatagattttgggttttttaaagayggatgattgggggtggtgattggtttatttttaaatatttattaygtaagg

SEQ ID NO: 3631 - DNA, 201 bp, synthetic construct
  misc_feature 1..201: note = Description of Artificial Sequence: Synthetic polynucleotide
  source 1..201: mol_type = other DNA
agtagtagtaggagtagygaygtttagattttygggtgttgtyggggyggtygygttattygtgygtatagatttygtagttaggtygttygggtygtagygggggygtygygggygygggtygggattgagttttygtygaggttattagtaygygttygygtagtygyggagtttttygtattttygtttttttgtttc

SEQ ID NO: 3632 - DNA, 246 bp, synthetic construct
  misc_feature 1..246: note = Description of Artificial Sequence: Synthetic polynucleotide
  source 1..246: mol_type = other DNA
gyggggatattttygggggtttygggygyggtttyggggaagaggyggaagttgaaattgygygayggggatatttgttgaaaggtygtttagttygaaaygagygttagattttagtaataaaaggttaggygaggttatatygygttggagatagagyggttgtttyggagygtaggyggyggttygggygggaagaggygttgggyggtyggattygtagaggggygtgygyggagttgggyg

SEQ ID NO: 3633 - DNA, 201 bp, synthetic construct
  misc_feature 1..201: note = Description of Artificial Sequence: Synthetic polynucleotide
  source 1..201: mol_type = other DNA
ggygttgtatygtttttgyggttttagaggttygygggtgtttgggygygggtggygggygggtygggggtttgygggygtgtttgtgygagagttgtttygygagyggygtagagatattygggygagttgagagttttattttgttttatyggtggaatgggtatattyggaaggygtagttgttttatttttgggagg

SEQ ID NO: 3634 - DNA, 201 bp, synthetic construct
  misc_feature 1..201: note = Description of Artificial Sequence: Synthetic polynucleotide
  source 1..201: mol_type = other DNA
ggttgygygaygtttttygtygttgggggagattagtaaagttattygtttttggatttyggggtttgggtttttagatttygtttygyggygggagatgygtttgagttttttatagayggagygygttttagtttgaygtagagggatgaatagataagygtatygggygggaatttygattgtttgtgtatttggggt

SEQ ID NO: 3635 - DNA, 358 bp, synthetic construct
  misc_feature 1..358: note = Description of Artificial Sequence: Synthetic polynucleotide
  source 1..358: mol_type = other DNA
gatatttagyggttttagggtgaatttygatygtagtygtygtygtttygggtagagtttgygtttttgttttgygtttygggygttgaagtygggygggygatgttygyggygtgaaagygttygyggygggygtygatttttgttttagttttttgtttttttygtttygtttgtttygtgtttttgtgattttggttttggygtygtygtttaggygtttygtaatgtagttgtttttgygtttyggygggaggygttttgtttygygagygttyggggttyggagttyggtttgggggtttagtygagttygggyggggtyggggtygyggtggygatgtatygggttygttag

SEQ ID NO: 3636 - DNA, 201 bp, synthetic construct
  misc_feature 1..201: note = Description of Artificial Sequence: Synthetic polynucleotide
  source 1..201: mol_type = other DNA
yggtygggttttttggagagggagtgtaaggaggagtagtgttttttygaggaggttygggagatttttaaggaygyggagaggayggtgagtttagtttyggggygtttygygtygyggatattgtaggyggyggtgaattaggtygygtggggtygtttgygtttttttggttgyggttgtgggyggygaataygtagc

SEQ ID NO: 3637 - DNA, 201 bp, synthetic construct
  misc_feature 1..201: note = Description of Artificial Sequence: Synthetic polynucleotide
  source 1..201: mol_type = other DNA
gttygggaygygagagggggygygayggyggttgyggtyggttyggygtttatttggtygtttttgygagtagygtttygygtttygttygygyggagttygtatttttyggtygygtygtygtygtyggygaggagtygtattygggygtagygtygttygttygygatgayggtygttygggtyggggayggggaggyg

SEQ ID NO: 3638 - DNA, 201 bp, synthetic construct
  misc_feature 1..201: note = Description of Artificial Sequence: Synthetic polynucleotide
  source 1..201: mol_type = other DNA
agagagaattygaggttgtttttgtygttgaaatttgagygggagagtatttygaagtygtttgygtggagygagtagttttygygttatgggttagaggygttygggagaatttgygggttayggattatattygtaggggtttggyggagtaaggtgtygttygtygtttgygggtaggagtyggttttgggtttyggt

SEQ ID NO: 3639 - DNA, 277 bp, synthetic construct
  misc_feature 1..277: note = Description of Artificial Sequence: Synthetic polynucleotide
  source 1..277: mol_type = other DNA
tygtagagatttagttttgtttgtygattggtttttygaygtygtygtygtgtttgagtttygttgtttgttyggataagtagaatttyggtaggygtagygggygtygaggtttgggttttagtygtggygttygtttyggygtagtggggagtygygggygtyggagaagyggtygygttgtttygggttattgtatyggttgaaaaaattaaaagtaaaattaatatttagaaaygaagtttgygtgttttygggggtttygttttgttttttt

SEQ ID NO: 3640 - DNA, 201 bp, synthetic construct
  misc_feature 1..201: note = Description of Artificial Sequence: Synthetic polynucleotide
  source 1..201: mol_type = other DNA
agttagtggaatyggagggggatttyggaggaatttgtttttgatgtttyggttttttggttttttattagaattygtagaggattygttttggagttttygtgygttttggtagaggtyggggaygttagagtgtaygtagttttttgygygtygagtttaggtttygggygtagggaggatygggttgagagtagggtg

SEQ ID NO: 3641 - DNA, 247 bp, synthetic construct
  misc_feature 1..247: note = Description of Artificial Sequence: Synthetic polynucleotide
  source 1..247: mol_type = other DNA
gtaagggtygggagtttggttttttatgaagttgttttaggtygggattagttttagtttygayggtygttgyggtttygtttyggtagtttygtgagttygyggaggagtttygtattygatygtgtatagygatygagttggygyggttygtatgaagygaagygtyggttttagtagygtagtttgagtaggggattygygtggtaattagggttgygygygagttyggggygattgtggyggt

SEQ ID NO: 3642 - DNA, 201 bp, synthetic construct
  misc_feature 1..201: note = Description of Artificial Sequence: Synthetic polynucleotide
  source 1..201: mol_type = other DNA
ttttygygygtagttygygtagygtttagagtyggayggygtttttyggtggyggyggaggagttyggagggaygtagtygggtaaggtagggygtagggygggyggygygaggygtagggygyggygggtagaggttatttggttattttttttggygttyggggaaggtgyggygatggtyggggygygyggggyggyg

SEQ ID NO: 3643 - DNA, 201 bp, synthetic construct
  misc_feature 1..201: note = Description of Artificial Sequence: Synthetic polynucleotide
  source 1..201: mol_type = other DNA
ygttaggttygttttygttyggtygttygttygttyggtgggtygyggtggtygygggttgygttgygygggtygggtttggygggtygggggttgygygygttygygagggygttygaygygggttgaggggygttggygtgtgttygtaggyggttttgygygggggayggygygtttttggatatygtyggttttaag

SEQ ID NO: 3644 - DNA, 201 bp, synthetic construct
  misc_feature 1..201: note = Description of Artificial Sequence: Synthetic polynucleotide
  source 1..201: mol_type = other DNA
ttttygagtttygygattttttygtttatyggggaaggagattttagygtygttgttttgttttttttgaaygttgtttttgttygatttggagtygtygygggagygttttatgttgyggaaatattgtttttagygttgtyggtyggygtttttttttagttttttttttttggttyggyggttttggaattaaatttg

SEQ ID NO: 3645 - DNA, 356 bp, synthetic construct
  misc_feature 1..356: note = Description of Artificial Sequence: Synthetic polynucleotide
  source 1..356: mol_type = other DNA
aatayggagtaygaatataagtaggtatygtatatttgygagttattygggttttygggggaaggtaaaaagttttaataagttttaagtaagattaggaygtttttatagttttgttttgatagttaaggaaaaaatttgttaaaaattagaggygttgttgagtgttggygtgggaatgttagtttagttagagttttgttttgggttatttaaataaaaatagatatgttggtggtaaatgttagttgaataygtaggagagyggtgtttttygggttyggagaagggtttgtagttgtatttttttttttttttttttttggtttttttagtttttttattattaygattag

SEQ ID NO: 3646 - DNA, 201 bp, synthetic construct
  misc_feature 1..201: note = Description of Artificial Sequence: Synthetic polynucleotide
  source 1..201: mol_type = other DNA
ttaaygtttgtttttattttaagttttgttatagttgttatatttattattgttygygtttgtgtygtygygaggattgggaygtttataaggygygttgygtgtayggtygygtgggtagygtgtgtygttaygtattgtagttttgtygygatagyggttyggtgtatygygttttttygygtatygygygtgtyggtt

SEQ ID NO: 3647 - DNA, 281 bp, synthetic construct
  misc_feature 1..281: note = Description of Artificial Sequence: Synthetic polynucleotide
  source 1..281: mol_type = other DNA
agtttygtgygtyggtttttgtttygttagtttygttatggttttttatttattttygygggagygtttttgtttttttattttgtattttttttagagtygygygttagtttttygtttygtggaagygtttttttttygatttyggttgattttygttygtygtttttttygygggtgygygttyggtttttttttygttyggggygggtttgygtgggyggtgtttygggtyggygggyggagtttyggttttttagttttgygtttyggtggagttc

SEQ ID NO: 3648 - DNA, 222 bp, synthetic construct
  misc_feature 1..222: note = Description of Artificial Sequence: Synthetic polynucleotide
  source 1..222: mol_type = other DNA
gtttaggttatatattagattttattggggatgtgagaagggtgtagygggygtgaggtttygttttygtygttttttgttygtttttagattygyggttygtttggtygttttatttggtygatggygttggtggtgagtataggaaggttattatagttttaatttttgaggtaatggttgaagttyggyggggygaagtygttgtaygaggggtyggta

SEQ ID NO: 3649 - DNA, 237 bp, synthetic construct
  misc_feature 1..237: note = Description of Artificial Sequence: Synthetic polynucleotide
  source 1..237: mol_type = other DNA
ygggtttggattaggayggygaggygggtyggygygygygygaggtggtttttatttatatttagygygagttgyggttgygyggygtttttttgygttaygagttttygygygtttaygagtagttttgygagttygtygaggttaataggygttttaygtttattattatttattttayggatyggygtatyggtygtttttttatgtgtatgattatggtygttttygagtygc

SEQ ID NO: 3650 - DNA, 201 bp, synthetic construct
  misc_feature 1..201: note = Description of Artificial Sequence: Synthetic polynucleotide
  source 1..201: mol_type = other DNA
tttggttttttaatttagtagtgtttttgaatgaaygtgtgatagtttaatgaagtagtygagtattttgatttgaatgttggagtyggggtttatagggggttgtattagttagtataggttgggttatgttattgtgataaagagttttagattttaaatttygtttttgtgggttagttgaggtttttgttttaggtt

SEQ ID NO: 3651 - DNA, 364 bp, synthetic construct
  misc_feature 1..364: note = Description of Artificial Sequence: Synthetic polynucleotide
  source 1..364: mol_type = other DNA
gttttattagtttttyggtygagyggaaggygtyggygtttagttgggttaagttgttgtagttgaggtygaggaataygagtttggtygagtygttgaaygtgtttttttttagygagygtagygagttgtttttgaagtttaggtagattaggtygtygtagaagatgaagaagttttyggggattygttggatgyggttgtyggttattagtagtttgygtaygtttagggggaaagggtttggtaygttgggtagttygyggtygyggtagtttayggtgtgygggtyggtgtaggygtagttygyggggtaygygtgttygggygygagtagtagtagaaggttgtagagttygagygt

SEQ ID NO: 3652 - DNA, 201 bp, synthetic construct
  misc_feature 1..201: note = Description of Artificial Sequence: Synthetic polynucleotide
  source 1..201: mol_type = other DNA
gaaattaattygttagaaaaattttttgggagaggygggagyggtaggggtggtygagtggtygtygttaaaaygyggttttattttggtagttgattttygagatttggtagtaagaygtygygygtatygggygggttgtattygaygtttaagtttagttattaagtttaggagyggtttttttaaggygtgtttygg

SEQ ID NO: 3653 - DNA, 201 bp, synthetic construct
  misc_feature 1..201: note = Description of Artificial Sequence: Synthetic polynucleotide
  source 1..201: mol_type = other DNA
gygtttttttttggggtgggtagygtaggtttggtttgygggtggggggtggagagtgagaggtaygyggggtattagtttagtttttttttggggatttygtattygtagtttaaggaatyggtggagtaygaattttatttttgagttggygtaagygttttttttttatggagatttatttyggtttttttttgaggt

SEQ ID NO: 3654 - DNA, 201 bp, synthetic construct
  misc_feature 1..201: note = Description of Artificial Sequence: Synthetic polynucleotide
  source 1..201: mol_type = other DNA
aggaatyggygttgtyggtgtttgggggtyggggygygggygaagtygggtygyggaggatataataggtagagtygggggtgttyggtygygygtttttygygtattatgtagttttttgttatttttttygtttttaggttaaaattttgagtatgatggaagataataagtagttygygtttygtatygatggggygg

SEQ ID NO: 3655 - DNA, 222 bp, synthetic construct
  misc_feature 1..222: note = Description of Artificial Sequence: Synthetic polynucleotide
  source 1..222: mol_type = other DNA
tgygygygtgygtgtgtggygtgtgtttgggtgttttatgattgtttttygtgaggtygtgtgtgagtttttgygtgggtygtgagtgyggtagggagygyggtgttygggggtygtttgtyggtgtgtttgtgygtgtttgtgygttagtttttgtttttgygagtgygtatttttaggatygagtttgtttatatgagtttgtgtttgtgtgtgtgygtt

SEQ ID NO: 3656 - DNA, 201 bp, synthetic construct
  misc_feature 1..201: note = Description of Artificial Sequence: Synthetic polynucleotide
  source 1..201: mol_type = other DNA
gataataagatttgttattgaygttatygggttggtgatatttaggtatagtagttttagtaaaygaatatatttttatgagaattaagttttttgagagyggtaagttgttttgttttgtttatagttgataagaataygtttgtayggttatttagtatttagtattgttatttaatygttttattagtatgtatgaat

SEQ ID NO: 3657 - DNA, 265 bp, synthetic construct
  misc_feature 1..265: note = Description of Artificial Sequence: Synthetic polynucleotide
  source 1..265: mol_type = other DNA
aggygtataygaggagttyggtttagtatttttaaattagatttyggaggygtygttagggagyggttatygttgggygtygtygagygtgttyggggygyggtygtggygggttttttggggyggtagttttaggygygggygygtagtagtttygaaggygtygtttggtttagtygttyggttttygagygtygttgtaagtggggggygtttygyggygtygygtatattttattggggggtygtttygtyggygttygtt

SEQ ID NO: 3658 - DNA, 242 bp, synthetic construct
  misc_feature 1..242: note = Description of Artificial Sequence: Synthetic polynucleotide
  source 1..242: mol_type = other DNA
tygggttgttttygtygtttatyggagagggtygttygggtgtttggttttgttygaaagtttttgggtttttttttttttttgtaaaatttaaagtaatygaataaaaagagtttaggtygygygggygggttgygygttygygttttgtagygygtyggygggggttyggttygyggggttattgtattgagtygggtagtgtgtggtggtggtggtggtgtagygtygtyggygggggc

SEQ ID NO: 3659 - DNA, 201 bp, synthetic construct
  misc_feature 1..201: note = Description of Artificial Sequence: Synthetic polynucleotide
  source 1..201: mol_type = other DNA
ttttagggygtagggttaygagttttygtttttattttyggtttttggtattyggygtyggtttygtygtttttttttataygtatttttggtagggtttygyggggygttttaaagtttgggggtagtttttaggtgtttttgggaagggaaagaaaggttataaagtaaaagaaggagtaaagagaaggygagggagga

SEQ ID NO: 3660 - DNA, 261 bp, synthetic construct
  misc_feature 1..261: note = Description of Artificial Sequence: Synthetic polynucleotide
  source 1..261: mol_type = other DNA
tygtttatygatgagtygtygtygttygygttygggtgtaggtgygtygtygtygygtgtaggtygttygygtgtgtatgttygtgtgygtgttygtgggygtttagatgyggyggyggygayggttttagttgygtttygtggttattttygtgtagygygtggtgtaggttyggtttygygtygttatygttygtygttagtatttyggttaggtygtygtygtygtttttygggtaggtygtttgygygtatagttyg

SEQ ID NO: 3661 - DNA, 201 bp, synthetic construct
  misc_feature 1..201: note = Description of Artificial Sequence: Synthetic polynucleotide
  source 1..201: mol_type = other DNA
yggtgttttgggtygagtygtttggagattttagattagtatgtgggtgggaaagggygtttygttttgggttttttygtttttgygygtagagtagagaygygtagattygtttttatttygtttggtttttttggagtagtttyggyggyggtagygatgggttgggaggggtyggtaygttggtttgygygggttttt

SEQ ID NO: 3662 - DNA, 337 bp, synthetic construct
  misc_feature 1..337: note = Description of Artificial Sequence: Synthetic polynucleotide
  source 1..337: mol_type = other DNA
gaattggataataatgtggygtttgttattggttaggggaggtagayggygttttgattggtygggttygygttyggggagtttygtattttgtagtgttygaaagattygaaattttaaaagttttattgygtgtttttgggaggggagggggygygttaggaaaggagtggaaaaaagtgggygaggaggagygttgaaaattttttgataagtagttttygtgygttygagagygtgtgaattgtttttaattatygtgttyggtgygtttttttgygtagatttgtgtaatttttyggtttttggggygtyggttyggttgtatygtttttat

SEQ ID NO: 3663 - DNA, 201 bp, synthetic construct
  misc_feature 1..201: note = Description of Artificial Sequence: Synthetic polynucleotide
  source 1..201: mol_type = other DNA
tgaagttgttttttygggataggaagggttaaatggttgygygttaattyggtttygattggggtgttagggagtaagagtygtttgtttygggggatttygtttggggggtttttaggggtygttttggygtttyggttataatttgggyggttttgtgyggyggttttygtttgygtttttgygygttatttaaaattt

SEQ ID NO: 3664 - DNA, 201 bp, synthetic construct
  misc_feature 1..201: note = Description of Artificial Sequence: Synthetic polynucleotide
  source 1..201: mol_type = other DNA
tagtaggtagtgygggtatagtgttgtagattattatttygttaggttygggtagygtttattagayggataggygttygyggtygtttttatttyggygygtttatttygagttttttaygtygyggygggygggygtaatatatttttttatttttagtygtygaggattatatttttygtttagttttttygatttat

SEQ ID NO: 3665 - DNA, 201 bp, synthetic construct
  misc_feature 1..201: note = Description of Artificial Sequence: Synthetic polynucleotide
  source 1..201: mol_type = other DNA
ttttgaatygttatttgtttattattygggygttygttatttattaggygttgtattagaggygttatayggygggtatgttggygttgttttgggygttygttttgggtttygtgttgttgttttygttttgggtatygyggttyggygtygygttatygygagtttattattyggygttgttggtygtygyggygttgt

SEQ ID NO: 3666 - DNA, 201 bp, synthetic construct
  misc_feature 1..201: note = Description of Artificial Sequence: Synthetic polynucleotide
  source 1..201: mol_type = other DNA
gtttygtgygtttagttttgtygggygtyggygaygyggyggtygttgtygttgtygttatagtygtgttygtagtgttttaggygtaattgggtattygygtygygggttagtattggtaatttagtyggggttygagggaagyggagattttyggttttygaygtttttgggtatygtygttttttttttttttagggt

SEQ ID NO: 3667 - DNA, 386 bp, synthetic construct
  misc_feature 1..386: note = Description of Artificial Sequence: Synthetic polynucleotide
  source 1..386: mol_type = other DNA
tgtttgttgaaaaataatattgtgattatttttagyggygaagggtgtgtttgggaayggtttggggaggggatagaagagagaggggtgggatggayggyggtagaagtgggaggtataygaggagttattggaaayggygtttttgtggaggagtygggggggatggggagtagagggagggggttttgttgttttagygtttygaggtygtggagyggtagtagttgtagtyggagtagtattagtaatagtaatagtgagygggayggagttaggatygttyggagygtataggtttygaggtagtataaggtttgttatttttttatttgttggtagttgtagaagaagatttgttttttaagtgaaaygtatatgttatt

SEQ ID NO: 3668 - DNA, 201 bp, synthetic construct
  misc_feature 1..201: note = Description of Artificial Sequence: Synthetic polynucleotide
  source 1..201: mol_type = other DNA
aggttatataggggtygggtgtaggttttaygyggaaaggygygtagtgttyggggtttatgtyggtttagggygtataggttttyggggtttyggggttygygttgttygygtygtttgtgagygttygttaagggggagggatttgggygygggggygyggagttttygggagyggygygygtygyggggggygggggg

SEQ ID NO: 3669 - DNA, 201 bp, synthetic construct
  misc_feature 1..201: note = Description of Artificial Sequence: Synthetic polynucleotide
  source 1..201: mol_type = other DNA
tgttagggygtagggagggyggtattyggttttagttttygtaatttygygygtttttttygtygtgggatttgggttttygygtygtttttttgagtttygagygygyggygggygggagttaggttgggattggtggtgaggtagggagtgaggagygagyggagtygygtgygtyggygygtagtttygggtygtttt

SEQ ID NO: 3670 - DNA, 309 bp, synthetic construct
  misc_feature 1..309: note = Description of Artificial Sequence: Synthetic polynucleotide
  source 1..309: mol_type = other DNA
tttgggtygyggyggtttttatttygttatygtygtygtygtygtayggttgttygtygygaataagtatyggtattattaygygaygtagtaggtygggygyggygtgtagttyggyggatgttgttaggttaggygatttygtygtttttggagygygagygygttttagtttgtagygatgattttggaattagattttgatttgygtgggygtgaggygaagtaggttygttagttgttygygttygggygtagataggtatygttgttgtyggaagygtygttttaattttagygtttgygttt

SEQ ID NO: 3671 - DNA, 203 bp, synthetic construct
  misc_feature 1..203: note = Description of Artificial Sequence: Synthetic polynucleotide
  source 1..203: mol_type = other DNA
tattttgttttyggtyggtgattygttgtggtttttaggttaagtgtttttygtgttygggyggttgaygttgtttgaagtttaygyggygtgtyggygaygyggygtygtggtggttaaggttgggtatttttaygtygtttggaagttttyggggttagattagtgygayggyggttggttggttgayggtagtgtgygtt

SEQ ID NO: 3672 - DNA, 388 bp, synthetic construct
  misc_feature 1..388: note = Description of Artificial Sequence: Synthetic polynucleotide
  source 1..388: mol_type = other DNA
atygggaagtagttyggtgttttaagttttttgagatttttyggatttgygygtygttygttyggtagggggttyggtaggygygggyggygggtgggggygggaggttttgttygttyggtggttgtygyggtttttttygygttgttttttaygtttggtttattatgtaygaggtaggtaatttgttttttttttyggggatttatttyggagataagaaggtagtttgttttttgtaatggtttttgttggagtgyggyggggtttaggygygagygggggtaygggyggggagttggtagygaaggatgygttyggygtttttyggyggtygttyggagttygaggtyggygygggaggagygttgatttygygggtygagtt

SEQ ID NO: 3673 - DNA, 241 bp, synthetic construct
  misc_feature 1..241: note = Description of Artificial Sequence: Synthetic polynucleotide
  source 1..241: mol_type = other DNA
gagggyggygygtagyggygtttygygaggtttttaygtygggygatatggggtgtttgttgtttttgttgttttgggygtttttttaggtttggggaagygttgaaggtgggtggaaygagggygtttgagtgtattygygggagggyggagagagggagttgggtagggayggggagggtaaygtttgatggggattggtgagattygggaygtattggygygatttaggtagaaaatt

SEQ ID NO: 3674 - DNA, 232 bp, synthetic construct
  misc_feature 1..232: note = Description of Artificial Sequence: Synthetic polynucleotide
  source 1..232: mol_type = other DNA
gggttttttatttgtatttttttataaaattgtygttygtgtgtgtttttgygtttggttttttgtatttttaaggggtttttgaagatagggtygaatgygygygggggttttaggtattttgygttttayggygggtttygtagttyggttygagtyggttttggaagtttygttttggattagattggtatygaygtygtttttagtttgagygttgagagggaaaayg

SEQ ID NO: 3675 - DNA, 214 bp, synthetic construct
  misc_feature 1..214: note = Description of Artificial Sequence: Synthetic polynucleotide
  source 1..214: mol_type = other DNA
gaattttttttagtgtygtaattaggaaagttttaaaaagtaaggattttagatagataagagatttatttttttttttagtataagaaatatttygygtygygttagtygaaygttgttygtataaggttattygttttttttggtygggaygtattyggtgttttttagttttttattagaattggtttagggggygyggaaatagagaggt

SEQ ID NO: 3676 - DNA, 250 bp, synthetic construct
  misc_feature 1..250: note = Description of Artificial Sequence: Synthetic polynucleotide
  source 1..250: mol_type = other DNA
agtagggattagttggtygtyggtttttygggtaagatggggaatygggagatggaggagttgatttygttggtgaatygtttgtaggaygygttttyggygttgggatagagttgtttgttggagttgtygtagatygtygtggtgggyggttagagygtyggtaagagttyggtgttygagaatttygtgggtaggtaagygygtagggygyggagtaaggatgyggtagtggggygatttygttgyg

SEQ ID NO: 3677 - DNA, 201 bp, synthetic construct
  misc_feature 1..201: note = Description of Artificial Sequence: Synthetic polynucleotide
  source 1..201: mol_type = other DNA
ttaggattttgtagattyggtygyggtygggtygagtgtttttygtyggggttttaygtttayggtttaygtttgtaatattagggttgtayggygggttygtagttgggtttgygtttgggattyggggttttttgygtttttygtgtygtattttttgttttaattttaagyggaygggttttggggttttatyggtta

SEQ ID NO: 3678 - DNA, 467 bp, synthetic construct
  misc_feature 1..467: note = Description of Artificial Sequence: Synthetic polynucleotide
  source 1..467: mol_type = other DNA
tygtttttttttaygttttttttttygttttttttygygtttagtttygttttttttattttgtaaaataaagtyggggaaaatgtttgttygtgtagttyggagygygtagttygtttttgaataagaagtgagtataatggygtgtttgtaaaaaaaagttttaagttygttttttttaaaaaatattttgaatgttgtatgttttatgttttttagygtttygygggagagattyggttatagagtaggaggtgagatttttttttyggtatttttatttttttggtygtaygtttttttgttttagttttttttgggaggattgtaaatgtttttttttagtaagyggtygttttttattttygtttygygtttaaagtgttgggttataatttggatttggaggtaaatttttgttagattttttttaygtygttttttttttttttttygtyggtgttygg

SEQ ID NO: 3679 - DNA, 201 bp, synthetic construct
  misc_feature 1..201: note = Description of Artificial Sequence: Synthetic polynucleotide
  source 1..201: mol_type = other DNA
ttygaggggtttatagtttggtattaatttgtaggtgttygttgttgatttggtttttttttygatttgyggayggttttttttagygattttygatataygtttttttgttttygtyggagggtygggtttggggtygtyggagtttgygggaatttagygtttattygttgattttygagtygtttygttagttgtgyg

SEQ ID NO: 3680 - DNA, 232 bp, synthetic construct
  misc_feature 1..232: note = Description of Artificial Sequence: Synthetic polynucleotide
  source 1..232: mol_type = other DNA
ttggggtgtttttaggaagtgaaggaaaaggttttygaygatattgttattggaaaagtgttggttayggttttygttttattttttttatttaygggttyggagtttttaggagtagttagatygattatygtttttgtagttttatttgttttyggagagatatttataagttagtttayggagagtttggattygttygttttagtatttaygtttttttygygttygg

SEQ ID NO: 3681 - DNA, 222 bp, synthetic construct
  misc_feature 1..222: note = Description of Artificial Sequence: Synthetic polynucleotide
  source 1..222: mol_type = other DNA
ggttagggatagtaaaggagataygggtgggtgagaygtyggattttaygagggtttgttgtttttttggygygggygtggaggtattggttagagggtaygtttattagttygagattttygggatgaggttattttttgagtttatatttggatatttattttttygaatgyggtgattttatttatattatagyggttattagygggtttgagatygtg

SEQ ID NO: 3682 - DNA, 239 bp, synthetic construct
  misc_feature 1..239: note = Description of Artificial Sequence: Synthetic polynucleotide
  source 1..239: mol_type = other DNA
ggtttttaggyggagygygggygygaggtgygggtttyggggyggagygtaygttygggaggygggaagtgggtagtagygttttygtttggtttttgtgygtttygattygaygttttttygttygattaggtgtttygagagygtatagttgggagggttttttyggtygyggygagatttaygtttgyggtgtgttagggyggyggygayggtgaygggygtggggygyggygttg

SEQ ID NO: 3683 - DNA, 209 bp, synthetic construct
  misc_feature 1..209: note = Description of Artificial Sequence: Synthetic polynucleotide
  source 1..209: mol_type = other DNA
ygtttygggggtttttgtattttagtyggggaatgttgttattttgaggggggttgtttggttgyggggygtyggggttgggggtattgtttttttaggaygyggtttygtagtgtagagygtygtygtttgygtggggggatttggtagttttaggggttgttttgagttttttggygagtaggagtgagttgttgyggygagtgagt

SEQ ID NO: 3684 - DNA, 380 bp, synthetic construct
  misc_feature 1..380: note = Description of Artificial Sequence: Synthetic polynucleotide
  source 1..380: mol_type = other DNA
gaggtygggtttyggygattttygagggaggttygggaattattttygatttaggygttagattyggagtygtayggggtttttagtttagtttygygagyggttgttgatygtttttttygygttygttagggtttttgtttygygttagttatygygygttttttttttgtttatgtygtagttttygtggtttttgttttggattygggatgttaggttgagataygttttgtaaatttttggtagaaatgggygtaagggggtggatttygttttygtttttygggtttttttttttttttygtttatatgtttttttattattttttttttttttttttattgtattttgatgaaatggttttgtttgtttaaat

SEQ ID NO: 3685 - DNA, 394 bp, synthetic construct
  misc_feature 1..394: note = Description of Artificial Sequence: Synthetic polynucleotide
  source 1..394: mol_type = other DNA
ygggtyggtagggattaagagtttgaaagggaatttgttttttttttttygtagttyggttattaaggtaagaaattgtaggtagagaagttttygaattygatttaggaygtyggygtttgttaggattttttygtttgtttttygygtttygygygygtttatgttattattayggggagggtgtatgyggtaggtgtttggtygaggttttygggagygagtygtttttaygtgttttagtttgtttttttttygaagttagaygttggygttgtagttttgttgtttgaygttgttgtagaagttygygtttattygggttaggtttggggagggttttttggggyggtttttgagttttatttgttygaagtttttatggggggaggtc

SEQ ID NO: 3686 - DNA, 201 bp, synthetic construct
  misc_feature 1..201: note = Description of Artificial Sequence: Synthetic polynucleotide
  source 1..201: mol_type = other DNA
tttygttygggttttttaaatatgtygtagygtggttgtttattgttttttttgggtaagaggaggttttagatatttttaygggatttgaattttygagygttttgtayggagtagttatttygttagtattttaaagtgaagttgtttataayggataagttyggagattttatgagaggtyggggtggagaagtyggg

SEQ ID NO: 3687 - DNA, 557 bp, synthetic construct
  misc_feature 1..557: note = Description of Artificial Sequence: Synthetic polynucleotide
  source 1..557: mol_type = other DNA
gtygttatygtttagtttygttgtttaggtgggaggggttatttgtygyggggtttttaagttagtgtygtttgttttyggtttttatttattgatagtayggygttygagtgattttgtttagtttygttttgygtttttgtaaattaygttgttgygttaattataaatttggttaatatgtttttgtaattttattatttaaaaaygtttttaggtatttggtygttgttagattaggttygygggttyggaggaggtttttttatttgttttygttagtttyggggatygtgygyggttttygtgtggttttygtttaygaggtttttygggtaggaatygtygygygatttttgtttagyggtygygttttggttaygggygatttttgtygggaattttgttttyggttaagttgygttttygtatttyggtggtttttattygagttygygtttgttggttttttttttggtttttttgtttgatttygattttgttttygaattttatttttagatttttttygttttggaaygtygatttttttttyg

SEQ ID NO: 3688 - DNA, 212 bp, synthetic construct
  misc_feature 1..212: note = Description of Artificial Sequence: Synthetic polynucleotide
  source 1..212: mol_type = other DNA
agttgggtttttttttattttaaaatttttatttttagtttttaaaagttattttagttygttatattgaaattggtayggtttttaaagatttttttttygtagttgtggygtttttaagaaaataygagtayggattaggttttggatgagtgttyggttatygagaattagttattttttattttttaggattttttagttttttttag

SEQ ID NO: 3689 - DNA, 201 bp, synthetic construct
  misc_feature 1..201: note = Description of Artificial Sequence: Synthetic polynucleotide
  source 1..201: mol_type = other DNA
tttttaatggtttagtygatygtgtgtataaatttgygttttattygtyggggatygttgggagyggagataaatttaatttttagggtaattttggtttygttygttttattttattttgtgtttaaatagagttttttttgaagttgygaatatttttaggttttttgggtagggttggaggggtygaggagagttatt

SEQ ID NO: 3690 - DNA, 201 bp, synthetic construct
  misc_feature 1..201: note = Description of Artificial Sequence: Synthetic polynucleotide
  source 1..201: mol_type = other DNA
ttttggataataatgygygttttygtttttttagaaagttagggaygtttttagtygtygttagagttggttyggttttttagttttttttygtggtattygtaggygagataaagttygttttyggtgaggttgygygygtttaaagygtgygggatgtttagtayggaggtttttaagygggggatttttggttttttt

SEQ ID NO: 3691 - DNA, 294 bp, synthetic construct
  misc_feature 1..294: note = Description of Artificial Sequence: Synthetic polynucleotide
  source 1..294: mol_type = other DNA
ggtagatgaygattygtygagttygtygtttgttttttyggaggygttyggagttgttgygggtttyggtygtygttgttattgttgttgtygtygtygtygtgyggggttatttgaaggttggggygyggaagtttaatttygtgttgattgggttttaagttttttgygttttygtttygtttygagtgttygygaatttttyggaygtttaygtagattatttagttatattataattttgtttgyggagagaggagaggagaaaaaggggtygttttaaaaatttttaaa

SEQ ID NO: 3692 - DNA, 244 bp, synthetic construct
  misc_feature 1..244: note = Description of Artificial Sequence: Synthetic polynucleotide
  source 1..244: mol_type = other DNA
tagttttgagtyggttgtyggttaggtgttgggtatattygygtygtygtygtygttygtttttggtygygttagtygtagggttttyggygttygggggyggtagtaggttggagygtatygtgygygttttgttttttyggygttttygtygtttyggaggttygggtttttyggttttygtyggttttygttttatggtygygtgtygtygygttyggttttttygtygtttaygttygtt

SEQ ID NO: 3693 - DNA, 303 bp, synthetic construct
  misc_feature 1..303: note = Description of Artificial Sequence: Synthetic polynucleotide
  source 1..303: mol_type = other DNA
ggtttggggttatgggaataggattaaggttttttgagygtygggtttggtttttgtggtttygtaaattttttagtttgtgtgttayggygaygygtagyggttgagtyggagtttaygyggygygygtttttygygaggaatttttyggtttgtaggttgtttgttattttygtttttygaygygtttttttttggttygygttttyggagttttttttttttttggygaggatttttttyggygttygyggtttygattttygtygygttgygttygttttttyggtttyggttgtttyg

SEQ ID NO: 3694 - DNA, 286 bp, synthetic construct
  misc_feature 1..286: note = Description of Artificial Sequence: Synthetic polynucleotide
  source 1..286: mol_type = other DNA
aatagattttygagttgaaaaaataaaaataaattggggagttagagtttttgaaagtttyggtaggaaatttaatgggttttttgtttttttaaattttygttttygttttygttgatattttgtaaagtygyggyggtagyggyggggattaygttgyggtgtattatttttygttattttttygygttgggttggggtygagggggtttygtagagtyggtaatygaatyggttttggtttgttttttttattttttagttattattagaattagttttygyg

SEQ ID NO: 3695 - DNA, 261 bp, synthetic construct
  misc_feature 1..261: note = Description of Artificial Sequence: Synthetic polynucleotide
  source 1..261: mol_type = other DNA
tggttgtggaattagatttgttttgaatttagtggagygtatygttggggttyggaagttatygttygygggtatygggttggygttgttygagtggaatygatagtttgygagtttyggttgtaagtggtttttttttttygyggttgttgtttagtgtygggtgagggttgygagtgtggtaagttgtaaagagagttttagaggttygaagagygttgygtttttattygygttygttttttttttttttyggttttt

SEQ ID NO: 3696 - DNA, 201 bp, synthetic construct
  misc_feature 1..201: note = Description of Artificial Sequence: Synthetic polynucleotide
  source 1..201: mol_type = other DNA
gaaygygtagagagttttttggagtgttttgattttgttttygagagggtttttaattttygtatttttttagtggttgttttggtaggtgygygttttgyggggagttgygtttygggggttatygtygagygggagttgttttttggaattttgtttatygygaattgggtgtttattttttatttttgttttttagtg

SEQ ID NO: 3697 - DNA, 201 bp, synthetic construct
  misc_feature 1..201: note = Description of Artificial Sequence: Synthetic polynucleotide
  source 1..201: mol_type = other DNA
tygygttttagtatygagtgttttaagttttgygygtagygtygggtttggaaggyggygaatggttgtttagtygtygtttttattagtgatattyggtygttagttttygtttaggatgtgtatatttgttggtagtattggttygggtggtagttatygggttatttattttataggtataatygtatttaatttaat

SEQ ID NO: 3698 - DNA, 201 bp, synthetic construct
  misc_feature 1..201: note = Description of Artificial Sequence: Synthetic polynucleotide
  source 1..201: mol_type = other DNA
gygtttygggaagtgtatggttttaaggtttaaggygttaggatttaggtttttagagtttttaattagtgttattttttttygtagygygggtgttagtygygagttygtagtttttygatattygtttttttttggggttttyggggatttttttagaggttgtaaaggtgttagaagtttaaggtaggaggtagtttg

SEQ ID NO: 3699 - DNA, 201 bp, synthetic construct
  misc_feature 1..201: note = Description of Artificial Sequence: Synthetic polynucleotide
  source 1..201: mol_type = other DNA
tyggygtygtygttgtygttygggtttygygattygggtygggttgtgggygygyggtaggygggttgyggyggyggygggayggggyggtygygggttgygtggggtttgtgygygygtgtgygygggygtyggttgtgygygtygygggyggatagggttyggtyggyggyggtaaagttgggattygygggtygggyg

SEQ ID NO: 3700 - DNA, 201 bp, synthetic construct
  misc_feature 1..201: note = Description of Artificial Sequence: Synthetic polynucleotide
  source 1..201: mol_type = other DNA
tgtttyggttgatttygttttgtagttagtttgaggttaggyggtygttttttgtaggttataaattttyggygtaaaagtagggttttgaaygygatatygtattagagygtttagttaagygagttgtttttatttttattgtgtygggyggygtaaattgygggygtaggtagaggagtygyggttttgygtygggyg

SEQ ID NO: 3701 - DNA, 201 bp, synthetic construct
  misc_feature 1..201: note = Description of Artificial Sequence: Synthetic polynucleotide
  source 1..201: mol_type = other DNA
ttgyggaggggtyggtgggttagagttaggttaggtagttgttgagtttttttttttttttttggygggagtgtgtgtgtaaggggttagggggyggagtyggagaaagggttgggggtgttygtgtttagygttttttyggaygyggttttataatttagttgygagaatagatggaygtagyggyggtttatttygggg

SEQ ID NO: 3702 - DNA, 201 bp, synthetic construct
  misc_feature 1..201: note = Description of Artificial Sequence: Synthetic polynucleotide
  source 1..201: mol_type = other DNA
ygyggtttttygtgggttggtygggttaatgagygygyggttgtaggggyggygggyggggagggggygtygagttttgyggatggaggygygggtagygyggygygtttatttygygygggygttgttggyggggggyggygtagttattggattyggatyggggtygygattyggggtggygggtggygtgggyggygt

SEQ ID NO: 3703 - DNA, 201 bp, synthetic construct
  misc_feature 1..201: note = Description of Artificial Sequence: Synthetic polynucleotide
  source 1..201: mol_type = other DNA
ttygtygatttttagaggtatyggttgygttttttggtggtttggaayggygyggagggtaagtttgttgtgatttgttaygatygtatygygtagtagtygtagyggygygagggggttyggttggggttggagtataagttygaggtygtygtgttttygtttagttgggtyggtyggttttyggtygyggggtttygc

SEQ ID NO: 3704 - DNA, 344 bp, synthetic construct
  misc_feature 1..344: note = Description of Artificial Sequence: Synthetic polynucleotide
  source 1..344: mol_type = other DNA
gtyggttagagggtttaygtaagtttygaaattyggggggaygttttttttatttttatttttgygttygttyggggttgggygygtyggggygtaygtaygtyggtttgttggygatttggygtatttgttygygygttttggttttagttgtygtaggttttttttgtatttatttttagtttttaaagttagtgtagttagtatygtttatttggagttttaatttttttttgygattttygtatatttattgtattttatttattattttygggtygygtaggttygggtttgygaagataygyggtttattttyggttatttygtttatttggttaaag

SEQ ID NO: 3705 - DNA, 201 bp, synthetic construct
  misc_feature 1..201: note = Description of Artificial Sequence: Synthetic polynucleotide
  source 1..201: mol_type = other DNA
attttttttygyggygttttttygygtagtttttagattgtttagtyggtgttygygggygttygttttttgygagttttaggttygygygagttgtttgygggaggggtyggggatayggatagaygttgttttattagggattyggaggatttggtgggtaagagtatgatttagygattttygtttygggtaagygtt

SEQ ID NO: 3706 - DNA, 218 bp, synthetic construct
  misc_feature 1..218: note = Description of Artificial Sequence: Synthetic polynucleotide
  source 1..218: mol_type = other DNA
attatttttttttttgtttaaaggattttttttttttttttgattttaygaatttatttttttaataggtttttaaagtatgggyggatgtgttttttttygtttatygttaggagtygagtttyggtaggtgagyggtgtaaaataygtatttagttgtttttagtttttttygttttygttgagttggttgtttttatttygtattayggtattyg

SEQ ID NO: 3707 - DNA, 234 bp, synthetic construct
  misc_feature 1..234: note = Description of Artificial Sequence: Synthetic polynucleotide
  source 1..234: mol_type = other DNA
gygygtttygtgygttttygtttttygygygttttyggtttattttygtttttggagagttgtygtttgygttygggygygyggttggttgttttttyggyggyggyggyggyggttttattagyggagttttygtttatgattggtttygttygggaagttggagaygggygatgaataattgatgtgtgyggtgyggtagtyggayggyggyggyggtggygggtagtagyg

SEQ ID NO: 3708 - DNA, 201 bp, synthetic construct
  misc_feature 1..201: note = Description of Artificial Sequence: Synthetic polynucleotide
  source 1..201: mol_type = other DNA
ygggggtattygggtaggggtgttagatatagtattgtatttggtaatttttyggggygtttagtgtggtttttttattygggagtttggaagggtttttygtagttygtaggagaygtagygtttttygtttagggggagtaggaggatagttggtygttttygggagttttaggygygaagyggttttttttygtttta

SEQ ID NO: 3709 - DNA, 201 bp, synthetic construct
  misc_feature 1..201: note = Description of Artificial Sequence: Synthetic polynucleotide
  source 1..201: mol_type = other DNA
agttatagtagtygtatttttygtagygygtyggygtttagtgtagygtttttagtagtagygttagygyggtygttygtaygttttttttygtygtygtygttygtatggttgygttttttttaggtgygygtygygtagtttttygaygttyggtgttyggyggtttaggtgtttyggygtgygttttyggttttgatt

SEQ ID NO: 3710 - DNA, 235 bp, synthetic construct
  misc_feature 1..235: note = Description of Artificial Sequence: Synthetic polynucleotide
  source 1..235: mol_type = other DNA
tttygyggtttgggggaygggagaatggggggtttayggtygttttgggtttttatygygtatygygttygtagyggagtttyggagttatggttttgagygagttggygttggttygttggttgtaggagagtygtygttygyggaagtttattttgtttatygtgtttttggygttgttgttggataatatgttgtttattgtygtgggtaygtgyggatagggtatttttgt

SEQ ID NO: 3711 - DNA, 201 bp, synthetic construct
  misc_feature 1..201: note = Description of Artificial Sequence: Synthetic polynucleotide
  source 1..201: mol_type = other DNA
attygtttattttttatttttggtttatttatygttatygatatttgggttatygtttttaaggtaygtgttaygtygyggaattgtagygygtygttttygtygtattttttattgttttyggtttgtttygggtgggygtttggtaaggtttgggyggaggttttttyggttygygggttagygygttttgttgggaaa

SEQ ID NO: 3712 - DNA, 241 bp, synthetic construct
  misc_feature 1..241: note = Description of Artificial Sequence: Synthetic polynucleotide
  source 1..241: mol_type = other DNA
gttaataaygggygggtttttatagttygaagttaaagygttaaaattygagggaaggygaggagggggyggtggyggaggyggttgyggggtyggggttyggttgagttttygtttgtttaattttatttgttattgtaygygtttaatygtygtatatttttygtatttaatttggatgatattttgattttattattagtattyggygtyggattgaygtagtttygagtyggggatt

SEQ ID NO: 3713 - DNA, 201 bp, synthetic construct
  misc_feature 1..201: note = Description of Artificial Sequence: Synthetic polynucleotide
  source 1..201: mol_type = other DNA
ggggtatttgtatyggggttgggygggygtatttagagttaggygggtaggaatttttgygtagttattyggtgtttgtatgtttttggygyggaagggaygttttattagtttyggygttttttttttttagatttttttttygtttttttttattgtttgtttgttgtattattttttatttagattatttagatygtt

SEQ ID NO: 3714 - DNA, 201 bp, synthetic construct
  misc_feature 1..201: note = Description of Artificial Sequence: Synthetic polynucleotide
  source 1..201: mol_type = other DNA
ggtyggygygygtgggtttyggygaggyggygttgtaggagttttgygggtagttggagygttatttgggygyggyggtttayggttgtggyggygttatygtgygygaygtttttttygyggttaagggtygygyggtygattgygagagttygygygagtttygggagygggttttgygygtttgatgggtygaggygg

SEQ ID NO: 3715 - DNA, 217 bp, synthetic construct
  misc_feature 1..217: note = Description of Artificial Sequence: Synthetic polynucleotide
  source 1..217: mol_type = other DNA
tyggyggygagygttgtattattttaygygggygtygagtyggggtygggygtygygatyggagggattttttgtttyggygagttagtttyggagttttygygtagygttygygtygtygttgagtttttttagttttttatttttaaaaaagttttttttygtgtgtgtgygtgygtgygygygygygygtygttttggtataagttagttttga

SEQ ID NO: 3716 - DNA, 201 bp, synthetic construct
  misc_feature 1..201: note = Description of Artificial Sequence: Synthetic polynucleotide
  source 1..201: mol_type = other DNA
tagggtttygatttttygtggggtaygygygatttyggygtagatgttagttygttgtttttygggttgagggagygaggattttagaygattttagggtygttgtttaggtttagtttygygttttttatttygttatttygttttgyggttttagtttggagatttayggattttattgygattttttgygtagtgtag

SEQ ID NO: 3717 - DNA, 201 bp, synthetic construct
  misc_feature 1..201: note = Description of Artificial Sequence: Synthetic polynucleotide
  source 1..201: mol_type = other DNA
taaatgggttaaataggttygtaaggttttygygggttttttggttyggaagttgagtygygggtgtttggtttgaagtttygygttttatagtggttygygggtttyggyggtttttgttttaygttttttaaggtattaggtaggtggttttagggtttttgtttaygatattttttgggtggggtaggattatttttt

SEQ ID NO: 3718 - DNA, 201 bp, synthetic construct
  misc_feature 1..201: note = Description of Artificial Sequence: Synthetic polynucleotide
  source 1..201: mol_type = other DNA
tgtagttygttyggyggygttttygggygagggtttggtgttggggagygagygyggagygaggtgtttttttaaataygttttgtagtgtgayggyggtygttyggttggaagagttatttttattttgyggtaggagttygttygtygttatygttygtttyggtttttatggttaygygtttgttttyggtttygggt

SEQ ID NO: 3719 - DNA, 317 bp, synthetic construct
  misc_feature 1..317: note = Description of Artificial Sequence: Synthetic polynucleotide
  source 1..317: mol_type = other DNA
ygygttttgttattaggygttgtagttgttggtygagttttgtgttygtggggttttggagtaygatagttgttaggattttatttattatttgygggatygtgttagatttyggtttygygatttaggtgagtgtygttatygtygtttggagggatttaagggttttgggttgggatttggggtygtatyggggtttgaggtagaatagygaygyggattgggagagggyggggggyggttatygagttaggagagtgattaagaattagygtattgtggtttgatgttgtaattaggyggggattygggyggtg

SEQ ID NO: 3720 - DNA, 221 bp, synthetic construct
  misc_feature 1..221: note = Description of Artificial Sequence: Synthetic polynucleotide
  source 1..221: mol_type = other DNA
tttgtattgtggagtaygttatgattgtttayggtggtygtaggtgtagaygttagtyggaatyggaatyggaatyggagtaygggttgtygttttygatygaatygygggyggygyggayggygtygygygagggataaggtgygygaggygtaygtatttttatttttattgtygggagttgatttgtttttttygygtggttattygtygttgtaaat

SEQ ID NO: 3721 - DNA, 201 bp, synthetic construct
  misc_feature 1..201: note = Description of Artificial Sequence: Synthetic polynucleotide
  source 1..201: mol_type = other DNA
tygagagttttgyggygttygtttttttgttggyggaygtgttttttgagtygttttygygtaggtaagaggttgtygtttttagygagggagagagtagyggygattttatttagttatyggaygtygtttygtagtgttttgygggtgygaattttaattygatatattaggtgttttgaggggatggtggtygtttat

SEQ ID NO: 3722 - DNA, 201 bp, synthetic construct
  misc_feature 1..201: note = Description of Artificial Sequence: Synthetic polynucleotide
  source 1..201: mol_type = other DNA
gtaggggagagygagtatgtttttgtttygggygtygtgyggtygtagtagtagygyggttttttttagtgygagtygtgtttggaatgtttygggtaagygaagggttagtaagygaggygaaayggatattataaagtagagagtggtgtgagttttttygttttttgaaaagatggtaagttttygtttygggaaggt

SEQ ID NO: 3723 - DNA, 201 bp, synthetic construct
  misc_feature 1..201: note = Description of Artificial Sequence: Synthetic polynucleotide
  source 1..201: mol_type = other DNA
gagttttaygtygtygtygtygygttagyggtggggggygggttgggggyggggyggtyggggttgttttttygggygtatatgygagygtagtattyggygttgtygagttatttttttygtygttygttagtaagtttggyggttttaagttaggygygttttaggatttaggtttatttgtttttatttagtttyggt

SEQ ID NO: 3724 - DNA, 201 bp, synthetic construct
  misc_feature 1..201: note = Description of Artificial Sequence: Synthetic polynucleotide
  source 1..201: mol_type = other DNA
gggtatagttayggtaatttttagtttgttaatgttaaggygggygygtaaggtygtttaaatttagatttttttttttatttattttaaaaaataataaygtgttagttattttygtagatatygtyggttggtgtttgtttaggagaygttagggttagagygttatttttagtatygaaatggtagagagaaagygta

SEQ ID NO: 3725 - DNA, 230 bp, synthetic construct
  misc_feature 1..230: note = Description of Artificial Sequence: Synthetic polynucleotide
  source 1..230: mol_type = other DNA
tyggtgttttttttyggtygttttatttagtaatttttygtgttttgtttttygattggaaatgttttayggaagygttttggatagggttttygttaggygataagagttyggtgttgagatgtgttaygtttttatttttttattaattatggatggaaataaataaggaagagttaattttgttgagtttttttttyggtaaygagaggygttttgtagtygggagg

SEQ ID NO: 3726 - DNA, 201 bp, synthetic construct
  misc_feature 1..201: note = Description of Artificial Sequence: Synthetic polynucleotide
  source 1..201: mol_type = other DNA
gttttttygagttggtygtttttgtagatttttaygtttagttgttatagygtygtttygattttttygttaagtatattttgtattgtaaggttaagtayggtygtyggtttgggatttagtgttatygggaggaaaagagagagatttggggttggggtatggatgatggggggaagggyggtygtttttgttattgtt

SEQ ID NO: 3727 - DNA, 201 bp, synthetic construct
  misc_feature 1..201: note = Description of Artificial Sequence: Synthetic polynucleotide
  source 1..201: mol_type = other DNA
tygtagaygtyggaggygttatggtygttaagttyggygagttgatgggtatttgttttagttattaggyggtgatgtygtatttygtgtgtttggtygaygagttttygtagttygtgyggttygttaagttgtttaagggtyggggtyggttgyggyggtygygttagtttygttttaagaygtagtyggtgattttyg

SEQ ID NO: 3728 - DNA, 201 bp, synthetic construct
  misc_feature 1..201: note = Description of Artificial Sequence: Synthetic polynucleotide
  source 1..201: mol_type = other DNA
gtagttttaggaagtygtagtygtygtygtygtttaggtagagtagtagygygygygtggygttggtgygtaggttgaagttgagttygtygttgttygtygygttygtttagygygygtagygagtttattgttyggggtygtygtygaattttaggtygttygygygygtygttagygttagtagtagtagtaatagta

SEQ ID NO: 3729 - DNA, 201 bp, synthetic construct
  misc_feature 1..201: note = Description of Artificial Sequence: Synthetic polynucleotide
  source 1..201: mol_type = other DNA
aagtttttattttttggattygggtttggygttttygttttyggygygtttttattyggyggaygyggtygygtataaggtttagtayggttygygttttygtagttyggtygyggttgaatatttttagygygaagygggtgggygttagtagtttyggggayggyggtttttaggtttgaaagttggyggttyggggtt

SEQ ID NO: 3730 - DNA, 201 bp, synthetic construct
  misc_feature 1..201: note = Description of Artificial Sequence: Synthetic polynucleotide
  source 1..201: mol_type = other DNA
ggttttttagtttgggttaggtyggggygygtgtttygggttttttgtggttgtatygygygttttgtgtttaygggygaaggygttggaattyggygttyggagttygagtttttgaaggygggaggyggygttygattttaggggttgygttgggttgtyggagttaagagtgtttgygtttttagtttygygttagaa

SEQ ID NO: 3731 - DNA, 201 bp, synthetic construct
  misc_feature 1..201: note = Description of Artificial Sequence: Synthetic polynucleotide
  source 1..201: mol_type = other DNA
ttagagtgtgattgagygggttggttyggyggtygttgtttttygttttygttttttygygtttggtygygttatttattgtygygggtgttygygtgygygtygtygatgyggtygtyggggagygtttggaggtggaagtygatgtttaygttgtagtagagtygtygtagtygtttgatgtttagtaggtagtygtyg

SEQ ID NO: 3732 - DNA, 201 bp, synthetic construct
  misc_feature 1..201: note = Description of Artificial Sequence: Synthetic polynucleotide
  source 1..201: mol_type = other DNA
tatttagaaaatggaaagttgagtggtygatgaatyggaattgggagtagttttttatgaattagagaaaatgtaagttaaaaggagatattattttttaygtattagattggtaaatattaggaaatattaagttttgttgaggaggaggggtttagggagtttttatattatgtgggtgggattgtaatttggtataat

SEQ ID NO: 3733 - DNA, 201 bp, synthetic construct
  misc_feature 1..201: note = Description of Artificial Sequence: Synthetic polynucleotide
  source 1..201: mol_type = other DNA
ttttygggayggaygttttaggygyggygtygagtggaggygagggggttgyggagggggaaggggttaygygggttayggggtttaatttttgatttttygygaygttaagaatgtaggagggtagagttgagggagattttaggtggaatttttaggtggggaaggttgagttgtyggggttgygggtatygggaaggt

SEQ ID NO: 3734 - DNA, 201 bp, synthetic construct
  misc_feature 1..201: note = Description of Artificial Sequence: Synthetic polynucleotide
  source 1..201: mol_type = other DNA
tygtygtygtttgttygggayggtttygtgaagaaggayggaggtagattgygtgttygtagygggatttttttggtttttgggatygtygtggttttygyggggtttgttaygttttttttygygtttttagtgttygtattttttagttyggtygtyggygtagttattttatttttygtyggttyggtattttygggg

SEQ ID NO: 3735 - DNA, 268 bp, synthetic construct
  misc_feature 1..268: note = Description of Artificial Sequence: Synthetic polynucleotide
  source 1..268: mol_type = other DNA
gyggttagatttyggttttgtaagttggyggtygyggyggtttgygaygtttttygtyggggggtagttttgtygtgggtyggggtygygattgtyggggygttaggggyggttagyggtygtttggttggygtgtyggyggygttyggggagggygggtyggggggygyggygtttatgaggtygttgtagygtttgatttgtttttgtaggtatttgyggtggtttatttttygtttygatttgttyggtttgtttagygttagtt

SEQ ID NO: 3736 - DNA, 614 bp, synthetic construct
  misc_feature 1..614: note = Description of Artificial Sequence: Synthetic polynucleotide
  source 1..614: mol_type = other DNA
agagttattttgttygttgttttggattttgaaatttgggagatttatattaaaggagggaatyggtttttttattttttaagygygtygtgttttttatygtttttttttttggttygattggttttggttttttttaygtttttagtttttaaattggygttygttttatggttygtgtaggaygttaaaagtayggtaaattttagggygatttttagtagaygttttygaygtatgatgtygagtygttatyggttttygtygttttttgtygygttyggggttyggtttgyggtygtygttgygttttgaagygtatygygtygtyggggtttygttatttygtygttygtttttygggtygggtttttttygttttttttaggygttgtttttattttaggyggtttttgttagttgtaatatagagataaattttygaggyggggagatttttagggtatygggatgttgaagtttygyggtttttatttttaagtttaattygtgygtygtttgygygtggygtagttaatttgggtaagggaagatygtttggtttatagttggttggaaagtttaggttttyggyggtagtagtttyggtygat

SEQ ID NO: 3737 - DNA, 201 bp, synthetic construct
  misc_feature 1..201: note = Description of Artificial Sequence: Synthetic polynucleotide
  source 1..201: mol_type = other DNA
gggtattagtttygagtttaggttttattttygggyggttygggaygaattttttttataggttagtgtgtgtgtagggtaagtgtagggggttgaggggygttggyggggaggtagtagaggtggtttggattattttggygyggygygyggtgagygygaggatttygttagtgggagtygttgagttaaagtgtattt

SEQ ID NO: 3738 - DNA, 201 bp, synthetic construct
  misc_feature 1..201: note = Description of Artificial Sequence: Synthetic polynucleotide
  source 1..201: mol_type = other DNA
ttygyggygayggtgaygygttttggttttgataagtttggttttttttattttatygggtggygtygttgttgattttaygtttagtygtttttattttygtttgaaattttttygatagggtttygtttygggggtttagtttttagygygtatatattygygtggtgtyggtttagttttttgtaaaggaagtagggt

SEQ ID NO: 3739 - DNA, 201 bp, synthetic construct
  misc_feature 1..201: note = Description of Artificial Sequence: Synthetic polynucleotide
  source 1..201: mol_type = other DNA
ttgtagttagtyggyggtttaggtaagagataaggtgtgagtaaaggtttttgatggtygggtggtttgayggttaggtgygagtggggaggatagtttaygyggtttgagtagttatttttggttatagttttagttttygtttttgttttyggtttttgttttggtttgtttgygygttatttygttatttygtagtgt

SEQ ID NO: 3740 - DNA, 201 bp, synthetic construct
  misc_feature 1..201: note = Description of Artificial Sequence: Synthetic polynucleotide
  source 1..201: mol_type = other DNA
ygttyggtygtygtttttagttaattygggttttttttayggygattaattagtgygaagttggttgggygggaagtygygagaggtttttattgyggygygggtggyggttaggagttgttaggatagtttttyggtgttttagtttaayggtttygtttatttatygttaagagaaatttygttttgyggtyggttttt

SEQ ID NO: 3741 - DNA, 201 bp, synthetic construct
  misc_feature 1..201: note = Description of Artificial Sequence: Synthetic polynucleotide
  source 1..201: mol_type = other DNA
ygggtattgygaattgtygggygatgttgtygttgtygtygtgatayggagagtaatagttttttagtaatattttttttygatataggtatatatttttygataggtaygtatatttattttatagtgttyggttyggttgyggtgagtgaggggtygggaagaggygtatygtttagygagygtygygygtyggggttt

SEQ ID NO: 3742 - DNA, 261 bp, synthetic construct
  misc_feature 1..261: note = Description of Artificial Sequence: Synthetic polynucleotide
  source 1..261: mol_type = other DNA
ggatyggyggtgatatyggagttygtygtgygttttyggtygttttyggtgggtgtyggtttttgtatttgatgygttygggatgttttttttattttggygygttygtygttagttygtatagygtttygtatattttygtaygygtttgaaatgygtayggtttygtyggttygyggaattattyggaygtayggagygtttygtatygattygttygtygttttttygagaygttygtatygtgtttgggtygggygc

SEQ ID NO: 3743 - DNA, 201 bp, synthetic construct
  misc_feature 1..201: note = Description of Artificial Sequence: Synthetic polynucleotide
  source 1..201: mol_type = other DNA
yggttagggtaatagttagggtaaagggagagagaagtygtttyggggygagaaggagaaaagttagagggttgaataggtgaygttgagtttgttggagygtgtgtgttttattaygtaagggygyggagttyggtygttttatttttygttatttgygygttygggggtaygttttttgygatagtttggaatttagat

SEQ ID NO: 3744 - DNA, 201 bp, synthetic construct
  misc_feature 1..201: note = Description of Artificial Sequence: Synthetic polynucleotide
  source 1..201: mol_type = other DNA
gggtatyggtgtygaygtygygagggtagygttygyggygggaatattaatgtattttaaagggtayggtygtygtygtagtaggtaattagttggatygyggyggagygygyggaggtggttgttggttgtaaggattgygtttagttttygtttygtttttygaggttttygygtgggtyggygggtagtgygtgggtt

SEQ ID NO: 3745 - DNA, 201 bp, synthetic construct
  misc_feature 1..201: note = Description of Artificial Sequence: Synthetic polynucleotide
  source 1..201: mol_type = other DNA
ttttttgtttyggtttygtgttttygttggggattgtttgyggtgagtttgtygtaygtaygttagggtygaggtagtgatgyggggtagygtgggaggaygggttgyggagttygygttattttgtttgtggggagygttgtgtttgtttttttgttagygygtttagttgtttyggtygtygttaygygggattgtttg

SEQ ID NO: 3746 - DNA, 201 bp, synthetic construct
  misc_feature 1..201: note = Description of Artificial Sequence: Synthetic polynucleotide
  source 1..201: mol_type = other DNA
ggaaaatagggtattyggagtgtaggagattttttagggtygttttttttttygggggtgttttgaggaatygyggyggggattygtygttggtagtttgygggttttggtgttagygygtatgggygggttgtgyggaygtggttggttttttaaaggttttagatttygttygggtygtttagttttttaaagttgtgt

SEQ ID NO: 3747 - DNA, 219 bp, synthetic construct
  misc_feature 1..219: note = Description of Artificial Sequence: Synthetic polynucleotide
  source 1..219: mol_type = other DNA
tttygggttaggaagttgttaggtaggggagggttagygttagttgtggaygtttygggatagttttttattttagtttttgtttttgttttyggygyggygtaaaygtaaaagttttygtggtygtagttttagtttyggtggtygttygattttygtygggatttyggttgtatttattggagaagyggyggtttygattttygaggaggyggyggc

SEQ ID NO: 3748 - DNA, 268 bp, synthetic construct
  misc_feature 1..268: note = Description of Artificial Sequence: Synthetic polynucleotide
  source 1..268: mol_type = other DNA
tttattattgtttttttttttygttttttatttttttgtagygttaagtyggttttttaatttggtttgttgaaygtaaatygttgagagtttgttgtatygttttttggggtttttggttgtygagtttygttaaggtaaagaygttagtaagygaggaagygtagyggaagaaaaataagygggygygygaggggagttttaggagggttgtygagtggttggtaggyggttttygtttttttygggtggtttygtyggyggttga

SEQ ID NO: 3749 - DNA, 201 bp, synthetic construct
  misc_feature 1..201: note = Description of Artificial Sequence: Synthetic polynucleotide
  source 1..201: mol_type = other DNA
tttttyggttttaggattggggagtgtgtygyggggtygagggtggggaatagttagagggagaygygaattaggtygttggyggagggtttagggggagygtagaggygayggtttttatgtyggyggttaatatgatggagaatyggtygttgttygttttgtaggtgttygagtygtagggtgygttygagggtagtt

SEQ ID NO: 3750 - DNA, 517 bp, synthetic construct
  misc_feature 1..517: note = Description of Artificial Sequence: Synthetic polynucleotide
  source 1..517: mol_type = other DNA
tagagygygggttttygggttttatttygggaaaagtttgggtttgttttgygttgttgygtgttgygtttttgggatttgttgattgttttagagggaaygtttygyggtagtgttagttttttggggattaggaagggygatttttgtttgggagttagtgtttgggtygtygggttygggtaagygttgggggtttggttygagaagatgyggataggtggtttagggygtygyggattttygttttttgygggtatygggagtttagggtygaggygygtygtttygaggggtttttttttttaataatgygttyggaatggagttygygttttgatagygygggttagttygaaatygtttagaattygtttygatgagtgggtgagtygttttgggagtttgtygygtttyggtagyggagggtttgagtggaaaaatttttattggatgtattttttaatggttggtttgtttyggttttygttygagtttttttyggtagtaggygttg

SEQ ID NO: 3751 - DNA, 226 bp, synthetic construct
  misc_feature 1..226: note = Description of Artificial Sequence: Synthetic polynucleotide
  source 1..226: mol_type = other DNA
ygygtttttttagtygyggttttttttttygtygtttttttttgtttttttagtttttttttttaygtgtggatgaygttaaaatttygygaaaaagtygygtggtggtttttygagyggaggygygatttygtygtttagyggttttttttygggggygtttggagggggagaagggyggaggyggtyggtttttttttttttygggaggtaggatttttygayg

SEQ ID NO: 3752 - DNA, 201 bp, synthetic construct
  misc_feature 1..201: note = Description of Artificial Sequence: Synthetic polynucleotide
  source 1..201: mol_type = other DNA
ttttygggaggygagtygygggttgttgggygyggaggttggagtygygagaggttyggttgttgaagyggttattgttttttagagttaggtttygygtygygygttttygtygtygtyggtattgtgtatttatttatttttyggagattggggtaggggaaaaaagttttgaggygtttttatttttgttttyggggt

SEQ ID NO: 3753 - DNA, 212 bp, synthetic construct
  misc_feature 1..212: note = Description of Artificial Sequence: Synthetic polynucleotide
  source 1..212: mol_type = other DNA
tttygggygtttggtatttttttttatyggggtttyggyggygygyggygtttgttyggaggggggttygggtatggtgttgyggtagttggattygtygygagtttttygygtttygtygtygtttgygtygyggagttggtttagttgtaaataaatagtagttttttygtttttttyggttatygttatttttttygttttattgygta

SEQ ID NO: 3754 - DNA, 388 bp, synthetic construct
  misc_feature 1..388: note = Description of Artificial Sequence: Synthetic polynucleotide
  source 1..388: mol_type = other DNA
ttttttyggttatttgtgttgttttygttttggttgtttttgtttygagggaagatgttygagtattttttttattttatttggtyggygaagtatagttyggtgaygatgtgtagagttttttggtatagattgtttatttygttttttttgtggaaatttatygtttggtttttttttygtttttttttttttttttagttagtygttttttttttttttygtatttttaatttttttggygttttaagttatagttygttygyggtgattttggttggagattgygtygttgagagtyggtaatttttaggagttttaygttggttttatggygggagyggagggygtaggggaaggagaggygygygaggaggttgyggttgtc

SEQ ID NO: 3755 - DNA, 201 bp, synthetic construct
  misc_feature 1..201: note = Description of Artificial Sequence: Synthetic polynucleotide
  source 1..201: mol_type = other DNA
tttttggatgttaaattyggtttagggagtttaggagtygttgtagttttagtttttttttttttttttttygatgattygggtaatgttaattttttttygggattgaaagttttaaatttaaggtgttaagttgatgggyggtttttgtttttatttttygatttygggygygtgttttgaaagataggagagaaaaaa

SEQ ID NO: 3756 - DNA, 201 bp, synthetic construct
  misc_feature 1..201: note = Description of Artificial Sequence: Synthetic polynucleotide
  source 1..201: mol_type = other DNA
tygtggtattttygttagagtttaagtagttttttaggygtggggtttggtggaygttggtttggagygttyggagggyggggtgggggtgggggggaygygttgtygtttggggtgttttygygtatttttgttgggygaattttggtttttyggtgttggttgttatttgagtaattgatgggtttttaggggaagtaa

SEQ ID NO: 3757 - DNA, 212 bp, synthetic construct
  misc_feature 1..212: note = Description of Artificial Sequence: Synthetic polynucleotide
  source 1..212: mol_type = other DNA
ttygtygttttttttttatttygttttttatygtygtttttagttttttttygggatgagagagagtygygttgyggagtaattttagtggatgggttygygggggttgagygggyggaggaygygggaatttygtgatatygattagttgaygttgttygygtgaaattagagtygggtattagggttttatttttattgtttttgtattt

SEQ ID NO: 3758 - DNA, 250 bp, synthetic construct
  misc_feature 1..250: note = Description of Artificial Sequence: Synthetic polynucleotide
  source 1..250: mol_type = other DNA
taggagggtgggtgttagtttttttttttatttttygagtttttttttyggygtttaygtgggyggagtagygygagggtgtgygtggtaggggtygyggyggygtgtgtygtgygtggggtggggtgygggttgggyggtttygttttygggtttygygtygtyggggygyggtttttagttttattttttttgttatttgggyggagatttgggggattgtgatttattttgyggaagatayggaggg

SEQ ID NO: 3759 - DNA, 488 bp, synthetic construct
  misc_feature 1..488: note = Description of Artificial Sequence: Synthetic polynucleotide
  source 1..488: mol_type = other DNA
ataygtttttygttagtttgggygtygggtttygaattttyggtttgtaaatttgygtattttttttygtygygttygttagataatttggygaatagttygttygttygtatttygtttttttyggttttttttttaaattttaaaygtatygtygtgttttaaagaaggtgtttaygtygtttttagatttyggagygttttttttttattttygggattttttaggtygtttatttttttygtttttygtttagatttgagagggatygaaaatatattttygattygggtagttagggtygaaattgttaagaggagaaaaggtaaagyggaaggagggtggttataaatagatttttttgtttttttttaaaaggatattgtygttttaaaagtttttttttygggtttttatttttygtattttygtattttgggggagygtatttaattgaggtaaygtagtttttttttagtgtttgtag

SEQ ID NO: 3760 - DNA, 201 bp, synthetic construct
  misc_feature 1..201: note = Description of Artificial Sequence: Synthetic polynucleotide
  source 1..201: mol_type = other DNA
ggttgaggagaagggagggagagtagagggaggggggaattyggtygggggaggaggagagaggygaggaggyggttttggtagygygyggyggyggyggyggtagyggtagtagtagyggyggtgyggagagtttggattgggagtttaaagttyggttgggtagygggagaggaggagtygtaggagttgtagttttgt

SEQ ID NO: 3761 - DNA, 364 bp, synthetic construct
  misc_feature 1..364: note = Description of Artificial Sequence: Synthetic polynucleotide
  source 1..364: mol_type = other DNA
ttttataattaaggagtatggtggagttgggttaattttaggtatagtttagtygagttaggygaggtttagagagatttgattygtttggtagttttaayggatttgttttygtagtygttgyggatttttyggtygttatggygattgtgaaatgtggggtggggygtatgygttggaagttattygygygggtagtttttgagtgtttttttaygtgttttttagygygagtagtattttygtttttgygttttttagagygtgtagttttyggtgagggtagttttaygtatagttttttatattttttttagygtttgtagttttyggtgygygtaggttttaagtttatatgygtagt

SEQ ID NO: 3762 - DNA, 220 bp, synthetic construct
  misc_feature 1..220: note = Description of Artificial Sequence: Synthetic polynucleotide
  source 1..220: mol_type = other DNA
gtttttatttygagygygtagttttaygtagtttttttatattttttttagygtttgtagtatttttagtgygtatagttttgttagtygttttttygggygtygtttttgtattatttyggtttataattttgyggygattgtttgaagaatttttygtggttttattttttttttygggtttagttttagttgtgatattttaattaaaagattatac

SEQ ID NO: 3763 - DNA, 201 bp, synthetic construct
  misc_feature 1..201: note = Description of Artificial Sequence: Synthetic polynucleotide
  source 1..201: mol_type = other DNA
tygtttttttygtttygagygattttttgttttagttttgtaggtttygtattgtagatgtttgttggtttttttgygttyggyggttttygyggtgtttygtaagttttygtgattttttagtattagtyggttgtgygttttttgtttttaygggtyggttagtygtagatatttatttagtttygygagtttagtygt

SEQ ID NO: 3764 - DNA, 201 bp, synthetic construct
  misc_feature 1..201: note = Description of Artificial Sequence: Synthetic polynucleotide
  source 1..201: mol_type = other DNA
ggggtatygygttggtatttgtagggagygattggtttggaagggtagagggtagaygggggtttgggtggggtagyggttattttaggygyggagaattygttgtttttatttttttttygyggatttttattttgyggtttgtgtgttyggtttttttygygtggyggggaagtgygggtggttgttygggtttttaga

SEQ ID NO: 3765 - DNA, 201 bp, synthetic construct
  misc_feature 1..201: note = Description of Artificial Sequence: Synthetic polynucleotide
  source 1..201: mol_type = other DNA
gtgtyggttttygaaygtatttygaggyggggtgagggttggtagtygtttttgtattygtygttgygagtygygttttttaaatttaggtatgggatttyggaaaatygattygttgttttgagtgtttattaygtgaggaattggagtggtygagttygttaaggygtyggggatatttgagtagatgagaattggagt

SEQ ID NO: 3766 - DNA, 358 bp, synthetic construct
  misc_feature 1..358: note = Description of Artificial Sequence: Synthetic polynucleotide
  source 1..358: mol_type = other DNA
gygtagygtttgagtttgygtttygttaagtgtattaagtaygagatttagagygttatggagatygtgttgttttggggtttggtygygtattgtayggyggttgygttggtygtattgtttttttataatatgagtagygtyggyggygatygtttgggtygyggtaagtyggttygttgyggttttatttttttygtgggtygygtgtatygttggatggtggatagtygygtggygttgygtatttaygagtaygtygttatttatttgatagtttgtatggagagtttttttygggatatttattygygggtygtggttttyggggtgtttyggagttgtagtggttttgggt

SEQ ID NO: 3767 - DNA, 201 bp, synthetic construct
  misc_feature 1..201: note = Description of Artificial Sequence: Synthetic polynucleotide
  source 1..201: mol_type = other DNA
ggagttttygggygygttttgggygtattggggaggttttygggygggtaggyggaygttttggggyggygggyggyggttgtyggggttygtyggggttyggtygttygttgtttatygataggtattaggaattgatttygtygttgttttttgttyggtttagttatygattagttgtygygattatggagaagygtt

SEQ ID NO: 3768 - DNA, 328 bp, synthetic construct
  misc_feature 1..328: note = Description of Artificial Sequence: Synthetic polynucleotide
  source 1..328: mol_type = other DNA
ygtagggagggagggggtatygtttgtttttttgttygaaaggtggaggtaaagagggatttyggattttagagaggtttataattttttataagtaaggyggggggyggaatttagagaggtaaagtgattygtttttaaatygtaatattaggaggatagtagggttagatggaatttttyggtttatagttttygatttygggtaagtgttttattygggygtayggtttgtttttagattagaattaggygygttygtagttaaggaagtttggygggagattttttygaggttttyggtttttaggttagyggggttaaggag

SEQ ID NO: 3769 - DNA, 201 bp, synthetic construct
  misc_feature 1..201: note = Description of Artificial Sequence: Synthetic polynucleotide
  source 1..201: mol_type = other DNA
ygttyggtgaagtyggtgtatttattatattttttgttgtttttagtagggaagtyggyggtgaggygggggagtaggtatggtggtttyggggtttatgyggggtttattgtttatttagaatagyggttattgttgtttattagggygtatttatygttggagttttygyggygattgtttatttttaatatatatttt

SEQ ID NO: 3770 - DNA, 319 bp, synthetic construct
  misc_feature 1..319: note = Description of Artificial Sequence: Synthetic polynucleotide
  source 1..319: mol_type = other DNA
tggagtyggyggtygygttygygtygttgttgtttggttygttggyggyggggtygggggttgtyggagttgattttatgtttttttttaatgtagagatygttggagatggygagtttygagattttttttattttttgtttttagagtaattttatggtattaaaaaaaaaaaaaaaaaaaaaaaaaaaaaaaaaaaaaaaaaaagaaggagaaggygatyggygaaagtaggagggaaaaagtaggyggyggygggygggtaagtaaaagygygagggagygygyggagtgtttgggtggaygtgtgtgtgygttc

SEQ ID NO: 3771 - DNA, 201 bp, synthetic construct
  misc_feature 1..201: note = Description of Artificial Sequence: Synthetic polynucleotide
  source 1..201: mol_type = other DNA
atygygggaggagagygtaaggaggtttttygtaaagttggaggttaggtyggagygatgtttygggagyggagtttttttagtttygggtttttagtygyggatagttggtagtgttaaagatttygttattatttgyggttygtagttgygattyggtygtagagtygggtatygaggaaggygtaaagttgagtttgg

SEQ ID NO: 3772 - DNA, 370 bp, synthetic construct
  misc_feature 1..370: note = Description of Artificial Sequence: Synthetic polynucleotide
  source 1..370: mol_type = other DNA
agggyggttyggggtgggggygttttatttttgttttttatggygtgtaygaagtttttttggtatagttggttgygaagttttttttttaggttgaagtygyggaygttgaygattttttttaygttygataagttttygttttygtygtatygttggyggttaatygggygttgygaggatttaaattagagagttygggatattattgtgggggttggaggtygttttttaatttgggtttagtattaataggtgtagtagtygagygttttttgtattttattattgtaatttaagtaattttgygtaattgttaaagatgttgaaaagtaggataaggagaggggttygtatttygagggtttag

SEQ ID NO: 3773 - DNA, 201 bp, synthetic construct
  misc_feature 1..201: note = Description of Artificial Sequence: Synthetic polynucleotide
  source 1..201: mol_type = other DNA
gttatgttggaatttggaggggaggggggatgttggagaggtatayggtgatggatatggaaggattygggaggtgtggagtggtgggttyggttygtygygggaaggatatagagggatataggttgttttggagaggygttttyggatatttggaggggygtatagtgttgggatttggyggygtttggggyggagggg

SEQ ID NO: 3774 - DNA, 201 bp, synthetic construct
  misc_feature 1..201: note = Description of Artificial Sequence: Synthetic polynucleotide
  source 1..201: mol_type = other DNA
gtttttygtttttaygtygtagttygggttagyggggttygtygyggtggygttygyggatgttgtygtattggtygttgyggtayggayggygtagtttygggygyggttyggtataggygtyggyggttttygttagttagtagttyggygaggygttggtttatttatggttttygggyggyggtttttgygtttagt

SEQ ID NO: 3775 - DNA, 201 bp, synthetic construct
  misc_feature 1..201: note = Description of Artificial Sequence: Synthetic polynucleotide
  source 1..201: mol_type = other DNA
attygttygttygtgggtgagttgggaggggygyggygagggagggtgggttyggggygggggyggygyggggygygtttgyggttatgygatattgtttygttygygtttygtttttttttttgggttttttgggttttttgggttgtaggattygtygaygyggygygttggtygtaygggggttgggygtygttgtat

SEQ ID NO: 3776 - DNA, 263 bp, synthetic construct
  misc_feature 1..263: note = Description of Artificial Sequence: Synthetic polynucleotide
  source 1..263: mol_type = other DNA
tgggttattygtgtygtatgtyggygtagttgttygttgtggtaaggggggggyggtygggtttyggagygggtygggagggygyggggygygtatttygyggtaggtgagyggygyggttgtaggtgagtagtagtttyggttygygygtttagtttttttygtygygttygttyggtttataygtttttygygygygygtygttttygtttygygygygttyggtygttygttygttygtgggattttygygaggtygygc

SEQ ID NO: 3777 - DNA, 201 bp, synthetic construct
  misc_feature 1..201: note = Description of Artificial Sequence: Synthetic polynucleotide
  source 1..201: mol_type = other DNA
gttttgttttttttgtttttaaygaattggtaagtaaaatattagttgtttattttgaaatttgttttaattattttygtattttttgaagttygttgggygygttttgggttgtttttttttgagtagtygggtttagagttaaggygygatgattgtygygtaagttagggtttaygyggtyggggtttttttttygtt

SEQ ID NO: 3778 - DNA, 201 bp, synthetic construct
  misc_feature 1..201: note = Description of Artificial Sequence: Synthetic polynucleotide
  source 1..201: mol_type = other DNA
ttttttatttyggtatttttttttggtgaygttaaggggttttttattttttattygtttttttatttattttttttttttttttaggttygtttttttgyggttayggagaggggygggggtygaygagggygggtggttyggggtygagygygygtggggaggtgttggygaygygggttygggagygyggtttyggta

SEQ ID NO: 3779 - DNA, 201 bp, synthetic construct
  misc_feature 1..201: note = Description of Artificial Sequence: Synthetic polynucleotide
  source 1..201: mol_type = other DNA
ttatttagttttgggggtygttygaaattggggaagggataaggttgaagtttygtygtttggttttaggggyggaaagttygatttaagggaagttggtygygttttygygayggtgtttttggtayggaggattgaggygtagttyggttgtttttttttgtttgtttttttygygttgtttygtygtttttgattttt

SEQ ID NO: 3780 - DNA, 201 bp, synthetic construct
  misc_feature 1..201: note = Description of Artificial Sequence: Synthetic polynucleotide
  source 1..201: mol_type = other DNA
ygyggggtygggyggggatyggtygggggygtygygygttyggtygggttgattgtygggggygattttygyggggtaaggygggggygygggagtagygygtagttgyggggttattttatttgagygttttgaggttagggtyggggtttgaggatayggygttgggtttygggggaygygggtttaygtyggygttyg

SEQ ID NO: 3781 - DNA, 215 bp, synthetic construct
  misc_feature 1..215: note = Description of Artificial Sequence: Synthetic polynucleotide
  source 1..215: mol_type = other DNA
ttatatttatygtttygggygygtygttygygygyggtttygtttygggtyggtatttttyggttyggttgttttyggttttygtttyggtttyggttttygtttygtagggttyggtttygygatggtggtygyggyggygagygyggtagggagggygtgtgtatgygygtgagagygygtagygtgtgtatgtgygtgtgygygggagggtt

SEQ ID NO: 3782 - DNA, 201 bp, synthetic construct
  misc_feature 1..201: note = Description of Artificial Sequence: Synthetic polynucleotide
  source 1..201: mol_type = other DNA
ygygagtgttttttaatggtagygygggygtttttaatygygaggggttgygttattatyggygtttgttggagyggttgygggagttgggygtgtagttygtggttattttgtattattgggatttgttttagygtttgtaggaygtttayggyggttgggttaatygygttttggtygattattttagggattaygygg

SEQ ID NO: 3783 - DNA, 201 bp, synthetic construct
  misc_feature 1..201: note = Description of Artificial Sequence: Synthetic polynucleotide
  source 1..201: mol_type = other DNA
gtgttagtagtttyggggtygttygtaygtaaygttttygggtygggttaggttggttagggtagggyggtygtttttygaggaattgygggyggggyggyggggttaagttgagygttygttttgttttyggygtttygyggttgygggyggagygggttttgyggagtttttyggtygtttttttygtagttttygttt

SEQ ID NO: 3784 - DNA, 201 bp, synthetic construct
  misc_feature 1..201: note = Description of Artificial Sequence: Synthetic polynucleotide
  source 1..201: mol_type = other DNA
ttaggttgtttgtagygtygttttgtttttttattttagagygtaggtgagtggttatttttttaggggatygyggttgagagygtttatttttttttttygtatttggaaattgagtttggyggtagggttgggttatttagagtttgtatatttyggaagggaaagtgattttagaagggagagaggaagtgttgagtt

SEQ ID NO: 3785 - DNA, 217 bp, synthetic construct
  misc_feature 1..217: note = Description of Artificial Sequence: Synthetic polynucleotide
  source 1..217: mol_type = other DNA
tgtagttggtgttgtttttgggaygatgtagaygttttatatttaggygygggtgttaggtygtygggtattagtttatttttagggtttgtgagttgygygtattttttyggtygygtattttttgggaggttgtagttagagygtttttgaagggagggyggtagaagatattttttttyggtttatgtaaatygttgggggaattttagttaat

SEQ ID NO: 3786 - DNA, 317 bp, synthetic construct
  misc_feature 1..317: note = Description of Artificial Sequence: Synthetic polynucleotide
  source 1..317: mol_type = other DNA
aagygagygattttttgagttygggtggttyggygggtaagggyggygygggagattygtagggygygggygyggattyggggaattagggttatygttgygggyggatgggggttatygaggyggttygtttttaggygtatatttygtatatttttttgttaagtgaaggggttaaaatgtatagatgggggagtttatttaggaatagaggygygagaygtatagttatttttgggttgggagtaygagttagtagattttyggagygygttaaayggataatatgttyggtgttgtaaatagaggtttttgtt

SEQ ID NO: 3787 - DNA, 201 bp, synthetic construct
  misc_feature 1..201: note = Description of Artificial Sequence: Synthetic polynucleotide
  source 1..201: mol_type = other DNA
tatttttgtgggggggagggtgtagygaaggttgttagggatttygygatygygttttaataygtattggagygagtgtgygagtgattatgagtgtgagygggtgygagygttyggyggggttgatygttaygttggyggggtyggyggggttaggtagtttttttygygttttttttttttygtttygtgttttttttt

SEQ ID NO: 3788 - DNA, 201 bp, synthetic construct
  misc_feature 1..201: note = Description of Artificial Sequence: Synthetic polynucleotide
  source 1..201: mol_type = other DNA
ayggtgttaagggatttagtttggyggatattttttattaggagatygtaggtaagygygggygygttgtaggggtaggttgtagttttyggttgtygtaygttttattggtygttyggygtttttttttttttttttgttgttgagttggtgtttattttttgttatygttatgggatttygygttttygtgttgggygg

SEQ ID NO: 3789 - DNA, 201 bp, synthetic construct
  misc_feature 1..201: note = Description of Artificial Sequence: Synthetic polynucleotide
  source 1..201: mol_type = other DNA
gygtygtagtttttygggtatyggyggyggtgattaatttgtaattttagygtttagagttgttatggtgttygygggyggyggyggyggygatagtgggygatyggtaggattagtgttaggygyggygtttagggygggyggggaygygggttttttatttayggyggtttagtttaggtagygygttyggttyggttg

SEQ ID NO: 3790 - DNA, 201 bp, synthetic construct
  misc_feature 1..201: note = Description of Artificial Sequence: Synthetic polynucleotide
  source 1..201: mol_type = other DNA
gyggtgtgtaygggagttygtygggtataygyggggtatatttaagtgtattgttaggaggtygggagtttagygtgygagygtgaggttagattgtgtayggtatygaggattagttttatttttgagtatgaaagggtgaaatygtttattttaagttttatttyggagttattaaataatgaatgtattagttatatt

SEQ ID NO: 3791 - DNA, 201 bp, synthetic construct
  misc_feature 1..201: note = Description of Artificial Sequence: Synthetic polynucleotide
  source 1..201: mol_type = other DNA
gggttggtygyggattyggayggtygggagygggygyggyggtygtagagayggttttttttygygyggttttagygtagattttagatttggagtygtgygggyggagaygygyggggttttttttygtttygtygtygttgggtttttagygttttyggattygygggaggataggaattattyggagtgaagttgygt

SEQ ID NO: 3792 - DNA, 221 bp, synthetic construct
  misc_feature 1..221: note = Description of Artificial Sequence: Synthetic polynucleotide
  source 1..221: mol_type = other DNA
tygagatataaagatygaggttgagatygttaggggttgagggtgaggtygygtttyggggtygttggagygygggygttatgygagattgtttyggttgygygtygttttagaggagttygagygttttttttagtygyggygygttggttttggtygggattgtagttaggtgggygtygygygtgtgagygtygygygtgtgagygtagatttggatt

SEQ ID NO: 3793 - DNA, 311 bp, synthetic construct
  misc_feature 1..311: note = Description of Artificial Sequence: Synthetic polynucleotide
  source 1..311: mol_type = other DNA
gattattgtygaatagtygttggagattygtagagaagggygggttttgygttyggggygtttyggaggtaagttyggagagttygggtygggyggagggygggagygtaygagtgtgtgtgtgtgtgtgtgtgttygyggtgtgttygyggttyggtgtataygygygygggttgtaaagttaggagttgygggagygtttttttgtttyggtttggtttyggagtattgygggtygyggaggtgtgggggtttttgtygttgygtttagggtagyggyggaaaaggtgtgtgyggatgyggggyggggt

SEQ ID NO: 3794 - DNA, 308 bp, synthetic construct
  misc_feature 1..308: note = Description of Artificial Sequence: Synthetic polynucleotide
  source 1..308: mol_type = other DNA
ttgagtygtagaaggtttttttygygtttttttttagtagggatttttggayggggagatygaygggtttgtgggygttttttygggatatatttyggttygttttgtttgggttgggtttatttaygttttgggtggggtttaggaattgygtgygggygtagygggtgagtatgttgatgatgattatttggttttatttttttaygtygattagtaggttatagagttttyggtagtttttgtgaattaggtygatgygtttygggtagatttttttaaaggttattattatattgttygttatt

SEQ ID NO: 3795 - DNA, 201 bp, synthetic construct
  misc_feature 1..201: note = Description of Artificial Sequence: Synthetic polynucleotide
  source 1..201: mol_type = other DNA
aatgtgatatagatattagtttttygtgtttttggtttttagggttttttttatygygttttagtatttgtagtttttttatttttatagygttygtygtygttaaggtaatagagggatgttyggtgatagattyggygtyggttttyggygtygtaagagaagygttygygygggygttttggattygtagagttttyg

SEQ ID NO: 3796 - DNA, 201 bp, synthetic construct
  misc_feature 1..201: note = Description of Artificial Sequence: Synthetic polynucleotide
  source 1..201: mol_type = other DNA
ttattttatttgagygtggttaaattgttgttatttagtggggagtaaaaaaaaataatttgtattatygaaaygagttagtaattggttgggaggygggyggtagttgggtttygygtgttttyggyggtyggggtttttttyggggagaggtatatataygtatagtyggatygygtttygttagggtyggagttattt

SEQ ID NO: 3797 - DNA, 201 bp, synthetic construct
  misc_feature 1..201: note = Description of Artificial Sequence: Synthetic polynucleotide
  source 1..201: mol_type = other DNA
ggtgggagtygygaggagygtttagtggygyggtttgtygggtatggtggtyggttyggygatygttgattygtygggttygggggttttggaagygaggygygtttttygatttygagattttgtagggttgtaatagayggtggggaggtaaaaaaaaaaaaggaaaaggaaaaaatggtgttaaagttattaagtttt

SEQ ID NO: 3798 - DNA, 630 bp, synthetic construct
  misc_feature 1..630: note = Description of Artificial Sequence: Synthetic polynucleotide
  source 1..630: mol_type = other DNA
tyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggtt

SEQ ID NO: 3799 - DNA, 201 bp, synthetic construct
  misc_feature 1..201: note = Description of Artificial Sequence: Synthetic polynucleotide
  source 1..201: mol_type = other DNA
aaatgggattagagygyggagggagtttggttaggaggttttttaggatttagtygygaygttgaaaagtatgaagggtyggaattaggtatttatttagygagygttattaattygaagttatagygttaattttttgattyggtygtttttataygtagygtygggattagaggygyggtygtygttygtttygttttt

SEQ ID NO: 3800 - DNA, 239 bp, synthetic construct
  misc_feature 1..239: note = Description of Artificial Sequence: Synthetic polynucleotide
  source 1..239: mol_type = other DNA
gaagaaatygggtaaatagttgtttttaggttygtgttaygagttttggygggatttttttttttttttgtattttttatttttygattttttttgtgtgygtygygtttygttgtagtttygttggagagatggggayggtttggtagaaggtggyggygataggggttygggayggtttggggagaggagggtgggggygyggttgttgtggggtgttttygggyggggtttayggg

SEQ ID NO: 3801 - DNA, 201 bp, synthetic construct
  misc_feature 1..201: note = Description of Artificial Sequence: Synthetic polynucleotide
  source 1..201: mol_type = other DNA
tgtttagtttttyggaggagtattatgttttgatattttygttttatygttttaaagttggtttggggtttygtagggagtggtttgtatggggagggttygygtgttgtgtttttgggaggggtaagagagtgggggygtagggggygggttaggtttttgggygyggygygggttygggggattygygyggttgaygtt

SEQ ID NO: 3802 - DNA, 221 bp, synthetic construct
  misc_feature 1..221: note = Description of Artificial Sequence: Synthetic polynucleotide
  source 1..221: mol_type = other DNA
ggtagttggygygttygttttggtygtagttyggtttggggattygttgygtgttttggtattagtgygtggtgaggaaagyggtggtggygaatagtagygttagtaggtttagggttayggttaggagygttyggtygyggyggttagtttttatgtygttygygtygtygggaygggattgtatygtyggggagtttygygygygaagttggtagttg

SEQ ID NO: 3803 - DNA, 201 bp, synthetic construct
  misc_feature 1..201: note = Description of Artificial Sequence: Synthetic polynucleotide
  source 1..201: mol_type = other DNA
tagttttaygtyggttygtttttygtttayggttyggtttttttttygtttggttyggygttttttygtttygagttttttattttttggatttygggttygygggggygyggagaagaggatttaggaaaggtttgggaatttgatgggtttgtggttggggggaggggtagttttttygttattttatttttttttygt

SEQ ID NO: 3804 - DNA, 246 bp, synthetic construct
  misc_feature 1..246: note = Description of Artificial Sequence: Synthetic polynucleotide
  source 1..246: mol_type = other DNA
tgggtttttttaggatttattttatgtagtttttatatggtttttagagttttgatttygtggttggagtgtttgtttttttttaagtattggtagtataygggtattttgtattgtaygtagtatatgttgtggttttttagttygtggtttgtgtaggtggagattttgygtgggtttagttttyggtttataygattttgggtygggggtattaggyggtgtttggttaggggttttyggggc

SEQ ID NO: 3805 - DNA, 223 bp, synthetic construct
  misc_feature 1..223: note = Description of Artificial Sequence: Synthetic polynucleotide
  source 1..223: mol_type = other DNA
tgatattgggggtaggtgatataggagttgyggggtatyggggttagggtyggtgataagtgggtggtyggtggyggtatagtygggggaaataygyggaygtygttgggggatttttggtayggggtagtgggggygttggygaatttttygtaggagttatagtygttgttygtttygttgtataggtttattttgtttaggtttagatagttatagtygg

SEQ ID NO: 3806 - DNA, 201 bp, synthetic construct
  misc_feature 1..201: note = Description of Artificial Sequence: Synthetic polynucleotide
  source 1..201: mol_type = other DNA
gggtttttygttagygtttgygtttggtttttagttttgagtttygygtttatttatygygggygagtgttgygtagtayggaggaygttttttttttttygttgttggtagttttygtaggygttttattygggtttaggtttttgtayggtagtggggttttttttttttttygtgaattygttgaygtygtgttttgg

SEQ ID NO: 3807 - DNA, 244 bp, synthetic construct
  misc_feature 1..244: note = Description of Artificial Sequence: Synthetic polynucleotide
  source 1..244: mol_type = other DNA
tgygtttattygttgtataaygygtttygtttyggtttttagtttatttttygygtygygttagtttygaatttggattttygygggygtttgggyggggygggattttaggtttatttagtaagttaattggttgaggttttyggttggggattaattatyggttttgagaaagttyggtagtggttattatatttggttttygttaatttttttaaggtagyggtygttggagtagyggggt

SEQ ID NO: 3808 - DNA, 201 bp, synthetic construct
  misc_feature 1..201: note = Description of Artificial Sequence: Synthetic polynucleotide
  source 1..201: mol_type = other DNA
tttttatttttggttgtttggyggggtttgaaagggtaggtggttttggyggygygtttygygagggatgtggtagaagggygtgygtttggygtygaggyggagggattttygatgtygtgtggtagyggggtttgttatygtagtttttygygggtattgtttttaggtttagagttagtttttagygagtygggtaaa

SEQ ID NO: 3809 - DNA, 457 bp, synthetic construct
  misc_feature 1..457: note = Description of Artificial Sequence: Synthetic polynucleotide
  source 1..457: mol_type = other DNA
tttttttaaatataygtttttttgttygyggttygttattttygttygggtttygggttgtgtagtttttttttaggtttgttygggtttatgtttttttygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygygggtyggagtygtttaggtttgtattygggggttygyggtygaygtatgygtaygygyggtggygggtttgtaggttygaaggttyggttttttttttaa

SEQ ID NO: 3810 - DNA, 244 bp, synthetic construct
  misc_feature 1..244: note = Description of Artificial Sequence: Synthetic polynucleotide
  source 1..244: mol_type = other DNA
gagyggtgattggaatttaygttygggagaggttyggagtttyggtygygggyggygggggatttttgtaggaaggggtaggaaggtaagtagttyggygygttttggyggtttygagggatttgggttygggtttgyggtygygtygtttgggttttttttgggttgggagygygtygggttttygttttgtaygttgttatygygggagaygtttyggtttygtygygygtagaggggaygc

SEQ ID NO: 3811 - DNA, 206 bp, synthetic construct
  misc_feature 1..206: note = Description of Artificial Sequence: Synthetic polynucleotide
  source 1..206: mol_type = other DNA
gtttygaygttgygggygatagggtttggttttagtagtygtygtygtygtygtygtygttattyggaggatttagtaaaagtttggatttgggggagggygyggygttgagygggattattattagggttggaaggagatttygagaatttttgtaggtaaygygygtttttaattttttttttttatgtttygtygttgygttt

SEQ ID NO: 3812 - DNA, 203 bp, synthetic construct
  misc_feature 1..203: note = Description of Artificial Sequence: Synthetic polynucleotide
  source 1..203: mol_type = other DNA
ggaagtagtggggggygttygaagagtagggtagttayggttatygtggtygtyggatyggttatgtgttaaagtttttggggttyggygtttygttgggygygtagygyggggagtagaygygtygtgggtggggtagygyggtgttgttggygttyggttttygyggggtgtagttttgygygtttttatgttgttttttt

SEQ ID NO: 3813 - DNA, 266 bp, synthetic construct
  misc_feature 1..266: note = Description of Artificial Sequence: Synthetic polynucleotide
  source 1..266: mol_type = other DNA
ttaggttatttygattttggtttttaggttygggataaygtgttagttttaagagagygttgtttatagtttygggtgggttgggtttaattgtayggggyggggygttaatagtttaggatttgggttgtaggttggtttttgtattaattagyggggyggtttygggttttagtttttttatttygtttaygaagggaggygattgygagygtttggggtttttgayggatttygtttygggggtggggyggggagtggttayg

SEQ ID NO: 3814 - DNA, 242 bp, synthetic construct
  misc_feature 1..242: note = Description of Artificial Sequence: Synthetic polynucleotide
  source 1..242: mol_type = other DNA
gtttagtagagatttggagttagaagtttagagatagtygagtgygtygtgyggttttyggaygttygttgtttagttygattttygttaattgtgtaggyggttgattygtagyggtagyggtagtagygaggattygagygttggttgtagygatattatggattttttttttatggtygygtaggtaayggggygttttttttaygygtttygggtygttaagtttggggaggttyggg

SEQ ID NO: 3815 - DNA, 201 bp, synthetic construct
  misc_feature 1..201: note = Description of Artificial Sequence: Synthetic polynucleotide
  source 1..201: mol_type = other DNA
agtttagattygygygaaygtggatgggtatatagtttygtttttttttattttgttttttygaggygttagtaatttgttttttgtyggtgatttygggygttttttttgtygtygtttgaggaaggttttgagattygttttgtgatygtgattygttaagygtygaygygtygyggtygtttgttttgttttgttttg

SEQ ID NO: 3816 - DNA, 201 bp, synthetic construct
  misc_feature 1..201: note = Description of Artificial Sequence: Synthetic polynucleotide
  source 1..201: mol_type = other DNA
ttttgtttyggtttttgyggggatggatgttttaygtagtaagygagtaagygagttttggagatyggggttttgggtgtgyggtyggtttagtgttaygyggtgagataggtatggttattaatttaygttaaggyggttgtgtatttggtatagaaaatattgttgttgaatgttgtttttatagttattygttagygt

SEQ ID NO: 3817 - DNA, 312 bp, synthetic construct
  misc_feature 1..312: note = Description of Artificial Sequence: Synthetic polynucleotide
  source 1..312: mol_type = other DNA
ttttttaatattyggtttgtaygtttggygggggygtaatagtgttttayggttygggagttygtttttggtttttgagtaaggtattttttttatttgtygtgtgtttagttgaatttagtatatttttttygtatttttygtttttttttttttttttttgaatttgtttttttgttttgygggtttttaatttttttygaatttygggygttyggttyggtttaggygagygttygyggttggggaygygggtggggaygyggyggtttgggygttgtaggatgygtttggtygyggaggagaygatta

SEQ ID NO: 3818 - DNA, 203 bp, synthetic construct
  misc_feature 1..203: note = Description of Artificial Sequence: Synthetic polynucleotide
  source 1..203: mol_type = other DNA
ygttggttttggttgtttgtggggtttttttaggtttyggggggtttgyggyggtttgggaggtagattttygygggtaggtgtggtygtgtttygatygygygaggatygaagttggyggaagtttttgtgyggtgttttttagttyggaggaggttggtttgaagtttttaggygttgtygaagtttttttttgttagygt

SEQ ID NO: 3819 - DNA, 201 bp, synthetic construct
  misc_feature 1..201: note = Description of Artificial Sequence: Synthetic polynucleotide
  source 1..201: mol_type = other DNA
ygtatgygygygygtaattagattttygtygtygtttttagygttttttttyggggtagggatttatttaataggttggggtttttggagtgygyggggtygygtggggaagyggggattttattttttttaygygtygtttagtattgggtaagggyggggtattttttgggttttygtttttygtygttygtttyggga

SEQ ID NO: 3820 - DNA, 283 bp, synthetic construct
  misc_feature 1..283: note = Description of Artificial Sequence: Synthetic polynucleotide
  source 1..283: mol_type = other DNA
agyggyggyggygggttttaggagtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttat

SEQ ID NO: 3821 - DNA, 201 bp, synthetic construct
  misc_feature 1..201: note = Description of Artificial Sequence: Synthetic polynucleotide
  source 1..201: mol_type = other DNA
gttttyggggygttttgttttgygttatygygygttygttygttygttygtttaatttatttgttgaagattaggtagtttaggtggttgattttgtggtyggagyggtggyggttgtagtttttttataggtttttgaaggtygtgatggttaggatgaagagtatyggygttagtgttaggtygggttggaaggygttt

SEQ ID NO: 3822 - DNA, 247 bp, synthetic construct
  misc_feature 1..247: note = Description of Artificial Sequence: Synthetic polynucleotide
  source 1..247: mol_type = other DNA
ttgagygygtgatatggtttgtygtttttgattaagaygggtayggttattyggygyggygagggtaggggygttatttttatatttttttyggttygggygygttttattttgtagyggtggttttggaattagattttgatttgygtgggygtgaggyggatgaggttggttaggtgttygygttygggygtygataggtatygttgttgtygaaagygtygttttagttygtaggtttgygttt

SEQ ID NO: 3823 - DNA, 427 bp, synthetic construct
  misc_feature 1..427: note = Description of Artificial Sequence: Synthetic polynucleotide
  source 1..427: mol_type = other DNA
ggggygtttttttaggggattgggggtggggaggagggygtaygggtyggggagggggttatyggatttggatttygggatatttygggggtttggggggygggtygygygtttatttgygttttygtygtygaaggagtttatgtaygggaagtagatggygagygtttygaaggaggyggatagattgaggyggttttgygagygttttatgttygygtyggygtygggygtttyggtygyggyggyggyggyggyggygggyggtttgggtagtttggtygttttatttttgaygyggagtayggygygyggygtggtggyggyggttyggggtygggtygaggtttygttgyggggttggygggygyggyggggtyggygggygggttaggagttggyggygygyggagttygaggygygttg

SEQ ID NO: 3824 - DNA, 246 bp, synthetic construct
  misc_feature 1..246: note = Description of Artificial Sequence: Synthetic polynucleotide
  source 1..246: mol_type = other DNA
yggtttatagtygggatgygttttygtyggggttatygyggyggygaaygtttyggatttygtatttyggtgattttttgggatgaatygaagtyggattygtattttggtygtaataagygygttttaygtygttaygtattagyggtgattttygagttttttgtygttttggttttttygtaggygggtttygaggttttygtagggagtttagggttayggttaygtgtagtygttttygag

SEQ ID NO: 3825 - DNA, 384 bp, synthetic construct
  misc_feature 1..384: note = Description of Artificial Sequence: Synthetic polynucleotide
  source 1..384: mol_type = other DNA
tgygygtyggtttggtttgtttgygggttttagagtttyggygttygttgtttttttygtttttttttttttttttatttttttttttttttagtygygaygygtagggggygggttttatttttttttygttttygtttyggttttaagtygyggaggygttyggtgggatttygttgttgtttaattaggggggatygggtgagtttttttttttggagtygggttttattagygtygtaggtttataggtygggggtgggggttttggatygaggggyggygyggggyggygyggggyggygygygyggttttggagygttagtatttgtttttygatttttyggtygtygttttyggtygtttyggggatttygttatta

SEQ ID NO: 3826 - DNA, 415 bp, synthetic construct
  misc_feature 1..415: note = Description of Artificial Sequence: Synthetic polynucleotide
  source 1..415: mol_type = other DNA
tgggtagttttaggtygtygaattyggygtttagygggggtagttygyggaaggygygagtygagttagaygtygyggggaaaggttygggyggtggttgygggggygttaatttygggagtaggaggtygggttttagtygtygggttttgygygtttgttttttgyggygyggtyggtatttgtagttggggtggtygygtaagtgttgtaygygtagtygttyggttttttttaygaagggtygttttttygtygygtttagttttttttaygttttgtttgygggtygtgggygttagtgagtggaaygtygtygggygggtgggygtygagtttttygtgygttygggaygtttygygagggtttggygtagttttygtatttygyggttygggatttttgtttttttyg

SEQ ID NO: 3827 - DNA, 543 bp, synthetic construct
  misc_feature 1..543: note = Description of Artificial Sequence: Synthetic polynucleotide
  source 1..543: mol_type = other DNA
tgygttttaygttttggagygtgaagtygggygttaaaaagttgttgtygggtygtagttttagatttagttgttggttaaaggygtgtaggyggaggygygtggtttygtgtttyggggygygttttagtttyggtattattagtttttygtttttttyggaggggygttygagtgygttygatayggttagtagygtygyggygagtagtagtagygtgggtattggtttaaagtttygagatttyggagttygtttygygttttttatgtygttgtttagtttgygtttttygaatttttygggtatagttygttgtattggagttttaggagatatygttygtagtagygtayggagygagggatttttagttygggtygggagagtaaagtttygttggtttgttttggattgttaaaattaataatttttattattygttggaagggygygtagagtyggttatagtygaagttttyggagttattaaaaggaggygttgtagttttgtyggygygygggaagttttttttttagyg

SEQ ID NO: 3828 - DNA, 227 bp, synthetic construct
  misc_feature 1..227: note = Description of Artificial Sequence: Synthetic polynucleotide
  source 1..227: mol_type = other DNA
ttaggagygatggttgtaatgtttttttttttgttttgtttttyggtgtygggagttttgtttttygtygttatttttggttagttttgygtaagaaygtygttttgtttggtagttaggtygagaygtagtttgaatgtgagtaggaattyggagaagggaagggagagaattagaaagaaggttygggagggattygggaagtagtgggaggtttgygttttgga

SEQ ID NO: 3829 - DNA, 323 bp, synthetic construct
  misc_feature 1..323: note = Description of Artificial Sequence: Synthetic polynucleotide
  source 1..323: mol_type = other DNA
tygtyggaagagttttgtagagtgagtttttagggttatttygttgttttttttttygttttygtagtygttgtagttagygtgggagtygggtaggtygygtggggygttggatttatygagaggttagygtygtygtygggggagggygtgtttygtaygtgtgtgttygygygtgttygygttygygtgtgttagygygygtgttttggtygtgygygtygagtygggtygtattaattttttyggygtygaygggtttagtttatggtgtgggygtygggtttagggaggtttyggttttygttaatygyggagtaggg

SEQ ID NO: 3830 - DNA, 279 bp, synthetic construct
  misc_feature 1..279: note = Description of Artificial Sequence: Synthetic polynucleotide
  source 1..279: mol_type = other DNA
ggtaygagygttagtagttygtaaaataggtagagtaygtttttygtgagggttataygygttttggtygggttyggggttaygtaggtggtgtattgygygttygttagggttaygaagagygtaaygaaygttagtagtayggygtttayggtgagygttygygtygtttgtatttyggtgtttagagttagtatygagtygtatattttgtattgtatgtgttyggtgttttgtattaygtaygatatttatagttttttttaggtggtttgygtc

SEQ ID NO: 3831 - DNA, 261 bp, synthetic construct
  misc_feature 1..261: note = Description of Artificial Sequence: Synthetic polynucleotide
  source 1..261: mol_type = other DNA
ttyggygygygtttttyggygtataygttttttattttygygtygygygggtygyggatttgtaggttgygygttttttgyggagtttgtttyggttttayggataggtttygtagtgagtaggtaagggtygtttygtygyggttgtttttttaygtttyggtygttttttttttttttagaattttygtttagtygggatttyggatttttttttttggtttggyggttttygttagtygygatttttatygayggaga

SEQ ID NO: 3832 - DNA, 364 bp, synthetic construct
  misc_feature 1..364: note = Description of Artificial Sequence: Synthetic polynucleotide
  source 1..364: mol_type = other DNA
gttygggttttgggyggygagggygtagygagggttgtygttttttygggtagtttyggggggygyggygttgggtygygggttygggggttgtygtgttygatygtatgygtygatttgtygttgggygttygtttttttttgttggggttgggygyggtttyggagtttggyggyggtggtgagggygtayggttagttgtagyggygttgtgtttgtygtggatttaggatattttaggtttggtggyggggttaggtggyggyggttttttgygttygggygatggygatagygataggtttttaatttygtttygggttygggtyggtygggtttygygtygggttaygygygygtata

SEQ ID NO: 3833 - DNA, 242 bp, synthetic construct
  misc_feature 1..242: note = Description of Artificial Sequence: Synthetic polynucleotide
  source 1..242: mol_type = other DNA
ggygttttttgagtttagagaagtgggttaagataagggaagaaaattttttatagaagaggagattttygtttttagtgttggggattttyggtattygygtttttgtgtttttggtggtttyggygttttttyggagygygyggtatgtttgtttttataygtttagtatttttgtttttagagtaaatttattttttagggtataygtagaggggtagttaggtatygtttttattttg

SEQ ID NO: 3834 - DNA, 285 bp, synthetic construct
  misc_feature 1..285: note = Description of Artificial Sequence: Synthetic polynucleotide
  source 1..285: mol_type = other DNA
ayggtygttyggggtygtattttygttyggtggyggygttygaagaygttagtygygttaygtattgtttgygtttygygttttagtygtygygtattaaygtygtygttttygtygggagttaagttygtygggtyggttyggttttaggtgggtagttyggtttgtagttggttggaggtggyggtygttgtagttttggtagygggtatatttttaagtataygtatttaaygttttttttttgagttaygaggatggagtagttatttyggttygggattg

SEQ ID NO: 3835 - DNA, 222 bp, synthetic construct
  misc_feature 1..222: note = Description of Artificial Sequence: Synthetic polynucleotide
  source 1..222: mol_type = other DNA
ggtattgattttttagttttttgtttgttttttygttttttttttttatttyggatatttttaggataattagggttgaagttttygggagaagtagtttygagttygtgggataagggggyggttyggtttygtttaggatttttttyggatttttttttyggttgtttyggttggttgtagggygygttatttygyggggaggyggyggtagyggtggyg

SEQ ID NO: 3836 - DNA, 201 bp, synthetic construct
  misc_feature 1..201: note = Description of Artificial Sequence: Synthetic polynucleotide
  source 1..201: mol_type = other DNA
gyggyggyggyggyggyggygggggttggggygygggggtyggattatgagtygttgagtygggtaaattttaggttatygagttagyggattttyggagygtagttttgygtygyggagtaggttttaattaggyggygaggyggttataygtatygagttagygattttygggygaygygyggggttagggagygttac

SEQ ID NO: 3837 - DNA, 298 bp, synthetic construct
  misc_feature 1..298: note = Description of Artificial Sequence: Synthetic polynucleotide
  source 1..298: mol_type = other DNA
gggattattttttayggtgttatygtatttatttygygtttttttttygttttttggagtttatygggattaggtggyggygggtgtttttttgggggtgygyggttatgtaattggtggatttttttaaatygttttggaggggggagygyggygttgggggygggagagygtttttggttgtgagttgtttttgtygtttygtttygygtttttttgtygtttygtttygggtttttygygttttttttttyggttyggtygagygygttgtttygaygtygttatttagagtygg

SEQ ID NO: 3838 - DNA, 272 bp, synthetic construct
  misc_feature 1..272: note = Description of Artificial Sequence: Synthetic polynucleotide
  source 1..272: mol_type = other DNA
tgatagggatygggtttagatttgttaaatgttgyggaggtagaatttgatagtgygggagggtaggygtttgggaggtaggagttggtggagatgatagygtggaattygtgagttttaygtaaygtttttttgtygtttagggtgggtttttagaagtatagaaatggtygggttgygggatattatagygaggaattagyggagtataggggttttaggagygtygggatatgttaggtygggtagatagtttygggtyggagtgagtg

SEQ ID NO: 3839 - DNA, 201 bp, synthetic construct
  misc_feature 1..201: note = Description of Artificial Sequence: Synthetic polynucleotide
  source 1..201: mol_type = other DNA
gagtatgagggagagtgttattttttagttgaaggttattgtgttttgtatttttggtttgggtaagtgaggagtttgttagtttttggtaggaagtgtaygtgatyggyggttggttaggggtatagagaygtattttatatagaaatttaggttggyggggtgggyggtyggggagttagttttgtagatgttattaag

SEQ ID NO: 3840 - DNA, 251 bp, synthetic construct
  misc_feature 1..251: note = Description of Artificial Sequence: Synthetic polynucleotide
  source 1..251: mol_type = other DNA
gtaggttgaaggyggagttggagatattyggggagtaggttyggagygttttygaggtyggggtyggygagggagaggtagggagttygaggaagggaggyggggygggtagggatygagttaggagagagygggygggggttttgggagyggttttygagagtggggtttgtggggagtagggyggtttyggggatagaggaagtygyggtggaggtttagggtagaygygggyggaygygaggagygta

SEQ ID NO: 3841 - DNA, 249 bp, synthetic construct
  misc_feature 1..249: note = Description of Artificial Sequence: Synthetic polynucleotide
  source 1..249: mol_type = other DNA
attygttttyggagtttygttyggyggtatttgttttggttaygygttttagtttygttaggtttttyggygggttygaattygtagtygggaaggtataygygagtaggagggygtattttatggttaggtgyggaygyggyggttgygggtggttagaygyggtaggyggagygtaygggyggygygtatttttttygyggtttyggagttyggygttttaggtgyggttttaggtgagagtygtyg

SEQ ID NO: 3842 - DNA, 249 bp, synthetic construct
  misc_feature 1..249: note = Description of Artificial Sequence: Synthetic polynucleotide
  source 1..249: mol_type = other DNA
gttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyggggatttgttggtgtttygagatttattgagttgygggggttttggagatttttaggtttgaaaagttagttttagaga

SEQ ID NO: 3843 - DNA, 201 bp, synthetic construct
  misc_feature 1..201: note = Description of Artificial Sequence: Synthetic polynucleotide
  source 1..201: mol_type = other DNA
ttgttygyggygtygggygygtyggtygtygggtggtggtggtggtyggyggygtggtggtggtggtggtggtagtgygggttygygtygttttgygyggyggtygyggygattayggyggatattayggyggyggyggggtttattttttygtygttgtygtttaaggaggygtyggtatyggtttyggtygtygyggtt

SEQ ID NO: 3844 - DNA, 201 bp, synthetic construct
  misc_feature 1..201: note = Description of Artificial Sequence: Synthetic polynucleotide
  source 1..201: mol_type = other DNA
ayggtatttayggtyggggggttygggggattyggygggyggyggayggygtatattygygattyggttygggagtygttgttttttttagtttggttttygtttttaygatttaggggyggttgygygttgttttttggygtygtatygggtttaggygygyggyggggttggggygygyggggyggtygtttgggttat

SEQ ID NO: 3845 - DNA, 251 bp, synthetic construct
  misc_feature 1..251: note = Description of Artificial Sequence: Synthetic polynucleotide
  source 1..251: mol_type = other DNA
yggygtygggtagygygtagagttagtygygtgtgtagggtygggtgtygttgygtgygggygyggggygygggttyggggygggtgtagggygygggatyggggtagygtaggagtaggtaggggttygyggttygygtgggttttaggygygggatggyggygtttagtagygygggttygygtagggygygtagygttgggggtaatagygtggggttyggtyggtagtggggygygggttgygyggt

SEQ ID NO: 3846 - DNA, 201 bp, synthetic construct
  misc_feature 1..201: note = Description of Artificial Sequence: Synthetic polynucleotide
  source 1..201: mol_type = other DNA
tayggtggattttgtgggtygttgagttttttgattttyggtttgttttattttgttttgttagtgggttttgygttygygttaataattygaatgggtaygtttttgygttttagaaygttgttygtttttttatatttagattgaggtggaatttaygttatataaatygggtygtaaggtttagtttagyggggtttt

SEQ ID NO: 3847 - DNA, 201 bp, synthetic construct
  misc_feature 1..201: note = Description of Artificial Sequence: Synthetic polynucleotide
  source 1..201: mol_type = other DNA
tggygyggggygtaggtgtaygtaggttggtygygggygygyggggttyggygggagtttyggggtggttttygygtggggtygggggygttygygygggyggggygaggtyggggagggtagttgttygtttttttyggtattgggagttttyggttggtattgygggaggagttttygggtgattygygggttttgaaa

SEQ ID NO: 3848 - DNA, 201 bp, synthetic construct
  misc_feature 1..201: note = Description of Artificial Sequence: Synthetic polynucleotide
  source 1..201: mol_type = other DNA
tgaggaattggatattaggygttggtygttttttatttttagtygttgggtgtttagagtttatttttagygattagagtagaattgtagagaagaygttygygttygggtttygtttggggagttagggygygyggggagygttygggtygygyggttattgatygttggttgtaygggggygtygtgyggattyggttt

SEQ ID NO: 3849 - DNA, 337 bp, synthetic construct
  misc_feature 1..337: note = Description of Artificial Sequence: Synthetic polynucleotide
  source 1..337: mol_type = other DNA
tttagggttttygggatyggtgttygttagtgggtataggaygtygggtgttygaagggttgtttggagatgtaattgattttggygggtattagaatgaygagtggtagtagtaggagyggggtgaygaataagattaygaaggatttgaatttggagatatagtttagygtygaggttatygygygggagggagattggygggygagaygagtgaggggtagttagaggygtygygggtttaagaaggggttatagttttyggggattggggagggggyggtgataatttygtttygtaygggggygttttttygyggttttggggyggggttat

SEQ ID NO: 3850 - DNA, 201 bp, synthetic construct
  misc_feature 1..201: note = Description of Artificial Sequence: Synthetic polynucleotide
  source 1..201: mol_type = other DNA
ggttygtgtagagtygtttattttttttygtagygtygggttgttttaaattgtttttggattttatttgtgagtygygtggttgggttgggttgggttgygygggatttgttagyggttttygttattttgttygtaggygtttatyggttgttttttgggtygtygttggtygtygttataygtgggaygtygagggta

SEQ ID NO: 3851 - DNA, 201 bp, synthetic construct
  misc_feature 1..201: note = Description of Artificial Sequence: Synthetic polynucleotide
  source 1..201: mol_type = other DNA
atatggygtatgatagggaattggtagggttatagtttyggattattyggggtagggtagggaaattayggtagattgygtagygtattttgttygggtgyggtgagggttgygtttygtttggttttygttataatttatagaaagttttygyggagtattggtgtttttgaatttattaggygatttygtygtaaagaa

SEQ ID NO: 3852 - DNA, 201 bp, synthetic construct
  misc_feature 1..201: note = Description of Artificial Sequence: Synthetic polynucleotide
  source 1..201: mol_type = other DNA
tygattttgtttygggtaatygatgggaaatttttygagagygyggtttttttggggattyggygtttttgaygtttttaggygttttttygggtygttgyggttttttttygtygttygttagygtttaaggtygygttttttttattttygtttttttttttttttyggyggttttyggatttggatagagttgtagga

SEQ ID NO: 3853 - DNA, 1216 bp, synthetic construct
  misc_feature 1..1216: note = Description of Artificial Sequence: Synthetic polynucleotide
  source 1..1216: mol_type = other DNA
taaggtggggatcgggacgcgatcggggatggggaagggggttgtaggaggtttcgtttgcgttgtcgtttttgttgggtatagcgttttttattattcgcggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcgattcggtcggcgtcgggtgcgtgtgggcgcgtgggtgttaggttgggcggaagcggcgtttttttttatgttgtaaattaagggattttttttcgtttt

SEQ ID NO: 3854 - DNA, 365 bp, synthetic construct
  misc_feature 1..365: note = Description of Artificial Sequence: Synthetic polynucleotide
  source 1..365: mol_type = other DNA
ggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggtt

SEQ ID NO: 3855 - DNA, 201 bp, synthetic construct
  misc_feature 1..201: note = Description of Artificial Sequence: Synthetic polynucleotide
  source 1..201: mol_type = other DNA
tggcgtgacggtttgtggggtttgcggggtgcgttgttttcggatttgcggggggaggcggttgagttggcggcgttcgcgggtttagtggtgagtgcggcgtttttacgtttagttcgacgttttcggagcggtcgtcgcgtaggggtgggcgcgggtttttaggagggagggcggttgtgaacgcgttttgtttttcgc

SEQ ID NO: 3856 - DNA, 201 bp, synthetic construct
  misc_feature 1..201: note = Description of Artificial Sequence: Synthetic polynucleotide
  source 1..201: mol_type = other DNA
attacgtcgttcgtgtttattatttacggtacggaggacgaggtgatcgatttttcgtacgggttggcgttttacgagcgttgttttaaggcggtggagtcgttgtgggtggagggcgtcgggtataacgatatcgagttttatagttagtatttggagcgtttgcgtcgttttattttttaggagttgtttagttagcgc

SEQ ID NO: 3857 - DNA, 201 bp, synthetic construct
  misc_feature 1..201: note = Description of Artificial Sequence: Synthetic polynucleotide
  source 1..201: mol_type = other DNA
gggcgcggcgggcgaggggttcgggttgagttgcgggtcggttcggatggcgggcggcgcgggttggtcgggcgttttcgcggttttgttgcgtttcgtgcgtcgtttgcgcgaggtgttcgaggtgtgcggtcgcgatttcgacggttttttgcgcgtggagcgcgtcgcggcgttcggattgcgtttcggttagggcga

SEQ ID NO: 3858 - DNA, 201 bp, synthetic construct
  misc_feature 1..201: note = Description of Artificial Sequence: Synthetic polynucleotide
  source 1..201: mol_type = other DNA
ggcgtttttttttcgtttttggtttaggttcggttcgcgggtgtagttttttttagggttttttttttttttcgggtcgcgcgttcgtttcgtatcgcggcggtttttcggtagtgtttgtttttattggacgtatagtgatcgtgacgggtacggggcgcgagtttttattattataatgggtgtgtatggcgcggggcg

SEQ ID NO: 3859 - DNA, 201 bp, synthetic construct
  misc_feature 1..201: note = Description of Artificial Sequence: Synthetic polynucleotide
  source 1..201: mol_type = other DNA
tttttttttaattgatttaattttttaattttagtttttcgtttttggtatcggtttttttttaagtttttagattttaattttggttttcgattcgtttcgttatagtttgggaagcgggagaagtagcgcgcgtttttttgcggatttttttttagggaagattgtggtgttagttgtttagggggattagggggttat

SEQ ID NO: 3860 - DNA, 201 bp, synthetic construct
  misc_feature 1..201: note = Description of Artificial Sequence: Synthetic polynucleotide
  source 1..201: mol_type = other DNA
agtttaggggtagggggtttagggtagttagatttttttaggtttaggaagagtagtttttagcgttcggttgttaggtaattcggttttcggttttttacggcggttttttcggtgtgttttattaagagcgatagggttggtgattcgaggggcgcgtgcgcggtcgttagtttgggatttgtacggattttttttttt

SEQ ID NO: 3861 - DNA, 213 bp, synthetic construct
  misc_feature 1..213: note = Description of Artificial Sequence: Synthetic polynucleotide
  source 1..213: mol_type = other DNA
gttttttgtttgaattaaagtggttaggtatttagtttgtaagatgaataaatgaaggaaagaaggaacgaatgaataagggtttattttgtagagcgttcgcgttttagcgcgtattaggtatattagtgttaaaggtgttgggggtcgggtttagcgttcggcgcggttggaatgggggcggcgaggagttttttttagttagtcgtaggg

SEQ ID NO: 3862 - DNA, 201 bp, synthetic construct
  misc_feature 1..201: note = Description of Artificial Sequence: Synthetic polynucleotide
  source 1..201: mol_type = other DNA
gggaggcggtaggtagggggcgttgcggggcgaggtaagtgtagttcgtcgttgtttgtttgcgagtttggggttgcgcgtcgttttttatttagttgcgcgattcgagcgtcgcgtttatcgcgtttcgtgggttttcgcgtttcgaagggtcgggattcggtttgagttttttttggttttcggtgtaagtcgttgggt

SEQ ID NO: 3863 - DNA, 201 bp, synthetic construct
  misc_feature 1..201: note = Description of Artificial Sequence: Synthetic polynucleotide
  source 1..201: mol_type = other DNA
cggggtattcggtcgtgtcgtcgtcgtcgttttagttgtcgtttttgttttcgttttcgcgatcgttgttagagcgtattattcgcgaggaggtggagggcgaaagtttggatttgtgtttgtagtagttttataaatagttaagtagttgggtttggttggtggtgggttcgcggtttttatcgcgtcggtttcggacgc

SEQ ID NO: 3864 - DNA, 201 bp, synthetic construct
  misc_feature 1..201: note = Description of Artificial Sequence: Synthetic polynucleotide
  source 1..201: mol_type = other DNA
aaggggggtttggttcgttagcgtaggggattcgagttgggtaggatatgtgagatagttatagttttttagagattacgataagatttaattagtcgcgcgtggttttcggcgtcggagcgggttagtttagttcggtttagttcggtttcgcgtagagttttcgtcgttttcgcgtatagagtcgggtgttttttgcgg

SEQ ID NO: 3865 - DNA, 324 bp, synthetic construct
  misc_feature 1..324: note = Description of Artificial Sequence: Synthetic polynucleotide
  source 1..324: mol_type = other DNA
ggtgggggtttgggagacggtcgaagggggttcgggtagaagtttcgcggtcgggtcggcggagggaagggggcggtcgcgttcgggattcggtttttttcggttttatttatttgtttcgaagagtggttttagttttgcgtttttttttgcgattttatatatagggatagttttaggtatagttttagtagtaggagtatggcggggcgagggcgcgggacgttcggggattcggcgggatacgttttgtagcgtttagggttttagttattgcgggacgttttcggggtcgtttatttcgcggttttagttcggatttcg

SEQ ID NO: 3866 - DNA, 201 bp, synthetic construct
  misc_feature 1..201: note = Description of Artificial Sequence: Synthetic polynucleotide
  source 1..201: mol_type = other DNA
tcgcggtgttgtcgcgttaagcgaaggaggaggagggttcggcgattttggggacgaacgttttggacgtttcgttcgcgtttttttttcgcgttcgtcgcgcgtttgtttgttcggtttttttttcgtttttttttcggtcgttcgggttaaaatttaaggttaggtttttgagggttcgggttttttagtcgttttttt

SEQ ID NO: 3867 - DNA, 330 bp, synthetic construct
  misc_feature 1..330: note = Description of Artificial Sequence: Synthetic polynucleotide
  source 1..330: mol_type = other DNA
ggattttggcgtttttttaggttgttgcgcgcgggttggggatcgtgtatcgttttgcgcgttagacgatgtattttttggaacggtagttgaggtaatgcggggtgtgaagtggcggcgggtagaggggttcgtaggggttgggattcgcgtgtttttttttgtttcggtgcggagtacgatgtgttcgggcgggggcgaggacgttcgggaggggttgggttgcgtacgttcgcggggtcgtcgtagatgggcggtttggaggcgttgtagtttttgggaaatgggagttttcgttttgttttttttgttgtttggttgggttgggtt

SEQ ID NO: 3868 - DNA, 293 bp, synthetic construct
  misc_feature 1..293: note = Description of Artificial Sequence: Synthetic polynucleotide
  source 1..293: mol_type = other DNA
tttagtattttagtttttaagtttttttgagtcggggttgcgttttcgttgtttttttcggtcgtcgttttttggcgttagagggatttcgcggttcgtacgggtttgttttcggtttcgttcggagggtgtgcgggttttcgtttcgttggtttcgtttgtttattacggcgcgtttaaatttacgcggttcgcggttttttgcgtgttttgtcgatttcgggtcgtaggaggggttagtttcgtcggtttttacgcggggtttgcgtcggtagcgttacgggttggaacgc

SEQ ID NO: 3869 - DNA, 201 bp, synthetic construct
  misc_feature 1..201: note = Description of Artificial Sequence: Synthetic polynucleotide
  source 1..201: mol_type = other DNA
cgttttcgtttcggtttttcgtcggtttggcgggcggcgacgtggggaggggtcgtttagaagtcggggtcgttcgggtcggggaattttttcgcgtcgacgtttattttttacgggtcgtattcgtcgaggggtcgaaaggggttttagtggaggacgcggtgggagttgggtttcgttttagttgtcgacgtcggcggt

SEQ ID NO: 3870 - DNA, 201 bp, synthetic construct
  misc_feature 1..201: note = Description of Artificial Sequence: Synthetic polynucleotide
  source 1..201: mol_type = other DNA
tatttcgttaaagtcggataaagcgtggttagagtgcggtttagttttttagtttgcggttcggggaggagggtagcgcgggcgcgggttgggggtggcgcggggcggcgtttaggatttcggtgtaggcgagagtgcggcggatttgttttaagaggagagcgaggcggatttgttttaagaggagagcgtggggcgtcg

SEQ ID NO: 3871 - DNA, 226 bp, synthetic construct
  misc_feature 1..226: note = Description of Artificial Sequence: Synthetic polynucleotide
  source 1..226: mol_type = other DNA
atggcgatgtttttatttttttcggtaggtttttttaattaaaaagttggaaacgggaattcgtaaataacgatttagggttttaaattatttgtaaagacgcgatggggaggggaatatttgcgcgttttaaaattttaatttcgaggtttttagtcgcgtttgattcgggagtcgggtgcgtttttagtgttcgcgtacgaattcggcgttttggtagtttcga

SEQ ID NO: 3872 - DNA, 363 bp, synthetic construct
  misc_feature 1..363: note = Description of Artificial Sequence: Synthetic polynucleotide
  source 1..363: mol_type = other DNA
ttgtaagggattatagttataatttattaggtaattatatttatcgtattgtagaagttatgaatttggcgggcgtgggggggaaggggaagaagttcggcgagattagaggggaaattcgaaaaagtaagtttttgcggtagtagttaggaaatattcgttaggaattggttgcgattttaattttagcggttcgaagttttagtttttttatttttatcgcggtagagtcgttttcgtagatatttttcgaggagaatcgcggtttcgagggcgttaggtgagtcgcgtcgtttcgagttttcgggttacggtaggtcgatttaggcgttttcggttcgttcgtgttttcgcgttcgggtg

SEQ ID NO: 3873 - DNA, 201 bp, synthetic construct
  misc_feature 1..201: note = Description of Artificial Sequence: Synthetic polynucleotide
  source 1..201: mol_type = other DNA
cggttcggtgggggtttcggcgagcgggagggcggttggggatttcggtcgcgtcgggcgcggggttcgggattcgggagatcgcgcggcgtcgaagttacgcgttagttttattgtttcgcgcgtttcgttttaggtttcgggtttttttttcgtatttcgtaaagtcgagattttttcgtagttttttatttcgagagg

SEQ ID NO: 3874 - DNA, 201 bp, synthetic construct
  misc_feature 1..201: note = Description of Artificial Sequence: Synthetic polynucleotide
  source 1..201: mol_type = other DNA
tcgcgttttttcgttagtcgtcggttaggagtttttcggtttttgagtaggacgcgttaaagggagttgggaggtttagtagtttttagcgtcgttttttcgggtgacgtgacgttttttttggagcgcgggttcgttttcgttaagtttttatcgtaggtttttatagtcgagttacgggaagatgtaacgtcgggcgag

SEQ ID NO: 3875 - DNA, 267 bp, synthetic construct
  misc_feature 1..267: note = Description of Artificial Sequence: Synthetic polynucleotide
  source 1..267: mol_type = other DNA
cgcggggtgggggcgcgggagtcgttttttgttcgtttcgcgcgtatgttttcgtcgtatttgtttcgtttagtgttttatatttcggggagtcgggtggcgttgggttcgtcgaggtcggggtttttttatgggagggaggtggttgcggcggaatttttagatgcgtttttttttgtattcgttttttgggaaggatttttttaaattttggttattttttgtttgttagtttgttttttggtagcgaagttttagtagtttatt

SEQ ID NO: 3876 - DNA, 707 bp, synthetic construct
  misc_feature 1..707: note = Description of Artificial Sequence: Synthetic polynucleotide
  source 1..707: mol_type = other DNA
gcggtggcgtcggcggttgtagggggacgagttagcgtcgcggcgttgggagttagttgagttcggtcggcgagcggaggcggtagcgtaggtagagcggcggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcgttttggattttggagatgttaattttagttcggatatttgggttgtgttattcggattattcgggtcgtatagagtatgcgtgattttttttatttttt

SEQ ID NO: 3877 - DNA, 201 bp, synthetic construct
  misc_feature 1..201: note = Description of Artificial Sequence: Synthetic polynucleotide
  source 1..201: mol_type = other DNA
ggatttaggattttgtgttcgcgtttttggagtcgttggagttcggatttttgtaattgttggtattttgggggtttggtttagcgttttgttgtttattcgttttttttcgttgtttcggaattaaagttttcggtttttttcgttttcgcgcgtttatttatcgtcgtcggggagcggttcggttcgtatttagtatta

SEQ ID NO: 3878 - DNA, 201 bp, synthetic construct
  misc_feature 1..201: note = Description of Artificial Sequence: Synthetic polynucleotide
  source 1..201: mol_type = other DNA
taggtttcgcgtttgattttttagtttgcgtagcgggtattcggtcgggaagaatttttttagtaggcggtttagtattacgtttacgcgttcgcgttcgcgttcgcgttcgtggtcgcgcgggttttagttttacgtagcgtttatagatcgtgagttcgtagggtagtgttatcggtttgtgtagtagtttcgggtagt

SEQ ID NO: 3879 - DNA, 201 bp, synthetic construct
  misc_feature 1..201: note = Description of Artificial Sequence: Synthetic polynucleotide
  source 1..201: mol_type = other DNA
tattgggatttttatatacgagttggtatatattagttatatacggttaattttagagggttggttttttgttttgggacgtttttaggttttcgggtcgcggtgcggagaatttaggtgggtgttcggtaagttatttattaggggttgttttttcgcgattttcgttataagcgtagggattcgggggtcgcgttggtt

SEQ ID NO: 3880 - DNA, 201 bp, synthetic construct
  misc_feature 1..201: note = Description of Artificial Sequence: Synthetic polynucleotide
  source 1..201: mol_type = other DNA
gaaaattgtaaaatttgggagttattttgttttatttttttgttgtttggggatatttttcgcgagtttgttcggtttcgaagaaggagtagaggggattcgtaatttagtttttagagtttcgttaggaaaggcgcgagagatttattggtttcggtaattttgtttcggcgttcggacggagttcgatgtttgcgtagt

SEQ ID NO: 3881 - DNA, 203 bp, synthetic construct
  misc_feature 1..203: note = Description of Artificial Sequence: Synthetic polynucleotide
  source 1..203: mol_type = other DNA
agtttagagtgcgtcgagtatcgtttcggtaggtggaggggttgcgggaaataaaataatttgggtaggaatttgattggtagtaggtttatttttggttcgcggtagggaatttaatggagatgaagaatggtggggaagggggggcggtgtttttttgggagtttaacgtacgtttttttattttgttattttttggagat

SEQ ID NO: 3882 - DNA, 201 bp, synthetic construct
  misc_feature 1..201: note = Description of Artificial Sequence: Synthetic polynucleotide
  source 1..201: mol_type = other DNA
cgcgcgttttttcgcgcgtttttcggattcgcgtttgtttattttttcggttttgttgcggtcgaggttttaagtcggttatttcgtgtttaggtaatcgcgggggcggcggcggcggcgtgaggagcgggcggttgttgtttcggggttttttggttcgagtttttagttttcgattttcggcgtttcggcgttcgatta

SEQ ID NO: 3883 - DNA, 201 bp, synthetic construct
  misc_feature 1..201: note = Description of Artificial Sequence: Synthetic polynucleotide
  source 1..201: mol_type = other DNA
gggtttttagtttggtttttaggcgcggtggcggcggtgggatacgcgttaggcgtttagagaaggatatgggataatggtttagttcgaggacgttagacgtcgtcgttcgattcggggaaggaagtttttgtagtcggttcgggaattcgaggcggggagggaggttagttttggaggtgcgttgtcgttttaaaataa

SEQ ID NO: 3884 - DNA, 208 bp, synthetic construct
  misc_feature 1..208: note = Description of Artificial Sequence: Synthetic polynucleotide
  source 1..208: mol_type = other DNA
gcgtcgcgtcgtcgttcggtttttcgaagtcgttttttgtcggcgcgtcggtcgtttgcgttacggcgggcgttatttatttcgggtagagttttttgttcgtgtagcgcgttttgggtttttagcgttgatttacgttcgtagtaggtgaggaaggcgtagtttggggaggaaagtaagcgttaagaagggttagtggggcgttttc

SEQ ID NO: 3885 - DNA, 201 bp, synthetic construct
  misc_feature 1..201: note = Description of Artificial Sequence: Synthetic polynucleotide
  source 1..201: mol_type = other DNA
gtaggggggttttatttattaagttatgttttattagggcgttaggcgggcgaagtaaaggtagggatggcgggcggggcggcggcggaggtggaatgggcgttttttttttttatttggttttatttatttatttagattagaaaagcgagtcggtttggagggagttcgttcggggattcgagcgcgtatttattagtg

SEQ ID NO: 3886 - DNA, 201 bp, synthetic construct
  misc_feature 1..201: note = Description of Artificial Sequence: Synthetic polynucleotide
  source 1..201: mol_type = other DNA
gcgtttcgtttttcgtttcggcggttttcgtagtttcgtcgtcgttcgcgttcgcgttttggagtcgcgttataaagggttcgcgcgtagtcgtcgtcgtcgtcgtcgtgcgaggagttaggatggttttggtttacgtcggttatttcgtgtttttagtgtttggttttgtgcgaaatagaggtatcgtttttttttttc

SEQ ID NO: 3887 - DNA, 595 bp, synthetic construct
  misc_feature 1..595: note = Description of Artificial Sequence: Synthetic polynucleotide
  source 1..595: mol_type = other DNA
aggaggttaggaaagtttattatatgcgttggtttcggttgtcgtacggtatttttatggttatcgggatgatgagcgtatttattttgggttcgtggattgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcgttcgggggggagggggatggagtgcgcgggtagtttttttttttcggttcgcgtttcgttcgtttcgggttgcgttggtttcgagcgtcgagagttagg

SEQ ID NO: 3888 - DNA, 201 bp, synthetic construct
  misc_feature 1..201: note = Description of Artificial Sequence: Synthetic polynucleotide
  source 1..201: mol_type = other DNA
tatcgtcggcgtcgaggcggcgtttatgtttaatcgtcgtcgttatcgtcgtcgtttgtttttgcgttcgttttcgcgtttgttgttttttcgtcgtcgtcgtcgtcgtcgttattatagattcgtagatatatagttaagatttttgatttttaatattaatttttttttttggggaggggaggggacggagggaagggg

SEQ ID NO: 3889 - DNA, 269 bp, synthetic construct
  misc_feature 1..269: note = Description of Artificial Sequence: Synthetic polynucleotide
  source 1..269: mol_type = other DNA
ggtgtgatgttttcggtggataatgtttttcgttttttgtttcggggtttagatagttggtgtttaagcgtttataatgtagagttttttgtatttttttcgggtcgttatttgtttatttgttttatttaggatatttttttaaataatttttaagtggaaaaattacggttttttaggagatttattcgggaacgaacgtgcgtggggtagtttaaatttttgagtttagatttcgtttttcgcggttagatggtgcggtcggtggg

SEQ ID NO: 3890 - DNA, 201 bp, synthetic construct
  misc_feature 1..201: note = Description of Artificial Sequence: Synthetic polynucleotide
  source 1..201: mol_type = other DNA
ttagtttgttatcgtacggcggtcgggatcgtagtttttgggtgcgtagtgcgtttttcgttgcgtttttttagagcgcgggtttcgtgtttgtgttcggcgcgacgcgatttttttgttagtcgggtttcgcgtgtttttcgcgtttttcgtagttttcgcgtagttcgtagcgttttttagtttcgtttcgcggtcgcg

SEQ ID NO: 3891 - DNA, 267 bp, synthetic construct
  misc_feature 1..267: note = Description of Artificial Sequence: Synthetic polynucleotide
  source 1..267: mol_type = other DNA
gtaggagtttcggcggtttgtaggggcggtggcgcggcgttgggcgcgcggtcgttagatggtagcgtagtttcggttcggttcgcgggaggcggttacgcgcgggggacgcggggcgcggcgcgttgagcgcgggtgtcgaggttggagggcgcggtcgggttttcgagtttttttttcgcggtatttttgtttttatttttaaatgttttgtaagttaggagttttcgtaggaatcgttgtatttttatttttttttaaatttta

SEQ ID NO: 3892 - DNA, 287 bp, synthetic construct
  misc_feature 1..287: note = Description of Artificial Sequence: Synthetic polynucleotide
  source 1..287: mol_type = other DNA
ggcggtgtgtagagtggggtttgggttttttgtttttaagggtagttgggtgggtttcgtgtttttttcgagtggatttggtttcggttttaaatttagtcgagggtcggttcgtttttggggattcgcggatgtcgcgagggggcgtcgcgttattgaaggttgggacgggggcggtgcgcggggcggcgtcggagttcgggatgtcggttttagagacgtcgcgtttcgtttcgaggaggtcgtcggtcgggtaagcggagttcggagttcgcggagtttggatc

SEQ ID NO: 3893 - DNA, 201 bp, synthetic construct
  misc_feature 1..201: note = Description of Artificial Sequence: Synthetic polynucleotide
  source 1..201: mol_type = other DNA
ggtttgtttcgagcgcggcgggggcgtcgggggcgtcggtttttattttgtagggtatcggcggcgggaggaggggtcggcgtttacgggttttcgttttcgcggcgtcgcggattaggagttggaattgttgcgggagtgtttgggagtcgtcgtgtttgttcggttgcgtaaggtggttttcgcgttggtgttaggtcg

SEQ ID NO: 3894 - DNA, 201 bp, synthetic construct
  misc_feature 1..201: note = Description of Artificial Sequence: Synthetic polynucleotide
  source 1..201: mol_type = other DNA
gcgtttgttcgcgttttgtttaggtggtttcggcggtttcggcgattttttgcgagcgttgttgtttttgaaggcgttgtagggtttgcgcgtggagtggcgcgggcgggattcgcgcgggtcgggtcgggtatagcgtagcgcgggggttatcgtcgtcgacgggtcgtgcgcgttgcgcgagtttagcgtagattttcg

SEQ ID NO: 3895 - DNA, 286 bp, synthetic construct
  misc_feature 1..286: note = Description of Artificial Sequence: Synthetic polynucleotide
  source 1..286: mol_type = other DNA
tttagggggcgttttcgagtcgcgtttcgcgttcgtttttaggagggttttcgcgagtcggttgtatatttcgaggcggtttcggttgtataatttggagcgagttgtttcgtttttttattttgggggcgaagaagggtcggggagtgggggaaagcgggaggcgtcgcggtttgggaggttttcgcgggttttagcgtcggtcgtattgcggtttttttcgcgcgtcgtcgtcgtcgtcggttttttttcgtttcgttttcgcggttttcggcgtttttcgcgc

SEQ ID NO: 3896 - DNA, 244 bp, synthetic construct
  misc_feature 1..244: note = Description of Artificial Sequence: Synthetic polynucleotide
  source 1..244: mol_type = other DNA
tagtagattttggcgtggggtatttgagattttcgttattgaaaaggcgttatagaaatgtaaggaattatgattttaataaaattgttttatttaggagcgagtttttgcgttgtttttgtcgtcggagttcgggtttgttacggtaaagtttgtaattagagaaaaatattagttttgttgagggttagaatatattattggttaatgtgtgtggttttttttttaaataatgttaagtatt

SEQ ID NO: 3897 - DNA, 201 bp, synthetic construct
  misc_feature 1..201: note = Description of Artificial Sequence: Synthetic polynucleotide
  source 1..201: mol_type = other DNA
gtgggtcggggatttcgttgttttgtttttttagcgggaaattgattgtttgagttttggaggataaatagagatattggggggttaacgggggcggtcgcgggcggggttttaggtttttatttatcgggttgttgagcgcgtacgtagttattcgagggaagattttcgtcgttcggggtttcggagaggggttagaat

SEQ ID NO: 3898 - DNA, 372 bp, synthetic construct
  misc_feature 1..372: note = Description of Artificial Sequence: Synthetic polynucleotide
  source 1..372: mol_type = other DNA
gtggtattagcgaatgtggtggatttcggtaggtttggggtaggggaattttcggtaatattttttagtatcgaaggtaggatttttcggttattttcgtcggttggaatttttttaagtattgttttgagtttatttttaaatgaaagggggaaaaatttaaattagattagaatttgaaatagttgaaatagttatcgatttttagtttgtttttaagtttggtagagattgtgaaagttttaattttttcgcgatgttagttacggttcgcggcggttacggagttattttagtatttcgcgatggatagtgattttcggcgtggcgcgagttttttgcggtttttacgcgggtttgggcggcgggttt

SEQ ID NO: 3899 - DNA, 201 bp, synthetic construct
  misc_feature 1..201: note = Description of Artificial Sequence: Synthetic polynucleotide
  source 1..201: mol_type = other DNA
agttagttttataatttgcgatcgatttttttttgtttagttcggttttagttttttttagttataagatggtaatagcgtcgatagtcgggtttcgcggcgttttgttttttttttgttttggtttggagttttttttgggtagttttgtatttatagcgttgcgttttttttagattgtgtagggagtacgggagggtt

SEQ ID NO: 3900 - DNA, 247 bp, synthetic construct
  misc_feature 1..247: note = Description of Artificial Sequence: Synthetic polynucleotide
  source 1..247: mol_type = other DNA
gttttcggggggttttggcgttttagttgtggattttttaatattcgtaggttatagagttatagaggttggatttttagtagtagaggatatagaagaacgaagacgagacgtagagttttaattgtagttagagataaaggtttcgttatatttcggaagtcgttttgtttttttttgtttcgtgtttgattggacggtttttagtttagcgtttttgattggataatttttaaggttttgtttt

SEQ ID NO: 3901 - DNA, 201 bp, synthetic construct
  misc_feature 1..201: note = Description of Artificial Sequence: Synthetic polynucleotide
  source 1..201: mol_type = other DNA
gatttggcgcggtttttgtttttcgttgtcgtcgaagttttaattttcgtttgtttgttttgtgttttttgtacgtagaagtttagtttgtgtggttttgcgatttgcgggtattgggagatttatagttaagacgttagggttttttggaagtttagaaatggtgagagtgtcggttcgatatttcgagagagggaacgg

SEQ ID NO: 3902 - DNA, 201 bp, synthetic construct
  misc_feature 1..201: note = Description of Artificial Sequence: Synthetic polynucleotide
  source 1..201: mol_type = other DNA
ggcgttttagttgtggattttttaatgtttgtaggttagagggttatagaggttgggtttttaagagtaggggatataaagtagggaagacgagattaagcgttttagttgtagcgagagataaaggtttcgttaaatttcggaagtcgttttgttcgttttagttgcgtgtttgattggacggtttttagtttagggttt

SEQ ID NO: 3903 - DNA, 235 bp, synthetic construct
  misc_feature 1..235: note = Description of Artificial Sequence: Synthetic polynucleotide
  source 1..235: mol_type = other DNA
tttggtcggattgcgcgtttagggtttttcgcgtttgttagttttcgttttgcgggtattttttttagtatcgggagcgcgcggttgttcgttttcgtcgcgatcgtggcgttagtttttcgttttttttgtttcgttttgagtatttgttttgcgtttttcgttgtaattttttatttttcgtttggattgcgggtttgggtgcggggtgttgtaggtttgtaggggacggggt

SEQ ID NO: 3904 - DNA, 201 bp, synthetic construct
  misc_feature 1..201: note = Description of Artificial Sequence: Synthetic polynucleotide
  source 1..201: mol_type = other DNA
atttcgcgttttttagttcggagtttatttgtataattggattttttttttttgtttttttttttttttttgaaatttgtttgaaaatttaagtgaaaatcgcgacgatttgtatatttaaaagtaagtgttaagtaagtgttttgcggtggtttcggcgcgtttcggggtgagcgcgtaaagtcgggagcgaggtgtcgc

SEQ ID NO: 3905 - DNA, 201 bp, synthetic construct
  misc_feature 1..201: note = Description of Artificial Sequence: Synthetic polynucleotide
  source 1..201: mol_type = other DNA
gggcgcggttttgggagcgggggaaggtgaggggaaatgggatatgatggtattaataatcgttattaaagacggtgggagtaataaaggaatgcgttttcgagacgtcgtttagtttcggggtgttttttggcgcggtcgcggtgtaggaacgcgagtttcgtcgtcgagtttttcgtcgtttgcgttcgttggcgcggc

SEQ ID NO: 3906 - DNA, 201 bp, synthetic construct
  misc_feature 1..201: note = Description of Artificial Sequence: Synthetic polynucleotide
  source 1..201: mol_type = other DNA
gttcgggcgcgtcggttggggttttggcgttttcgtaggtttcgaggtcgatagtttcggcgagggcgggcgtttcgcgttttagtatcggttgtttgagcgtttttggagtagtaaattttagatttttttttttttttttttttttttttttttttttttttttatttttttttttttttagttttttttttttttttt

SEQ ID NO: 3907 - DNA, 201 bp, synthetic construct
  misc_feature 1..201: note = Description of Artificial Sequence: Synthetic polynucleotide
  source 1..201: mol_type = other DNA
tttgttttaaaagtttatagtatgttttttttttttttagatcgggagatagtgattttatttatacggtaagattaaaagttttcgttcgtttagtttgcgggtttgggttgggtttagacgttttttaggatgtagatgcgtcgtcgttggttttttcggttataaagtcgtttttagcgttttttcgcgcgtaggagc

SEQ ID NO: 3908 - DNA, 201 bp, synthetic construct
  misc_feature 1..201: note = Description of Artificial Sequence: Synthetic polynucleotide
  source 1..201: mol_type = other DNA
gggcgaagcgatttagcgcgaggattagtttttaattaattcgtttttagttttgggcgttttttttagtagttagatgggggttttagaggtcggtgcgcggttatatggtttcgggttaggtagggggtcgtggggacgtatttgcgttaggcgtatagtatttttgggcgcgggacgggcgaagcgtcgtgggtttta

SEQ ID NO: 3909 - DNA, 296 bp, synthetic construct
  misc_feature 1..296: note = Description of Artificial Sequence: Synthetic polynucleotide
  source 1..296: mol_type = other DNA
tgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgg

SEQ ID NO: 3910 - DNA, 201 bp, synthetic construct
  misc_feature 1..201: note = Description of Artificial Sequence: Synthetic polynucleotide
  source 1..201: mol_type = other DNA
agtttacgggttagtttggcggggttcgacggcggcggcggtggcggtagcgttcgatttagcggtattagtttgggttacgattagcgttacggtagttcgcgtttcggtcgttcggattcgcgtttcggtttcgggtcgttttcggtgggtagcgttcgttttagcgtttttagtttcggttttcggggttcggtcggc

SEQ ID NO: 3911 - DNA, 201 bp, synthetic construct
  misc_feature 1..201: note = Description of Artificial Sequence: Synthetic polynucleotide
  source 1..201: mol_type = other DNA
atttattggttgaaagtttcgtttattttagggtgattgagagcgttttttttttttgtgttgtttggaaacggattgttcgtttagtaatatttgattacgttttttattggttatcgttttcggaagttcgttttttcgttttcggaattttcgtaggcgttgggtttgtagatggcgtttaggtatatagtggcgagt

SEQ ID NO: 3912 - DNA, 266 bp, synthetic construct
  misc_feature 1..266: note = Description of Artificial Sequence: Synthetic polynucleotide
  source 1..266: mol_type = other DNA
gaaagataaaagggaaagcgtttttacgaaattcgtttacggatacgatttcggggttatatttagttagacgaatgtttggtaaatgatagttattttacgttagatttttatagttttttatacgttatttttattgttttagggaattataagtataggtatcgtttcgttcggcgtttttttttaaagattggggtattaggatcgcgggtttttatttttatttagtataaagagttcggcgtttagagttagcggttttt

SEQ ID NO: 3913 - DNA, 201 bp, synthetic construct
  misc_feature 1..201: note = Description of Artificial Sequence: Synthetic polynucleotide
  source 1..201: mol_type = other DNA
tcgtaggttatttgtgtgatttcggtgcgagtggaggttggtatcgtttagtgcgaggttgttatttcgtgtgtttgtttacgttttgtgtgattgggtgcgaggaagttaatggtatcgtggaatgtgaggttgtgagttgaggcgggagcgggcgattgttcgttgtattttgttgggtcgatattcgcggtttttttg

SEQ ID NO: 3914 - DNA, 228 bp, synthetic construct
  misc_feature 1..228: note = Description of Artificial Sequence: Synthetic polynucleotide
  source 1..228: mol_type = other DNA
tagagtttaggatattttaggttttttttgattcgattggaatttattttttacgtttttttggttttaattaatcgttatttgtatgtataaatggaaacgatagggtagagggttagtagttattcgcgtttgggttcgtagtttcgggtacgttgtagtttcgtattcggttgtttacgttcgggattatttattgtgttttttcggaattgtttagcgtgtttt

SEQ ID NO: 3915 - DNA, 248 bp, synthetic construct
  misc_feature 1..248: note = Description of Artificial Sequence: Synthetic polynucleotide
  source 1..248: mol_type = other DNA
agattttagatatttattttaaatttaggttttagcgttttgtaggggatttttattttggggcgtttatttttgattttttttttgggttttttcgttacggtcgagtttaagtggttgaagcgcggacgaggatgcgcggggtttcggtttttaattgtattataggtcgtatttacgaatttggttcggtatagttattatcgttcgggtttttaggttttagggttgtagaagtttagtttcgg

SEQ ID NO: 3916 - DNA, 387 bp, synthetic construct
  misc_feature 1..387: note = Description of Artificial Sequence: Synthetic polynucleotide
  source 1..387: mol_type = other DNA
gaggcggttatcgtagcggtcgttaacgagtagttgtacggaggtgtagaagaaggaggttattgttatttttttgataagttgggggcgtgggaggtttcgggagttcgaagtcgtttcgagcgggggtgggcggtgagcggattttcgggtgttgattaggtgtttggtggtagagtagggaaggggggaacggacgtcgattttagggattttttattcgtttacgttttttggcgttggttatacgtcgtcgttttagtattaattggaggtttttagtggacgagtagtcgttcgagggtagtcgtttgagtcggtagatagcggttagttggggtagcggttcgaattgttttcgtaatacgttttttagtatttcggttt

SEQ ID NO: 3917 - DNA, 203 bp, synthetic construct
  misc_feature 1..203: note = Description of Artificial Sequence: Synthetic polynucleotide
  source 1..203: mol_type = other DNA
cgttgtttttttgtgcgttatcgggggtttgttttgggtttgttcgatatcgtggttgttcgtttatttgagcgtaggtttttattttgtgttagggtcgcgcgtggttttcgtttgcggtttgttgggtttcggcgttataggtattgcggtttcggcgttcgtacgcgggggattgggcgggggttggagagtttaggtcg

SEQ ID NO: 3918 - DNA, 203 bp, synthetic construct
  misc_feature 1..203: note = Description of Artificial Sequence: Synthetic polynucleotide
  source 1..203: mol_type = other DNA
gttgcgtttcgttgtttagttcgggcggtttatcgttttttttgtttgggtggacgtatttttgtttttcgtttttattggcggtagttttcgtggggcgcgcgtggggggcgttggggtttttagttttcgtttcgagttttttgtcgcggcgttgttagtttcgggggtttgggttttatttcgttttggttttgttcgta

SEQ ID NO: 3919 - DNA, 312 bp, synthetic construct
  misc_feature 1..312: note = Description of Artificial Sequence: Synthetic polynucleotide
  source 1..312: mol_type = other DNA
gtcgggggggcgttcggggcggcggcggtggcggcgggcgggggtaggtcgggttgcgaatatatttcgaagttgtcgtcgtagtagagggttatgtcggcggtcgtgggcggttgcggcgcggtcgcggcgaggggcgagcggggttggtttcgtcgttcgggcgagagtatttttttgggggttaattttgcggtttcgtttttattcgcgttgggcgttcggtgtttcgggtcggggtcgggcgggtgttagcggagcgtttgttagtcggttttttataatcgagttcggcgcggttttttttgggtc

SEQ ID NO: 3920 - DNA, 407 bp, synthetic construct
  misc_feature 1..407: note = Description of Artificial Sequence: Synthetic polynucleotide
  source 1..407: mol_type = other DNA
tttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgaga

SEQ ID NO: 3921 - DNA, 295 bp, synthetic construct
  misc_feature 1..295: note = Description of Artificial Sequence: Synthetic polynucleotide
  source 1..295: mol_type = other DNA
gcgttcgtttcgcgcgtttttgtatttttcgcgtcgtttttcggggtttcgcggcgttcgtaggtcgcgtcgttttgtcgtttttttttcgtggtttttacggttcgttcgttttttagtagttttggggtgttcggggcggttttgtaagcgggagagagcggcgaggcggcggcgtcgagtgcggggggatgcggagtcgtgttcggttttgtcgtatttttcggtcgttcgttcgcgttcggtttcgttcggttttgttcgggttgtacgtatttttttcgcggtttagaat

SEQ ID NO: 3922 - DNA, 435 bp, synthetic construct
  misc_feature 1..435: note = Description of Artificial Sequence: Synthetic polynucleotide
  source 1..435: mol_type = other DNA
tttggttcggtttggttagttttcgcggtttttgttcgggttgacgtttaggaatgtggtcgacgagaagttttaatagtacggcgtggttttttagtttcggtgagtattcgtcgtggggaagggttttggggatttattggaggtcgcggttcgtagtagttaggggtcgagttacggttacggacgttttggtgtttcggttcgtgtcgggtttttaggcggaggaggcgttcgttgggtttagattttcgattttagtttcggtttttcggcgtttgggttgcgcggagtttttgtttcgcgtttcggatttttacgcgtagtttttacgcgtttcgagttggagaagtcgttagttcgtttttttagggcgtgtcgttcgttttttgtttttttgtgcggggtatgtgaaatgtgtggggttagaattgt

SEQ ID NO: 3923 - DNA, 410 bp, synthetic construct
  misc_feature 1..410: note = Description of Artificial Sequence: Synthetic polynucleotide
  source 1..410: mol_type = other DNA
tttttggagggaagttcgtcgggaagttgaagatagtggttatcgttttcggttattatttttcgggattcggattttaattttgcgttatatttttattcgtttttagtcgtgttttggttgcgtagttggaaaggttgagtagtttattgttgtttttttgttcggttttggatatatcgtttgaatttttgggcgtttttgttgttaagtgggggatagtattatttattggggaggaaaattttaggaatgtggattttggggttacgtaggggttgggaagtgaagggtagggaacgcgggcggcgttcggggtttgcgggtaggtaggcggtttggtcgcggaggttttttcgagttttgcgtttttttagagagggaggggtttatatcggttggtatagtta

SEQ ID NO: 3924 - DNA, 392 bp, synthetic construct
  misc_feature 1..392: note = Description of Artificial Sequence: Synthetic polynucleotide
  source 1..392: mol_type = other DNA
ggagttcgttgggcgtgttcggttcggttcggtttcgtcgtacgttcgtttttttggtttggttgaggatttcggggtttggacgtgttaacgttattttcgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagttagaggaggtttcgtttcgatttggggtttttcgcggtttttagttcgggggttcgggttttcgaagagatttttggtaatggtagaggttttaaagtttagatgttaagtttcgcgatggggcggatgttttta

SEQ ID NO: 3925 - DNA, 203 bp, synthetic construct
  misc_feature 1..203: note = Description of Artificial Sequence: Synthetic polynucleotide
  source 1..203: mol_type = other DNA
agagaagacgttaggttgaggttttagcgattttaggtattagtttcgaaggagggcggggagatcgtaaaggggaagtgttcggagggttaacggttttcgcgtattttgcgtttttttgaagcgcgtcgttttttcgcgtcggggattgggatttgtttttggggaattcgtttagaagacggcggcggattggggtcggg

SEQ ID NO: 3926 - DNA, 398 bp, synthetic construct
  misc_feature 1..398: note = Description of Artificial Sequence: Synthetic polynucleotide
  source 1..398: mol_type = other DNA
aaaattgcgggagtttatttattgcgtttaggtggttagtttttgagttttttttattcgtggttttttgtcggtatgtaggtatgtataagtatatcgtcgagtaggaggatttaacgaatttagtttgtggatatgttttaatttttattttcgttttttttaggtttgtttaggtgaggatgatgggagggaaaagcggtgtatagtcgtaatattggtattttgtaagagtcgtcggggtattgatatagagggatatcgtattggagatgcggtgtttacggagatttattgcgcgcggtgaaatattttaagtatcgcgcggaataattgggtttagtttttttatttcggattttttttaggattatacgttattttttattttcgaattt

SEQ ID NO: 3927 - DNA, 286 bp, synthetic construct
  misc_feature 1..286: note = Description of Artificial Sequence: Synthetic polynucleotide
  source 1..286: mol_type = other DNA
tgtagagtttgaattttatcgtttagaaggaaaggtgagtgggggattcgggcgggaggtgaggtttgtcggtagcggtttttaggcgtgttgggtagtacggttagtagaggcggcgtttggttttggatgttgtagcggagacgttaaggagattgaatgtagggagcgaggcgtagcggtcgcggagggtggggtcgttcggaaatttaggcggcgttagttttgtagtatttgtaggtcgggggcgcgtatacgaggggtacgtgggtgtggaggaatcggc

SEQ ID NO: 3928 - DNA, 267 bp, synthetic construct
  misc_feature 1..267: note = Description of Artificial Sequence: Synthetic polynucleotide
  source 1..267: mol_type = other DNA
ggttgttaaggaggcggggtggttagcgcggggggtggaggatgggggtaggacgcgggagggaagggtagggggtggggggcgaggtttcggggattagcgcgcgagagtgtttagttgggaaatgtagtttcgaattaatatcgtatgttttataattagtttacgagtcgatgtggggaaagttatttttagatggggaagagtagttcggatttttttaaggacgttttttagttagattagggaggggagaaggagatgggg

SEQ ID NO: 3929 - DNA, 260 bp, synthetic construct
  misc_feature 1..260: note = Description of Artificial Sequence: Synthetic polynucleotide
  source 1..260: mol_type = other DNA
tagagtcgtttgtatttgttcgtattttttgggaggttgcgatgatcgtagttagggtggtcgagcgttcggtttattgtattcggcggttgttttgtagcgtttttggtatttagggaatggtttgtaaattttaatgtattatagattagtttttatcgtggagtaggaaaggcgtttattagttaggggtaatcggttttgtagatttgggcgggggcgtagggggaggggcggtggtgtaaatttatcgtgatttt

SEQ ID NO: 3930 - DNA, 239 bp, synthetic construct
  misc_feature 1..239: note = Description of Artificial Sequence: Synthetic polynucleotide
  source 1..239: mol_type = other DNA
gaaggtaagttttaaatttttgtttggaagacgggttgtcgcggttgtattattagtaggaggaggaggagaagaaattatttcgcgatattttattttgcgggtgttttgtcgttgtcgtttttgttgtcgtcgattcgagttcgcgggttcgaatatcgtagcggtggggacggtgggttcggcgggcgtcgggaggaggatattagcggagttttgtattttcgtgtttcgtttat

SEQ ID NO: 3931 - DNA, 846 bp, synthetic construct
  misc_feature 1..846: note = Description of Artificial Sequence: Synthetic polynucleotide
  source 1..846: mol_type = other DNA
gttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatt

SEQ ID NO: 3932 - DNA, 526 bp, synthetic construct
  misc_feature 1..526: note = Description of Artificial Sequence: Synthetic polynucleotide
  source 1..526: mol_type = other DNA
tgttgttttttttcggcgttttgtttttttataattggaagtcgcgaaggcggttattgcgttgagtcgttcgttttgttggttaagtttgggcgattcgcgcggaggagggtcgggttgattgtcgtcgttgagttgttttcggacgggagcgtttgtttacggtatttattttttttagcggtggaaatgtggagaagtaagtgggaggcggtgtcgggaattgattttttttaaaacggtcggcgtcgttgttttgaaatgggcggttaagtgtttgtgggattaagggcggttttagagatgttcggaaaatcgttgttacggttagagtgcggcgtagacgcggtagagttggaggtgttcgcggtgtaggttgttgtttacgtcgtttaggttaggtgttgagggtttagttcgcgtttcggtcgaattatttttagtttcgttgagttatttcgttcgttcggtttttatcgtatcggttagaggaaagttttcgcggtttttacgtttttttatagtt

SEQ ID NO: 3933 - DNA, 201 bp, synthetic construct
  misc_feature 1..201: note = Description of Artificial Sequence: Synthetic polynucleotide
  source 1..201: mol_type = other DNA
gtttcgttcggggatttagggaggagggagagaggagggagggagtgggtagtttgggcgtacgttatcggttttcgtacgttcggtatttttcgtggcgcggcgagttaatgggatttgtatattcgaggtgtaatagtattattgtattaattattatttttattttacgtttagattgtttatttatttgcgggaaat

SEQ ID NO: 3934 - DNA, 523 bp, synthetic construct
  misc_feature 1..523: note = Description of Artificial Sequence: Synthetic polynucleotide
  source 1..523: mol_type = other DNA
tgttttgtacgcgtgtgtacggttcgtacgaggcggtcgggttcgttagttttttgattatagcggtcgcgttagggttatcggggttcgcggttgtagtcgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcgttcgtcgtcgttttcgcgcggtattttgatgaagtattcgttgaggttgaggttgtggcggatgttattttgttagttttttttatttttttcgtagaa

SEQ ID NO: 3935 - DNA, 276 bp, synthetic construct
  misc_feature 1..276: note = Description of Artificial Sequence: Synthetic polynucleotide
  source 1..276: mol_type = other DNA
gttattttttttttttcgtgacgttacgggtcgtttcggggtgagcgtttgagtcgtttcgggttcgcgttagtgagcgcggttgttgtcggcgagttagcggcgtagcggcgggaattcgaggtcgagcgtcgcggcggtagcgttagaagcgtatttatcgggtacggcgaggcggtttacggtgcggtaggtatcgggaggcgagagtcggcgcggatagtaggcggcggttgtagttcgttggcggttgttgcgaggatgttgtttgggcgg

SEQ ID NO: 3936 - DNA, 357 bp, synthetic construct
  misc_feature 1..357: note = Description of Artificial Sequence: Synthetic polynucleotide
  source 1..357: mol_type = other DNA
aggagggaggtagggtaggtttgagggtgaaagcggtaaggatttaggtttaagttggatttgtttatttttttttgtcgtagtttttttggtttttgtgcgttttggattttcgaagttagttttttgcgtagcggattagagaggtttattcgcggacgttaatttaatttttgggcggggttcgggggttgagtagaaggcgaggtttggggagtacggataattttgagggttgtttgtgtcggggtgggagcgtagtgggtgagtttcgagttttggtttagggacggttagagtagggcgttggcgcgtcgtggggataagtaggtgtttgtttttgtttgggggaaggat

SEQ ID NO: 3937 - DNA, 278 bp, synthetic construct
  misc_feature 1..278: note = Description of Artificial Sequence: Synthetic polynucleotide
  source 1..278: mol_type = other DNA
tcgggcgttgggtagttttcgtcggtcgtcgtcggagtttttgtgtttacgtcgggggcgtcgttgtaggtttaggagaagattcgtgttttcgagtagtcgtttttaaaaattaaataaattaataagagaattaattaataggtagcgttgcgatcgttaggagcgcggagcgcgcgaggtttagcggttttttcgttaagtttttgttatcggcgcgcggtcgttcgcgttgcggtagcggcggcggcgcggttgattgcggcggtagcgcggta

SEQ ID NO: 3938 - DNA, 336 bp, synthetic construct
  misc_feature 1..336: note = Description of Artificial Sequence: Synthetic polynucleotide
  source 1..336: mol_type = other DNA
gtttcgtatgtggggtataatgaaataagagtagtttcggttagaggtttagtaaagcggaaagacggtttcgttcgtatattttttcggaaaattgaagcgttttttttgatttttaaggttagaaagatttattatttttttcgagagggcgtagttatagatttattagagagggcgggtagggtgtcggaagttagagaacggcgtttcgcgtttttttatcgttttagggcgtagaggtgtttttagtgttcggagaggttggtagtgtcggtttcgagggaagcgtggagcggacggtcgataggggatttttgtttaaattttattatt

SEQ ID NO: 3939 - DNA, 311 bp, synthetic construct
  misc_feature 1..311: note = Description of Artificial Sequence: Synthetic polynucleotide
  source 1..311: mol_type = other DNA
cgcgtgttttgttttcgtagtggtttcggcgtttaggacgtcgttggttcgcgttttttttcggaatgaaggtgtttcgtaggaaggcgttggtgttgtgcgcgggttatgtattgttgttggtgtttattatgtttaattttttggattataagtggtataaggagtcgttgtagtagtgtaatttcgatgggtcgttgggtgtcgtagcgggggtagtcggaggtagttgggggcgtttagggtcgttttcggtcgggtcgtttcgtgtttatgttcgtttggattttcgtattttttatcgttttttc

SEQ ID NO: 3940 - DNA, 201 bp, synthetic construct
  misc_feature 1..201: note = Description of Artificial Sequence: Synthetic polynucleotide
  source 1..201: mol_type = other DNA
tataggtaatagagataaggttaggaggtaaagtatatttatgtgtaaatgagacgcgttagggaatttgtaattttttgtattttcgtttttgatgtttcgatttttataattatagaattttaggtagaggtcgtcgattttttcgttttcgttaagagggattcggagtatcgaagttttttagtcggtgtcggcgtt

SEQ ID NO: 3941 - DNA, 201 bp, synthetic construct
  misc_feature 1..201: note = Description of Artificial Sequence: Synthetic polynucleotide
  source 1..201: mol_type = other DNA
aaacgtttttttagaaaataagttattaatcgtacgagagaaggagaggaaggtagtaatttaattttttgcggttcgcggttttgaagattaggaggttcgttttagtagggtgaggtttatagaatgtatcgcgtcggttgcggttttttaggggtcggttattcgagttttggaatttcgagaggcgcgaagtgggag

SEQ ID NO: 3942 - DNA, 481 bp, synthetic construct
  misc_feature 1..481: note = Description of Artificial Sequence: Synthetic polynucleotide
  source 1..481: mol_type = other DNA
cgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcgtcgttcgttgggtttttaggggtttgaacgtttaggggtcgcggcgagtttattcggagcgagttaggtgagtaggtcgttatggcgatgcggtttcgg

SEQ ID NO: 3943 - DNA, 280 bp, synthetic construct
  misc_feature 1..280: note = Description of Artificial Sequence: Synthetic polynucleotide
  source 1..280: mol_type = other DNA
taggttttttggggttatttcgcgaggtagtcgagggcgtaattcgggcgtttggggtcggaggcggaattaggggtcggggttaggaggtaggtgtaggcggttgttaattcgtttaatttgttgcgcgggtggtcgtttagagtcgcgggtttgcggggcgtttttcgtcgtcgcgtcgtcgtttttttaggttcgggagggggcgtttagggtggagttttatttatgggttgaggttttgggcgcgcggagtcgtcgtcgttttttcggttggttt

SEQ ID NO: 3944 - DNA, 252 bp, synthetic construct
  misc_feature 1..252: note = Description of Artificial Sequence: Synthetic polynucleotide
  source 1..252: mol_type = other DNA
cggagttttagttacgaattatttaatattcgtaggttatagagcgacggaggttgaggttgtgatcgaattatcgacgtttttttgaggggtgaaagtacggtcgtggagattttaatcgagtttacgttggcgtaaaaggtaaaagtcgcgttagatttcggatgtcgttttttttttttcggttgcgcgtttgattgggtagtttttaatttagcgttttgattggataagatattaagttttttacgt

SEQ ID NO: 3945 - DNA, 239 bp, synthetic construct
  misc_feature 1..239: note = Description of Artificial Sequence: Synthetic polynucleotide
  source 1..239: mol_type = other DNA
ttatttgcgtgttgttttcgggtttcgtttcgtttcgtttcggagggatttttaggtcgggtttagatttaggagttatttggggatttcggggtggttgcgcgtcgagggggcgttagcggggacgtgagttggcgtcgagatagtttcggttttttagcgttagggttattgttaggagattttcggttagtatttacgtggggcgttttcgggagttcgaggggtttatcgtttgt

SEQ ID NO: 3946 - DNA, 405 bp, synthetic construct
  misc_feature 1..405: note = Description of Artificial Sequence: Synthetic polynucleotide
  source 1..405: mol_type = other DNA
aagtttgcggagcgggtcgcgtttttggttcgttcgggttttaagtttcgcgtcgtcgttttggcggggacggtgtagtaggcggcgggatgcggcggggcggtagtttgagcgtttcggatggttcgcggcggggcggtttgtaagagcgacgcgcggttgttgttggggcgggacgcgttgcggtcggcgttcgttttgttggttttcgtcgtgttgttgggcgtcgcgttcggtttcggtttcggtttttggtttggttgtcgcgcgggtcgttagcgtacgcgatattaggtgggtcggtcgagtagatagcggcggggcggggagcgcggggcgcgtggtttttgggttttgcgggttcggagtttcggttttgcgattttttgagtttggttgggaatt

SEQ ID NO: 3947 - DNA, 237 bp, synthetic construct
  misc_feature 1..237: note = Description of Artificial Sequence: Synthetic polynucleotide
  source 1..237: mol_type = other DNA
cgcgtacggtggtgtaggagtttcggtagtttagcgtgaggaagttcgagcgtttgttttgcgcgtcgtcgtcgtcgttattatcgtgcgttttcgggttcgagggtacggcggtcgtcgtttcgcgtagtagtagcgcgtcgttgttattttgcgagacgttgttttttaggtcgttttggtagttttcgtcgttgagagagttttgtttggtgattttgggcgatagtagtttga

SEQ ID NO: 3948 - DNA, 204 bp, synthetic construct
  misc_feature 1..204: note = Description of Artificial Sequence: Synthetic polynucleotide
  source 1..204: mol_type = other DNA
cgatcggggcggtttcgtttagggttcggggtagcggcggcgtcggcggcgttcgagttttatcggaggagagacgcgcgagagaggagtttcgtcggtgcggcggcggtaatggagaggtaagaaggagttgttgtttttttggggcgagggcggggaagtgtgagagagatttgcgagaggttttagggttgttgttcggtt

SEQ ID NO: 3949 - DNA, 224 bp, synthetic construct
  misc_feature 1..224: note = Description of Artificial Sequence: Synthetic polynucleotide
  source 1..224: mol_type = other DNA
aggattttttattggggttgagtttttttcgtttttaatagaatttttaaatataagtagtttttttttgtttttaggagtttacgaaacgttgttatatcgagcgaatgtaacgcgtatatacgtttatattcgaatagtataagtaagagatcggttgggtgtggaatagaggcgtatatcgcgtaacgtatttatagtatgtatacgcgcgtatttcgatt

SEQ ID NO: 3950 - DNA, 278 bp, synthetic construct
  misc_feature 1..278: note = Description of Artificial Sequence: Synthetic polynucleotide
  source 1..278: mol_type = other DNA
gttttttattcggcgttttttaggatttttaaagacgttcgtttagatttataggtatttatttgagtttttttgtttttttataatttcgattttttttcgtttttttttttttttaaaaaaaaaatttaaataatttttaaataatatttaataggaaagaagaaggaaaaggagcgtataggaagggcggaggcggtattcgggggggattgtttttagaggaggtcgttgtgagtcggcgacgcgaggttgggggagtgggaggtaaattcgtt

SEQ ID NO: 3951 - DNA, 232 bp, synthetic construct
  misc_feature 1..232: note = Description of Artificial Sequence: Synthetic polynucleotide
  source 1..232: mol_type = other DNA
ggtggggtaaaaagtaagacgaaatttatttagatagttttttcgatttttagaggatcgatatttttttcgagggttttaatagtggtcgtttagggttcgagggtaacggtcgaggcgttacgcggggtcgcggttcgttttggttacggaggatcggatttgttgcgtttttgtgagtttgttttatttttatttattcggtgtttttcggtacgtcgatttgtttttt

SEQ ID NO: 3952 - DNA, 331 bp, synthetic construct
  misc_feature 1..331: note = Description of Artificial Sequence: Synthetic polynucleotide
  source 1..331: mol_type = other DNA
aacgcgtttcggattttatttttgtacgtgtagttgtttttggggatgagggttatttagtttttgtcgcgggtcggggcggcgaatttggtgttggggtcgtaggttaggcggtcgtgggtcgagttggttatgattattttttcgcgggcgttttgtttgggcgagtgtttttcgtagcgttcgtatttcgtttttttcgtgtgtagtttcgcgtcgtcgtcgttcgtcgtttcggtttcggggttcggcgcgggttcggcgtaggtgatgtttacgaaggcggtgtattatttttttttttcggttacggtaaagtttaggtagagta

SEQ ID NO: 3953 - DNA, 231 bp, synthetic construct
  misc_feature 1..231: note = Description of Artificial Sequence: Synthetic polynucleotide
  source 1..231: mol_type = other DNA
gcggttatggtggtttcgggaacgggttcggggagggagggcgcgggaggacggcgagtcgggggtatcggaggggaaggcggcggcgtagatcgtggttcgttttcggggtagaggagggggtgttaggcgggattggggagaggggaaggggggtttagttttgatcgggatttatcgtttttttcgcggggcgcggggttaggcgcgtagatgcgtttagggcgtagt

SEQ ID NO: 3954 - DNA, 201 bp, synthetic construct
  misc_feature 1..201: note = Description of Artificial Sequence: Synthetic polynucleotide
  source 1..201: mol_type = other DNA
ttcgtagtggttttttttgtagtttttttgggtttcgcggttagtagtgtagttcgtggagtcgcggttttgttcgttttttttgggtggttttagtgcgcgggttgatatttatttagtcggggaaggtgaggcgagtagaggttggtgcggaatttgtcgtttttagtagcgtcggcgggttaagtttagggtcgggta

SEQ ID NO: 3955 - DNA, 201 bp, synthetic construct
  misc_feature 1..201: note = Description of Artificial Sequence: Synthetic polynucleotide
  source 1..201: mol_type = other DNA
agtttaggagttcggggcgttcgcggcgggtatgaggcggcgtcggcggttgtagtaagaggacggtatttttttcgagtattatcgttatttcgagttgcgcgaggcgttcgtgttcgtgtggttgtagtgtatcgttattagtaggatttatacggtggggcgtagtttcgagggtcgggagtttttggttatcgagtt

SEQ ID NO: 3956 - DNA, 219 bp, synthetic construct
  misc_feature 1..219: note = Description of Artificial Sequence: Synthetic polynucleotide
  source 1..219: mol_type = other DNA
cggttggcggtgtttcggcgttttatcgggcgcggtttttttaggttcgggggttcggcgttcggcggtattttttcgtaatgggagtggtttaggtcggcggcgtcgttggtatattcggggttgtaggatagggttatgttgtagtcggggggcgatatttcggggtggtcgatgagttagttatggaagtaggggttttttttatggttgtagcgg

SEQ ID NO: 3957 - DNA, 284 bp, synthetic construct
  misc_feature 1..284: note = Description of Artificial Sequence: Synthetic polynucleotide
  source 1..284: mol_type = other DNA
gcgggaggagggcggcggggcggttggcggcggcggggttcgggagcgtcgcggcgtaggattttttagagcgcgtcgggttgagcggcggcggcggcggcggcgggcgtaggggtagggtatgattgacgcgttttttgtttgcgtttatgtgagagaaagcggtcgagggagggagcgtgtcgagttcgggttgttttttttttttattttttttcggaagtcgtttttttggagtttttcgtttttttcgtttttttttcggcggttttatttttttcggt

SEQ ID NO: 3958 - DNA, 429 bp, synthetic construct
  misc_feature 1..429: note = Description of Artificial Sequence: Synthetic polynucleotide
  source 1..429: mol_type = other DNA
ttttttttcgggtcgcgatattgattcgttaacgttaatgggggttcgcgattgttgcggggacgagggcgtagagtagttttcgttacgggtcggtttacgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcggggtcgtggggcgtgtgggtgaaggcgatatttcggatgcgggacgtatgaatggtggtagagtaggggtcgggattcgtttatgggttgggagagagatgtttt

SEQ ID NO: 3959 - DNA, 283 bp, synthetic construct
  misc_feature 1..283: note = Description of Artificial Sequence: Synthetic polynucleotide
  source 1..283: mol_type = other DNA
ttcgttattattgtttaatcgagaattagtaacgtttttcgtcggtttttattttacgtcggaatggatttttagaatttattgcggtcgtaagatagttcgtaagagttggttaaaatgtttttaggtgcgtgggggtttcggggttttagttggagttcgatattttgagattggcggttcgagggttgtagggtcgtttcgggcgtgcgtttatcggttttgtatttttgggtagtcgagtgtcgcggagaacgttttattttttttatcgcggtttttt

SEQ ID NO: 3960 - DNA, 241 bp, synthetic construct
  misc_feature 1..241: note = Description of Artificial Sequence: Synthetic polynucleotide
  source 1..241: mol_type = other DNA
tcgtttatatcgttttttttttgtaggtgaggaatggggtttgtttcgtttggaatgtgtttttgtcgggttttgtttgatttttattttttagtcgggacgcgcgagttttttcgtttggttgagttaaaaagggatcgcgcgtatttcgtcgttttttattacgaagcgtagatataggaggttgtagggttagtgttgcggagaattttagacggttttatagtcgtcgttattcgcg

SEQ ID NO: 3961 - DNA, 244 bp, synthetic construct
  misc_feature 1..244: note = Description of Artificial Sequence: Synthetic polynucleotide
  source 1..244: mol_type = other DNA
tcgtcgtttttatttcggggcgcgtaggtcgaggaggatttcgttgattacgaagagtttgaggatttttcgagtttgttagatattcgtagtatcgtttcggacgattttttttattttttcgaggacgaggaggagtacggcgtcgagagcgcggagagcgtttcggagggcgtttcggaaagcgtttcggagacggcgatttttttgcgcgtcgtttgcgttaataacgtggggttgttgc

SEQ ID NO: 3962 - DNA, 225 bp, synthetic construct
  misc_feature 1..225: note = Description of Artificial Sequence: Synthetic polynucleotide
  source 1..225: mol_type = other DNA
ttagttcgggaagaggcgtgcgcggcgtcgttcggttttagggtaaggttttgattttgtttaattgtagtatttttcgtttttgttgtttgagcgcggtcgcgggataagggatgttggcgggcggtaggggcgagcgtcgcgggcgagaggcggttttcgacgcgagtgcgtagcgttcggttcggcggttttttcgagttcggcgagcgtagcgttttttgt

SEQ ID NO: 3963 - DNA, 249 bp, synthetic construct
  misc_feature 1..249: note = Description of Artificial Sequence: Synthetic polynucleotide
  source 1..249: mol_type = other DNA
gagtttggggtcgtcgcggcgttcggcgtcgagcgttttcgagttgcgtttcgcgcgcggttcgcgttatttgtgtcgtcgtcgttttagtcgtcgagggcgaggtttttttcgcggcgcgcggtagttttagtttttatttaaatttcggcggtcggttcgggcgttcggttagtgagggagcgttcgtttcgtcgtcgaaatcggtttcgggtgcggagtatgtttagtgtcgtcgcgagagcggcg

SEQ ID NO: 3964 - DNA, 255 bp, synthetic construct
  misc_feature 1..255: note = Description of Artificial Sequence: Synthetic polynucleotide
  source 1..255: mol_type = other DNA
gtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcggg

SEQ ID NO: 3965 - DNA, 243 bp, synthetic construct
  misc_feature 1..243: note = Description of Artificial Sequence: Synthetic polynucleotide
  source 1..243: mol_type = other DNA
ttagtagcgtcgtcgttttttagcgtcgatgttttagtcggcggggcggttgaggggtgagggggaatttcgcgggcgggggcgagggagcgtgtgtgcgcgagcgtgtgcgcgcgcgaggggagcgcgtgcgcggtgaggacgcgcgtcggcggttggggcgggggcgggggtcggggcgtttttgtgggaagggaggggtgaaaggtcgttggttttcggtaatacggtttaggtaaacgt

SEQ ID NO: 3966 - DNA, 201 bp, synthetic construct
  misc_feature 1..201: note = Description of Artificial Sequence: Synthetic polynucleotide
  source 1..201: mol_type = other DNA
tggagagaaatgagttggagagttatatcgagttaacgcgggatacggttttcggttcgggtcgggttaggggtgggaggcggttttttatcgtaggcggcgggatttttatgcgtcgagggatttaagtttttattttatttatacgtttattcggcgtcggggcgttgcggtttcgttttacgagtttagagtaggtcg

SEQ ID NO: 3967 - DNA, 208 bp, synthetic construct
  misc_feature 1..208: note = Description of Artificial Sequence: Synthetic polynucleotide
  source 1..208: mol_type = other DNA
gtcggatatttttttttaggattattcgtattttatagtcgcgttaaaagcgttttatttttttgtttttcgtcgcgtaggttttttatcgacgttcgttcggaaggcgagagtttttacgtggttcggcgcggcgcggttttcggggatcgcgagtaataaaagttcggttcgtagtttttgtttttcgtttttttttttaattttt

SEQ ID NO: 3968 - DNA, 257 bp, synthetic construct
  misc_feature 1..257: note = Description of Artificial Sequence: Synthetic polynucleotide
  source 1..257: mol_type = other DNA
tttagtttttcgtaagtatttttttcgtttttttattttttttagtttttagtcgtcgtcgttttcgtagtttcggtttcgcgttttttcgtagtttcggcgttcgtttattcgttaggtaggcggtggtgtcgatttatttgagtagttgtttcgcgtttagttcgtcgcgcgtagtggcgtgcgtcggttggatggtttggtttatgattatttcgtcgggcgtcggtcgttttatggttagggcgagagcgtta

SEQ ID NO: 3969 - DNA, 350 bp, synthetic construct
  misc_feature 1..350: note = Description of Artificial Sequence: Synthetic polynucleotide
  source 1..350: mol_type = other DNA
gaacggtttagtttaggttttgcgttagagtatcgtattcgggggcggacggttttgtagttttttagttttttttcgtattaattagttgacgttcgggcgtattggtttttttcgttttcgttcgtacgaaagttttgttcgacgtttgtagttagtatcgttcgtattgtttagggagggtttgcgtcgagatttagtggtcgagtgagttatagagtcgttggttttggggacgttgttttttatcgttttttatcgttttttttttttttgtattttatttcggtatttcgtattttttttttcgttcggtttcgcgtattttgtttagattttataagtatttt

SEQ ID NO: 3970 - DNA, 216 bp, synthetic construct
  misc_feature 1..216: note = Description of Artificial Sequence: Synthetic polynucleotide
  source 1..216: mol_type = other DNA
attaaattaggggttgggagtttttagattgaaatgcgttttttattattaagagggagtttacgcggtcgcggggggtcgaggtagttagtcggcgtcgcggttttggggagttcgtgtaggggtgtgttttggtgtgaaatttggtaggattttgtttgggtttgtatgtagggaggggttagagattttgaaatgtattagcgggtagggtgg

SEQ ID NO: 3971 - DNA, 269 bp, synthetic construct
  misc_feature 1..269: note = Description of Artificial Sequence: Synthetic polynucleotide
  source 1..269: mol_type = other DNA
ggtattgttgttcgaacgaacgaacgaacgaacgaacgaagcggtttcgtttaggaaaaatatttttttgacgcgaagttacggttgaagtttcgggttacgtagaggggttagtaattttatgggtggtggggttttttatttttggacgtagcggggagtagcgggcggtttttttttttgtttattttttttgggggtgggggagttttgtgttattcgacgttgcgaggggttgttacgggttttttaggttgtgtttttcgcgg

SEQ ID NO: 3972 - DNA, 258 bp, synthetic construct
  misc_feature 1..258: note = Description of Artificial Sequence: Synthetic polynucleotide
  source 1..258: mol_type = other DNA
agatcgggtttttgttcgttttttttttgcgtttcgggatgaggtagagattgaatagtcggcgagtaaattaacggtatttagaaagttatgtcggattcggcgtttagcgtttaagcgttaattcgttgaaagttttttagcgaaattttagggacgatttggatttcgttgagaggaattgtttttgagtgagatggttttagaggtttggaggagcggattggtaagtatcgggagggtagtgggagttttgtt

SEQ ID NO: 3973 - DNA, 224 bp, synthetic construct
  misc_feature 1..224: note = Description of Artificial Sequence: Synthetic polynucleotide
  source 1..224: mol_type = other DNA
tgtgttttttttttttttttttttttttttttttttcgtcgtttttttttttttttttattttttttttttgttcgttttttttttttttttcgcggtcgcggttcggatagaggttatttagcgttttttcgtagtttttcggagagtatgtgattaggtcgttagtagcgtcgcgagtgttcggtaatggtagggatggtgttttaaatatttttggaagtt

SEQ ID NO: 3974 - DNA, 256 bp, synthetic construct
  misc_feature 1..256: note = Description of Artificial Sequence: Synthetic polynucleotide
  source 1..256: mol_type = other DNA
cgttatttcgcgttagtgtttgagttgtaattgtaaattgcgcgttttggtacgagtagcggtgggggcgggtgggggaaggagcgagtgattttttaggcgtttttcgttatttgatattagttaggtagtttttagggttagagcgttagcgtcgaagttaggtttattcgggaagttatttcggtggtcgcggggtgtttatgttagtattagattttttttcggaaggaggagcggggcgggttatacggtt

SEQ ID NO: 3975 - DNA, 310 bp, synthetic construct
  misc_feature 1..310: note = Description of Artificial Sequence: Synthetic polynucleotide
  source 1..310: mol_type = other DNA
gggaaggggcgttaatagggttattatttcggggtttcgttattttttagtcgttttttttttcggagattttgtttgttaagagttttgttttttgtttcgtttagggttggggttcggtgggaattttttcgtgttcgaagggacgatttcgttagagagtttttcgatttttgtatttatcgtttttggtaggacgtggagttgttcggaagttatttcgggttggtttttttattcgtgtgttacgatttttcggcgggtttttgtcgttcgagtgtttttatcgttagttttcggagcggcggag

SEQ ID NO: 3976 - DNA, 410 bp, synthetic construct
  misc_feature 1..410: note = Description of Artificial Sequence: Synthetic polynucleotide
  source 1..410: mol_type = other DNA
aggataattgggacgggttggatttatatttgatattcgggaaatttttagagcgtgtggtgtttttgttagcggtagttattggtggagttgaggttatcgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcgcgcgtacgaatcgggtagtgtgcgcgtgtgtgtgttcgcgtgtgtgagcgcgtgtgttagcgtgcgttttcgcgcgggcgtgcgtttgggtggattttt

SEQ ID NO: 3977 - DNA, 274 bp, synthetic construct
  misc_feature 1..274: note = Description of Artificial Sequence: Synthetic polynucleotide
  source 1..274: mol_type = other DNA
ttggggttagttttttttttttatcgtcgtcgtttttttatttatttcgcgtttattttataattatttcgtttggttttttttcggttttatttttatgcgtttttattatttttttaaatattgtagtaagttgtagtaaggcgggtaaatatcgatagcgcgcgtgggggcgggcggcgggcgtcgcggggtttatttttttttcggttttttcgcgttttcgtcgtttttcgcgttggtttttatcgtatgagtagcgttttttcggttt

SEQ ID NO: 3978 - DNA, 201 bp, synthetic construct
  misc_feature 1..201: note = Description of Artificial Sequence: Synthetic polynucleotide
  source 1..201: mol_type = other DNA
tttttggttggcgggcgtttcgtcggtcgtcggttttttttttgaaattcgtcggcgtatatgaggtcgttgttttcgtcgtaggcgttggcggttttttcgcggtgttcgtggtgatgttatgtttcgttattacgcgggaggagaggagggcggcgtcgtcgggttttgggtgaagagcggcgtagcggcggcggcggc

SEQ ID NO: 3979 - DNA, 265 bp, synthetic construct
  misc_feature 1..265: note = Description of Artificial Sequence: Synthetic polynucleotide
  source 1..265: mol_type = other DNA
ttttcgtggtaggcggtagcgagttgggttcggggtcgggttgagttttgggatcgcgttgcgtagttttcgagtcgttcgttatttggttgcggtcgcgcggttatttgtttttcgttttcggggcgtcgtttagtttcgcgttaggcgttttttttagcgttcgtcgttttttttcggcgagattattcgggcgcgtttcgttcgtcggttttcgatgtaaatagttgggtttcgtaggcggttggtttcgcgtttttcggtt

SEQ ID NO: 3980 - DNA, 201 bp, synthetic construct
  misc_feature 1..201: note = Description of Artificial Sequence: Synthetic polynucleotide
  source 1..201: mol_type = other DNA
attattattattttaagtgtttgttcgttggggattcgtcgtcgtcgtcgtcgtttggtttgttttgttttggggttttgcgcggtttttttttgtttttcgttttttcggaagaggcgttcgtttttaagtacgtggagcgcgtttcgttcgtagtcgtcgcgttgttaggagcgcgttatgcgtagttgttttttgcgt

SEQ ID NO: 3981 - DNA, 362 bp, synthetic construct
  misc_feature 1..362: note = Description of Artificial Sequence: Synthetic polynucleotide
  source 1..362: mol_type = other DNA
tttggcggggagtttgggtagcgtcgattaaagttcggagcggtagtttcggggcgcgggacgcggggtatacgggtttagttgttcgacgggagttcgacgcgcgtttttcggcgggtcggcgggttcggaagtttcgttgttcgggtcgggtttttaagttcgtagtcgttttgattaaaataggtatcgcgacggcggcggtaggcggcggtagttagggttggggtcgtatcgcgtacgcgtatgcgttcgtcgtttcgcgtttttcggcgggcggagttcggcgtcgcggttaggattttttatttcgttttcgcgatttcgttgcgggtttgtatattcgaggattcggtttgaaa

SEQ ID NO: 3982 - DNA, 298 bp, synthetic construct
  misc_feature 1..298: note = Description of Artificial Sequence: Synthetic polynucleotide
  source 1..298: mol_type = other DNA
gttttcgttttttatcgttttttttcgtttcgtagttttcgagtggcgttagtacgttcgtcgggtatgggttttaaatgtttattagcgggagtttaggcgtttttgttttggagcgcggtcgggagtaaaatcgtaggagtgggagggtagcgagttagttggatttcgagtcgcggagcgcgttggttttgtttcgtttgatgattttagagcgcgggtttaagcgtcgtttatgtagtatttttgagtttcggggaaggagagttaatgaaaaaatatttaatcgttttcgttg

SEQ ID NO: 3983 - DNA, 295 bp, synthetic construct
  misc_feature 1..295: note = Description of Artificial Sequence: Synthetic polynucleotide
  source 1..295: mol_type = other DNA
gagcggcgcggagagcggtaggggcgaaatttcgcgggttagatgttcgagggcgcggcggcgttgttaggttgtcgttgttgtttttgcgggtttcgagcgcgttttcgtaggcggtattgttcgcggcgcggcgtgtgtatcgagcgagtgaaggtatgtgtggcgggcgcggttggagttgtcgtcgtcgtcgtcgtcgtgttagtaggttttaatgtttgttattttttaggacgttggtagtagtagtagttcggagttttcgagttttcggtaggtttgcgtgtttttt

SEQ ID NO: 3984 - DNA, 203 bp, synthetic construct
  misc_feature 1..203: note = Description of Artificial Sequence: Synthetic polynucleotide
  source 1..203: mol_type = other DNA
cgaaggtatttgggatttttagacgtaggatgtttttgatcgttgagtaaatgataagggaggcgcggtcgcggtattcgtttatttagcgtaatcgtttcgcgcggggagatttcggttgggtttttaggttggatttcggtagtcgaacgttcgttattcggttaggaagttagggagcgagcgtttgcgcggtcgtattt

SEQ ID NO: 3985 - DNA, 215 bp, synthetic construct
  misc_feature 1..215: note = Description of Artificial Sequence: Synthetic polynucleotide
  source 1..215: mol_type = other DNA
cgcggatcggtcggtttgggtttttgtagagtagattttgtttgcgttttttaggaggagtgggtggtaggattggggttttttataggttttggggcggcggcgagattggtacggttcggggtcgtaggcgcgtagttacgtttttggaagttcgtttcggttttcgtttttaattcgttttttcggggttttatggcgtgaggtttggggtt

SEQ ID NO: 3986 - DNA, 201 bp, synthetic construct
  misc_feature 1..201: note = Description of Artificial Sequence: Synthetic polynucleotide
  source 1..201: mol_type = other DNA
ggaggttgtagtcgttcgagtcggttcgggtgggggcggggtgggggcggcgcggagggtacggagattacggcggcgttattcgggatatttagggtttcgaggttttgggcggtttttacgcgagatcgtaaattatgataataggtagttattcgaggttaaataaaaacggagtgggtttttcgcgcgtcgtcgttt

SEQ ID NO: 3987 - DNA, 340 bp, synthetic construct
  misc_feature 1..340: note = Description of Artificial Sequence: Synthetic polynucleotide
  source 1..340: mol_type = other DNA
ggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggg

SEQ ID NO: 3988 - DNA, 201 bp, synthetic construct
  misc_feature 1..201: note = Description of Artificial Sequence: Synthetic polynucleotide
  source 1..201: mol_type = other DNA
agggtttagggcgtagggcgggtttcgtacgtagggcgggcgcgcgggtatttttgtggttaggcgatttcggttcgttttttcggagtttagggattttcgaggttggcgcgggttgttcgcgataaggtgttagtagtttcgggttcgcgaggagtagtttttattcgcggttttcgagtttagttttgttttttcgtt

SEQ ID NO: 3989 - DNA, 236 bp, synthetic construct
  misc_feature 1..236: note = Description of Artificial Sequence: Synthetic polynucleotide
  source 1..236: mol_type = other DNA
tttgagtagtgtatttttttaaaggtaaagagagataagggaggaaatatagtatttaaggtgattagtcgattggatattgttgatggtatatttttttcgtttttaattaatcgtataaaattcgtaatatttcgcgttttcgcggggtttttcgcgtttttggttcggttttttcggtcgtttttagtaggcgtttcgtttttcgcgggaattttgggatttggtcgagcgtt

SEQ ID NO: 3990 - DNA, 251 bp, synthetic construct
  misc_feature 1..251: note = Description of Artificial Sequence: Synthetic polynucleotide
  source 1..251: mol_type = other DNA
gttttttagtttttcgcgtatttttttgcgttcgggtttcgtcgtttcgtttagtgttggttacgggtcgtgttattagtttgtgcgttttcgttattcgcgggtcggggtatttggcgttttgtgtgggtggcgggagcggggacgtttcggtgttcggggatcgtagcgcgttggcgtttaattttgtcgtcgttcgttttggagtcgggaggttttagtcgtttaagtgtttcgggagatttaggtat

SEQ ID NO: 3991 - DNA, 201 bp, synthetic construct
  misc_feature 1..201: note = Description of Artificial Sequence: Synthetic polynucleotide
  source 1..201: mol_type = other DNA
tttcgttttcgttttattttttattggcgtaggtttaggttatcgttgttaggatttttcgttgtcgtcgtttttcgttttttttatttagattttgagtcgtttattttagtcggtgtaggtcgcggggtcgtttttgatggtttgggtattttttattttcgtttcgtttacgattatcgcggttgtttgagttgttta

SEQ ID NO: 3992 - DNA, 206 bp, synthetic construct
  misc_feature 1..206: note = Description of Artificial Sequence: Synthetic polynucleotide
  source 1..206: mol_type = other DNA
gttttcgagtgcgtagcgtgcgtttttagtttttgttgcgtttttaggtttggcgcgcgattcgagcgtagcgggtaaagttggaggaatttggcggcggcggagcgggcgtaggtttagttcgataaagttcgggggttcgggtcggggtcgttgtcgtagttcgtacgttgtttcgtgttttcgagaggttttttttttagcgt

SEQ ID NO: 3993 - DNA, 201 bp, synthetic construct
  misc_feature 1..201: note = Description of Artificial Sequence: Synthetic polynucleotide
  source 1..201: mol_type = other DNA
ggtcgtcgtttatttcgcgtatttcgttttttggaaatttagtagtcggggggcgaatatcgcggcgtttttatgggaatttggtttcgggtttagagcgcgggtagttggtagagtttggggggcgcggcggcggtagtagtaggttggagggcgcgcggcgggggttaaggggatttggtcggcgttcggagtcggagt

SEQ ID NO: 3994 - DNA, 203 bp, synthetic construct
  misc_feature 1..203: note = Description of Artificial Sequence: Synthetic polynucleotide
  source 1..203: mol_type = other DNA
gttgtaattttgggtttgggattgcggggacgggacgggtgggaagcggttaaaggcgtagcggtttttggttagagtcgtagaggtttgagacgtgggtcgcgtttcggtttaggagatttcgcggtcgcgttttaatttttagtttttcgattgcgattgcgattcgggaaaacgtttacgtttttggaaaggaagtttta

SEQ ID NO: 3995 - DNA, 216 bp, synthetic construct
  misc_feature 1..216: note = Description of Artificial Sequence: Synthetic polynucleotide
  source 1..216: mol_type = other DNA
ttggggggttgggagaacgaaaatattagttgcgtttttaatatttaaggaaggaagtggtagcggggacggggagaggatgggaaggggatgttgattgcgagttggggcgggacgcggtgatgggaggggatcgggtcgggaatgcgggaggcgaggggagcgacgggatttgtcgtttcggcggtcgggtagttaatcgattcgtttttttta

SEQ ID NO: 3996 - DNA, 335 bp, synthetic construct
  misc_feature 1..335: note = Description of Artificial Sequence: Synthetic polynucleotide
  source 1..335: mol_type = other DNA
agtgtcggagcgttcggtggtcgtcgcgtcgcgcgtttggagggatgttaacgtggagtcggcgtcgagttcgttcggcgtgcgtgcgtgtgtgggagcgcgcgagttttttgacgcggggattagttatgaatcgggggtgtgtgtttgtttttagagatttggtaaggtgcggagttttttagaagtgcggttaagcggtagcggagacggcgagttaggaattttttttcgcgtttttagttttttagcgtggcggcggaattttcggagaaagtttgtaaatttttagcgggcgcggcgaggacgtcgggttatttagggggcgggtgggc

SEQ ID NO: 3997 - DNA, 230 bp, synthetic construct
  misc_feature 1..230: note = Description of Artificial Sequence: Synthetic polynucleotide
  source 1..230: mol_type = other DNA
gagagaaagtgagaagggagagaaaagcggcggttgagtaaagcgggagtcggcgcgggcggtggggtttgattcggacgtcgcgtattcggtttcgtttcgcgtttagcgtttcgtttattttttggtcgcgtttgttttcgcgtttttttgtttttttttatttattagtagttttgttgataagcgagaaaattgataagtgagaaaagtcgtttgttagcgttcgg

SEQ ID NO: 3998 - DNA, 224 bp, synthetic construct
  misc_feature 1..224: note = Description of Artificial Sequence: Synthetic polynucleotide
  source 1..224: mol_type = other DNA
tagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgtt

SEQ ID NO: 3999 - DNA, 211 bp, synthetic construct
  misc_feature 1..211: note = Description of Artificial Sequence: Synthetic polynucleotide
  source 1..211: mol_type = other DNA
ggttaattttaggtatagtttattcgagttaggcgaggtttagaaaggtttgattcgtttggtagttttaacggatttgttttcgtagtcgttgattagtcgttgacgagcggatttttcggtcgttatggcgattgtgaaatgtagggtggagcgtatgcgttcgaagttattcgcgcgggtagtttttgcgtgtttttttgcgtgtttt

SEQ ID NO: 4000 - DNA, 205 bp, synthetic construct
  misc_feature 1..205: note = Description of Artificial Sequence: Synthetic polynucleotide
  source 1..205: mol_type = other DNA
cgtgtaattcgattttttttgatttataagttttgagtgatagttttgatttggtttaatcgcgggagggaggggaaagagaaagaaagaaatttttagtcgtacgttttttttggtatttaatcgattttttggaaaaaggttttatttcggtttggtgtttcgtgttgggtggagaagtttttcgtttcgatttggtatcgtt

SEQ ID NO: 4001 - DNA, 398 bp, synthetic construct
  misc_feature 1..398: note = Description of Artificial Sequence: Synthetic polynucleotide
  source 1..398: mol_type = other DNA
tttcgttcgtttcgcgtttcgcgtttcggcgtttcgtcgttcgtcgttcgttcgtttcggcgtcgtcgttcgcgtttcggcgtttcgggtcggcgaggggcgcgttcgcggtcgcggtcgttgtatggcgttgagatggcgggggcgtcgcgcggcggaggcggcggcggaggcggcgcgggcgagttcgggggcgtcgagcgggcggtcgggataagtcgtcggcgcgggtttcgggcgtgcgacgaggagttcgtttgtttagagttggaggcgttgtttcgcggttatacgttgcggttggagtaggcggttacgttgaaggcgttggtcgtttttagtttgttggcgggcgcgttggcgttggtcgagttgttgggcgcgtcggggttcgcgtt

SEQ ID NO: 4002 - DNA, 290 bp, synthetic construct
  misc_feature 1..290: note = Description of Artificial Sequence: Synthetic polynucleotide
  source 1..290: mol_type = other DNA
atagcgggcgtttttagatattggggaaagtgttttacgatgtttcgagtttttttagtttcgttagcggggcgagcgtgagggtgtttcgatcgattagcggtttcgggtgtagggtggcgggttcggcggcgcgcgttttttttttttttttggcggttcgtacgtgtcgttcgcgtcgcgtttttacgggttacgcgcgggtttcgtagcgtcgcggtcgagtcgggttgttcggttcgcggatatagcgtcggtcgtcgtatttcgtgcggggtcgcggcgcgatg

SEQ ID NO: 4003 - DNA, 307 bp, synthetic construct
  misc_feature 1..307: note = Description of Artificial Sequence: Synthetic polynucleotide
  source 1..307: mol_type = other DNA
cgtgaaattgtttaattaagtgcgtagttatagaggaagaggcggtttttttaatatggcggggtttttgttttttagttttcgggttttgattttagttcgcgtttttattgttttatttttttcgtttttggagtttttcggtgattttattatagtttttgttattttgtgatttgtaggtattgggagatttatagggaggacggcggaatatttggaggttgggaaatggtgagtgcgtggagtgggtgtttcgagaatggggaagaggttgtttgaattcggtcggaatcggttgcggtgg

SEQ ID NO: 4004 - DNA, 212 bp, synthetic construct
  misc_feature 1..212: note = Description of Artificial Sequence: Synthetic polynucleotide
  source 1..212: mol_type = other DNA
agtgttgttaggcggaggttcgttagaaggtttcgtagttgttgaggcggggtgggattgcgttttaggggtcgcgttgaagttggcgtcgcgattattgcgtatcgatttcgtttattttttgttcgttttcgggagttttttttgttttaggacggttttttattttttaaattatgttcgttttttatttcggatttatagttattttt

SEQ ID NO: 4005 - DNA, 375 bp, synthetic construct
  misc_feature 1..375: note = Description of Artificial Sequence: Synthetic polynucleotide
  source 1..375: mol_type = other DNA
tggtttttgagtagtatcgtttagtgtagttttcgttaggaaaagtagtagaatcgatagttttagggggcgagcggggtttatggtgtagggggtcgggcggttcgttgggtaaggcgttcgagaaagcgtttggcgggaggaggtgcgcggttttttgttttaggcggttcgggtgttcgttttatgcggggcgagcgttcggtcgattttcgtcggggcggagtttgaggggtggttgatttatgtacggggattgttatttcgtcgttttcgcgttgtaaattgtgtaagagggagaggaatttttcgttaagttgaaaagttgaatttgttttttaaatttttttttgtagtttagacggggacgttttg

SEQ ID NO: 4006 - DNA, 201 bp, synthetic construct
  misc_feature 1..201: note = Description of Artificial Sequence: Synthetic polynucleotide
  source 1..201: mol_type = other DNA
ggggttgttcgtaatatgtagggaaatgagtatttcgttttgttttttatttttttttagtttttcgtggtgggtgtataggaaaaagaagggcgaaaagcgggggtaatagttagtcgtcgcgcgcgtttttagcgtcgtttttagtaatagcgttaggaggaaagtttgtcgggtttagttattgcgttttatgtcgtc

SEQ ID NO: 4007 - DNA, 356 bp, synthetic construct
  misc_feature 1..356: note = Description of Artificial Sequence: Synthetic polynucleotide
  source 1..356: mol_type = other DNA
ttggagacgtcgggacggaggagttacgcggagagaaggcgagaagaaggcggacgggagcggaacgggttcgggagcgggtttgggagcgggttttcgtcgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgttcgtttcgttttatatttttttaaagtttcgggcgtcgcgtttttttcgtcgtcgttatacgtgtttcggtcgttttttcgttttcgcgcgtcgtttcgttc

SEQ ID NO: 4008 - DNA, 265 bp, synthetic construct
  misc_feature 1..265: note = Description of Artificial Sequence: Synthetic polynucleotide
  source 1..265: mol_type = other DNA
gtcggtttttttgtttgagtcggttgcgtttcgcgtttttcggggttcgtagtttgttagttcgggcggttcgtattcgttttgggaattcgttcgaggtcgcgaatcgttaggggttttcgcgttttttttttatttaggttttttgtttttttcgtcgcggtcgttcggtttttcgcggtagcgatagagttttatttgtagaggattttaaaatgagattaagcgaaagtggaattggtagattcgagtggtgtttggaaat

SEQ ID NO: 4009 - DNA, 697 bp, synthetic construct
  misc_feature 1..697: note = Description of Artificial Sequence: Synthetic polynucleotide
  source 1..697: mol_type = other DNA
gattttagtcgtacgttgtgcgaggtttgtaatattcgttttagtcgttacgagatttatatcgtgtataagcggtattattgcgtttcgcgttacgattcgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacggtttgttgttcggcgcgtttttggtcggttcgggggtcgaggttcggacgtcggtcgatcgcggtttttcgttcgttttcgttttcgtcgttttttcgt

SEQ ID NO: 4010 - DNA, 226 bp, synthetic construct
  misc_feature 1..226: note = Description of Artificial Sequence: Synthetic polynucleotide
  source 1..226: mol_type = other DNA
tgggaggagcgtagatatttttcggtgatagggagggttttttatttggttgttatttggaagtttatagtggtttcggcgggtaggcgggcgggtagagcgcgggttcgaacgtttttcgcgtttgcggcggcgtacgtgcggcggcggcggcggcgtcggcggcgcgggcgggatttattgggtggtcgcgcgcgttattcgcgcgttttttgcgcgtttttgt

SEQ ID NO: 4011 - DNA, 201 bp, synthetic construct
  misc_feature 1..201: note = Description of Artificial Sequence: Synthetic polynucleotide
  source 1..201: mol_type = other DNA
ttttttttatttttttaatttttagtaggatacggaatttcggcgtttttcgaaagttataaaagaggggtacggaaattttaagttcgtcgtgttaattcggagaacgtaaattcgaggtagagcgtgcgtcgtgcggggatgtgggtgtcgaggatttcgaagcgttcggtttttttcgcgatttttattttttttaga

SEQ ID NO: 4012 - DNA, 201 bp, synthetic construct
  misc_feature 1..201: note = Description of Artificial Sequence: Synthetic polynucleotide
  source 1..201: mol_type = other DNA
tatttcgttatttcggcggggtaagttcggattttattagggtaggttcgggaggttatttagggtagacgattcgaggtagagcgttttaaaattttgtcgtcgtacgtttagttagagcgtcgagcgcgtttgtttttttttcgttattttttagttttttattcgtcgattaaatttttgggggattatatttttaag

SEQ ID NO: 4013 - DNA, 215 bp, synthetic construct
  misc_feature 1..215: note = Description of Artificial Sequence: Synthetic polynucleotide
  source 1..215: mol_type = other DNA
ttgttttttagttagaacgtgaatgtattgttgacgtatattgttttgggagaagattagcgtgatgtagtgtttttatgtattagcgtcgtttttttttcgtcgtttgtttcgcggggttaacgtcggcgttttttagcgtcgcgtcggtcggcgtcgcgtagtttcgcgttttcggtcgttcgtttttttttttttttttttttttttttttt

SEQ ID NO: 4014 - DNA, 252 bp, synthetic construct
  misc_feature 1..252: note = Description of Artificial Sequence: Synthetic polynucleotide
  source 1..252: mol_type = other DNA
tgaacgtgtgcgtgtgcgcgcgtgtggttgttttttttagttttagtttcgaacgtaaatattttatcgaggtatagggaagtcgggagtagtcgaggaacgcggagggcgtcgaattagagtttgcggggtttgatagttttttttgcggcgtttaaggtgggcgtaatgtttaataaaaaggtcggaaaatggggatcgatttcgaatattttttttttttatttagtttcggagttcgagtagcggcgg

SEQ ID NO: 4015 - DNA, 203 bp, synthetic construct
  misc_feature 1..203: note = Description of Artificial Sequence: Synthetic polynucleotide
  source 1..203: mol_type = other DNA
cgtttcggcggtcgcggagggagcgtaggcggcgtcgttgtaggggtcgggcgggttggcggcggcggcggcggcggttgtaggagcgcgggtaggttcgcgcgtcgttggtaggggtagtaaatggtagttttttttcgtagtatttattcgcggttgtatcgtatcggggtattgtgggaaatttcgtttattttttcgtt

SEQ ID NO: 4016 - DNA, 201 bp, synthetic construct
  misc_feature 1..201: note = Description of Artificial Sequence: Synthetic polynucleotide
  source 1..201: mol_type = other DNA
cggcggtattcggcgtagaggttttagcgcggggagtcgggtttagtttcggtttgttagcgtcgcggttttagtttattcgaggtcggtttggggggttcgtagggcgcgcggagcgtcgagtgcgcgtcgggttgggtttcgtatttcggtgtaggagcgcgggcgcggcgcggcggagcgtttcgtatggagtcggtt

SEQ ID NO: 4017 - DNA, 201 bp, synthetic construct
  misc_feature 1..201: note = Description of Artificial Sequence: Synthetic polynucleotide
  source 1..201: mol_type = other DNA
gttgaatatcgttcgggtttagtttttatttcgcggtttggtgaagttggttttcgtgtttgtttgggaagtttttgtttggggataatcgttaggttttcgagtcgttttttttttatttttcgttgcgtcggtaattttattttttcgtttttattaacggatcggtatttaaattaaagtttagttttttggggttta

SEQ ID NO: 4018 - DNA, 201 bp, synthetic construct
  misc_feature 1..201: note = Description of Artificial Sequence: Synthetic polynucleotide
  source 1..201: mol_type = other DNA
tttcgtttttcggtagagtttttgttcgcgttaatttatttattaggttttgttcgcgttacgcgcgtttttggtaggtttggggcggggaaaggcgaagcgttgggtacgcgagggtttgtgtattttagtttttacgacgtttttggttttttttaggttcgtcgttgtcgtatttaatttttttttttcgggggttat

SEQ ID NO: 4019 - DNA, 213 bp, synthetic construct
  misc_feature 1..213: note = Description of Artificial Sequence: Synthetic polynucleotide
  source 1..213: mol_type = other DNA
tagtttatttaatattatttatgtattttgtgtaaggaattgtgggatttcgttttacggtaaataatatggaaattttaaaaatagcgatttttttgtgcgtgtttatttacgcgtttcggggtgatttggcggggttgtcgtcgggtgatttatatttttgaatcgcgaagcgatagggaaagcgcgggcgagcgtaggagacgcggtcgg

SEQ ID NO: 4020 - DNA, 385 bp, synthetic construct
  misc_feature 1..385: note = Description of Artificial Sequence: Synthetic polynucleotide
  source 1..385: mol_type = other DNA
ttattttttgtttgtttaagtcggttggttttcgtgattgattcggaataatagagtagatgtttgcgtgggaggtaagttttatttaatatttgttttgcggcgggaaggtttgggtgtttatagatagagttggagtttttcggtgggtggtatagataattagttggggttgttttatatgtaatttaattataggggaaataggtttaaatatcgggtgataagtagcgtaattgtttcgggtgattttgtaattttttttttattaattttttttataacgtatatgattgttataagggttaattaaaaagagcgtgagtggttttatgttatatgtagttggattagaaagtgttgagtatttgtttatgcgtgtaag

SEQ ID NO: 4021 - DNA, 278 bp, synthetic construct
  misc_feature 1..278: note = Description of Artificial Sequence: Synthetic polynucleotide
  source 1..278: mol_type = other DNA
ggtattgcggtttagttttcgttcggggattcgcgggtcgattgtggttttttttggggaagtcggggcgcggggaggcgtttcgggtattttagtcgtacggggtacgttcgttttcggcggggtttttcgtttcgttgtgggagtggtagtgggtgtcggggtggagaaagtacgcgtggcgcggagttttggggacgcggcgttttattcgttttggggagtttcggattttttttagtttttaggttcgtatgtttttttttttttagtgtttt

SEQ ID NO: 4022 - DNA, 248 bp, synthetic construct
  misc_feature 1..248: note = Description of Artificial Sequence: Synthetic polynucleotide
  source 1..248: mol_type = other DNA
acgcgagtcgttagcggtgggatttatcgacgatttttcggggcgataggagtagtttcgagagttagggcgagcgttcgttttaggtggtcggatcgttcgtcgcgttcgcgtcgcgttttttgtaggtaacgggagacgttttcgcgtagcgcgagcgttttagcgcggtcgttcgttttttttttcgagggataaattttttttaaattcgattcgagtttttggattaaattcgtttgcgtcga

SEQ ID NO: 4023 - DNA, 216 bp, synthetic construct
  misc_feature 1..216: note = Description of Artificial Sequence: Synthetic polynucleotide
  source 1..216: mol_type = other DNA
tataatataagggagagaaagtaacgttttggttttagaaatttttatcgttaaggttagttttggttagacgtatagttaaagagtttttttagtttagcggatgaatcgttcgcgagtggtattttttaaaattttggttttattttttaagatgtttttttattgcgtaatttagaaagtattcggatcgtcgttatttattagcggcggcga

SEQ ID NO: 4024 - DNA, 201 bp, synthetic construct
  misc_feature 1..201: note = Description of Artificial Sequence: Synthetic polynucleotide
  source 1..201: mol_type = other DNA
tgaggtgttttttttattaattttaggtatcggtttttggtggaattgtttttagattgtttgagtttttagggttaagttttttttttattttttagtacggagttttatttagaattgtatttcgaaagtttaaagtttatttatggtttttagagataggcgaaggcgaggttttttacgggacgttttggtaggtgt

SEQ ID NO: 4025 - DNA, 208 bp, synthetic construct
  misc_feature 1..208: note = Description of Artificial Sequence: Synthetic polynucleotide
  source 1..208: mol_type = other DNA
cgagtagttagggttagcgagcgattttagtagtagggacgcggtcgtgcgagagttcgcggataggcgagggggattttaggggagtagttgttgtttacgggttacgggcgatgtacggagtggagaagtgaacgtggtttataggatttttgttcggaaggtggagagcgttataggggaattttttcgatttttgttcgtttcg

SEQ ID NO: 4026 - DNA, 201 bp, synthetic construct
  misc_feature 1..201: note = Description of Artificial Sequence: Synthetic polynucleotide
  source 1..201: mol_type = other DNA
ttaggagttcggatttttgtttagttttttggcggagttaagttcgagcgtatagatttttcgagttttagcggttagggggtattgtgtgagcggttgacgttattttttcgttcggtcgaaattaggcggcgggattttatatagttgaggagagggagtcgaggtcgtgatttagggttggcgacgattaaattaagt

SEQ ID NO: 4027 - DNA, 364 bp, synthetic construct
  misc_feature 1..364: note = Description of Artificial Sequence: Synthetic polynucleotide
  source 1..364: mol_type = other DNA
gtcgcgggtgaggtttgtggttaatttcgcgttgtcgaggttttattttttcgagtttagtttgattttaggtcgtttttaggtcggtgtttagttgaggcgggaacgttgtagtttggttgagcgtgatttttaggttttgtgaggaaaagtcgagcgcgttatatcgaggcgttagtcgtttattttattataaggtaaaagatttatgttgttttagttattttaaagttgggagatatattgtattttttattagatttcgaatgtttttagtgtttgtaattttttaagaagtttttagagtagatagtttttggatcgtgggtattttttttcggggacggggattttgttgatcgtt

SEQ ID NO: 4028 - DNA, 213 bp, synthetic construct
  misc_feature 1..213: note = Description of Artificial Sequence: Synthetic polynucleotide
  source 1..213: mol_type = other DNA
gtttagtttttttttagtatgtaaagttttttgttttttttcggagttggcggaggcggtaattttttattttcgtcgtcgggggtcgggtagtagcgggcgcgcgggttagcgtttagtacggcgggtagcgtcgcgttgcgtatcgtcgtcgattatgagcgaggatagtcgcggagatagtcgcgtcgagagcgttaaggatttggagaa

SEQ ID NO: 4029 - DNA, 201 bp, synthetic construct
  misc_feature 1..201: note = Description of Artificial Sequence: Synthetic polynucleotide
  source 1..201: mol_type = other DNA
ttttttcgttacggtaatttaattggaggtagaagtcggcggggcggtcgagcggggcggggcgggagcgcggtcgtcgcgagttacggtggggagcgggcgcgggggattttggcgggtttcgggtagcgcggttgtatttatttgtgttataattgcggcgacggggggttgaggaatcggtttttttaaaagtaaatc

SEQ ID NO: 4030 - DNA, 201 bp, synthetic construct
  misc_feature 1..201: note = Description of Artificial Sequence: Synthetic polynucleotide
  source 1..201: mol_type = other DNA
ttttgggcggttgtagaggtcggtcgttcggtttggtttattttttttaggaaattttatattggagaggtaagggcgattttaaaatgtatcgttgagtcgttaagttgttatttttttttatttttttttgtttttttaaattgtatttaaaaaaaaaaaaaagttaattgtatagagtggttgggcgcgatgggtggg

SEQ ID NO: 4031 - DNA, 296 bp, synthetic construct
  misc_feature 1..296: note = Description of Artificial Sequence: Synthetic polynucleotide
  source 1..296: mol_type = other DNA
ttcgggatcgcgtttcggtcgttcgagtttttcgcgttcgtcgttttttatttcggtcgggggtttatttgggagttcgttgttttcggttagtcgttcgcgtgtgtttagggttagtagtacgtataagtgttagcgtacggtcgtcgcgtttatgtttaatgcgggtttcgttgggcgtgcgggcgtgcggggcgcggggattcgatcgatcggtcgttttcgtaggcgttgttcgttgttcgtcgtttcgttatcgttcgggttttcgagtcgtttagttagttcggttgatg

SEQ ID NO: 4032 - DNA, 201 bp, synthetic construct
  misc_feature 1..201: note = Description of Artificial Sequence: Synthetic polynucleotide
  source 1..201: mol_type = other DNA
ttttgtttggcggtttttgcgttcggggttgttgagttcggggttcgttttgaggtcgcggttgtggtttttggttttttcggttcgcgttattgtcgcgcggcgttcgttgtattttgttttttttgcggtttcgtatgtttttggtggaatttagttcggcggacgacgaggaggatgagatggaagtttgttggaaat

SEQ ID NO: 4033 - DNA, 297 bp, synthetic construct
  misc_feature 1..297: note = Description of Artificial Sequence: Synthetic polynucleotide
  source 1..297: mol_type = other DNA
ggggagggaggcgcggcgcgggaggaggaggggcgtagtcgcggagttagtggtttcgtttggacgcgttgttttttagatattttcggagttttagtcgcgcggatcgcgcgttttcgtcgttttgtttttaaatttttgtcgtagtttttttttaagttagcgaatttattttttaaaattagaaattgaatttcggtacgggaaaggagttcgcggaggagtaaaattatagtagagtaagaagagttttagagagtagttttttcggagtattaatttcgtgtcgggagtgta

SEQ ID NO: 4034 - DNA, 268 bp, synthetic construct
  misc_feature 1..268: note = Description of Artificial Sequence: Synthetic polynucleotide
  source 1..268: mol_type = other DNA
tcgcgttcgggaggggcggttgtcgttcgcggggcgttcgcggtgttcgggtttgggtagcgaggaggtgacgtcgttttcgcgggatgagttcgggaggcggaggggcggaggaggtgttggcggcggtattgagcggcggcggcgtagggcgcgcgggtttttcgcgtcgattttatcgatttaaggggcggcggcggtggcggcggttgagcgattttgggtcgggcgcgtgatgaggaggggtcggcgttagatttcgttgtac

SEQ ID NO: 4035 - DNA, 201 bp, synthetic construct
  misc_feature 1..201: note = Description of Artificial Sequence: Synthetic polynucleotide
  source 1..201: mol_type = other DNA
ttgagtagtcgaagggataattagatagttatagatagatagacggttagttcgagtttcgggtaggagagaggttgcgaggagtagtttatgtttgtttcgtttagttttcgcgttttcgggttgtttttttaatttcgattcgcgtacgttgcgagttttcggcgttgtcgtttagtcggaggggtagtttcgtttttt

SEQ ID NO: 4036 - DNA, 201 bp, synthetic construct
  misc_feature 1..201: note = Description of Artificial Sequence: Synthetic polynucleotide
  source 1..201: mol_type = other DNA
cgcgattagtattttttcgttacgaatttgagagataagaagcgaaaatagggtgtgtgggggatggagagagtttcggggaggtagttgcgttttcgtacgttttaatttaaagaagagagggaaggaggaagcgaatttattgtttagtacgagtcgcggagcggtttaatttagagcgggtagttgcggacgagttgg

SEQ ID NO: 4037 - DNA, 201 bp, synthetic construct
  misc_feature 1..201: note = Description of Artificial Sequence: Synthetic polynucleotide
  source 1..201: mol_type = other DNA
ttttgtgcgagtaaagtcgggagagcgagttttaagtatttggtagcggtgtttttagtaggcgtcgaggaattcggttatttatttttggtgaattttgcgtttattgaggtattcgaggtacggatgtgttcgtttagtattcggagacgaaggagagagagcggggatatgcgttttagttttgttaggttttagggt

SEQ ID NO: 4038 - DNA, 201 bp, synthetic construct
  misc_feature 1..201: note = Description of Artificial Sequence: Synthetic polynucleotide
  source 1..201: mol_type = other DNA
tttttttttttcgcgtatttcgtggttcgattcgagggcgtcgaatacggcggcgtttattagtaggtaggtgaaggtgtagacgatgagggatagagttcgtacgttttgtttttttatggtcgttagtaaggagtcggcgcggggggtatgtttcgtaggtttatagtcgcgcgcgttttattgtagcgttcggcggtc

SEQ ID NO: 4039 - DNA, 302 bp, synthetic construct
  misc_feature 1..302: note = Description of Artificial Sequence: Synthetic polynucleotide
  source 1..302: mol_type = other DNA
cgtttattcgggcgcgcgggtgcgtagcggggttttcgtcgggcgtcggtcggtgcgcgaagtttgttcggtttaatttttaaggcgcgggagcggggcgcggttttaggacggtagggatcgcgatggagcggtttcgggggcggtcgggggacggcgcggtggcggtcggttagttcgttttttcgggggcggcgggcgcggcggcggcggcgggaggggtttcgcgggtttcgcggagtagcggggcggacgcgggcgtatgagtcgcgcgggggtcggggtttttcggcgttcgggcg

SEQ ID NO: 4040 - DNA, 201 bp, synthetic construct
  misc_feature 1..201: note = Description of Artificial Sequence: Synthetic polynucleotide
  source 1..201: mol_type = other DNA
tcggtggtcgcgttcgtgaaatggggacgcgggttttgttttcggattttttttagttttcgatttttcgtatttgtttcgagatttaacgtgttcggttcgtagcgtgttgggtttgcggcgttagggtggttcgagtttcgagattatttgcgtttgcggatatagtcgcggggtttggtatgaagggttttagggagg

SEQ ID NO: 4041 - DNA, 220 bp, synthetic construct
  misc_feature 1..220: note = Description of Artificial Sequence: Synthetic polynucleotide
  source 1..220: mol_type = other DNA
gcggggcgggcgattgtcgggtttcgggttagttttcgtttttcgtttcgttttcgatcgttcggttttttcgttcggcgttttttcgggttgcgtttcgcggtttttggcggcggcggcggcgggcgtagagcgcggtatgggcgttcgggtcgcggggtttggcggcggcgggcggacgggcgcgcggttgcgggcgtaggtgcggggcggcgggtcg

SEQ ID NO: 4042 - DNA, 347 bp, synthetic construct
  misc_feature 1..347: note = Description of Artificial Sequence: Synthetic polynucleotide
  source 1..347: mol_type = other DNA
tatcgtttcgggtgcggcggttttaagcggagatttgagcgcggcgggtcgagttttttaatttgttggcgttgttttttttttttcggcggtgcgcgggcggcgttttaaaggggaggattttgcggcgcgggtaagaggcggcgggagcgcgcggttcgggagtgtggttgtagtgcgtcgggatattagggtttcgcgtttcgtatttaagaggttttcgcgttttaatttttcgcgttcgcgcgttcgcggatttaggtcgaggatcgaaaggggtcgttcgagttttcggggtcggcgtttagagagtttagtaaggtcggtcgttttgtcggtgtgtcgtc

SEQ ID NO: 4043 - DNA, 201 bp, synthetic construct
  misc_feature 1..201: note = Description of Artificial Sequence: Synthetic polynucleotide
  source 1..201: mol_type = other DNA
tggtattaggtttttttatgggtatcggagtaggcggataggggtggggtttcgcgagcgatacggaagggttagtgtggcggagcggattttgtggaggcggggttattgtgtttttgagaagggttttcgggggtggagtttattaaggttgcgggggcgtggttacggagcggagttaataaaagcggggcgtgtacg

SEQ ID NO: 4044 - DNA, 201 bp, synthetic construct
  misc_feature 1..201: note = Description of Artificial Sequence: Synthetic polynucleotide
  source 1..201: mol_type = other DNA
cgttttggtatcgggggcggcggcgtagaggtcgggaggaagaaattcgggttttggtttaggtcgggtttttatttttgcgattcgcgagaggtttaggcgggaaaggcggcgagtggcgttagcggtttcgaaagtaaatttggttcggtgttattgttcgagggtcgtcgggcgcgttttttaattttttcgagtttg

SEQ ID NO: 4045 - DNA, 225 bp, synthetic construct
  misc_feature 1..225: note = Description of Artificial Sequence: Synthetic polynucleotide
  source 1..225: mol_type = other DNA
agtgcgtacgttgtaggaattacggttacgtttcgtcgtttaagggttataagcgtttttgtatgtggcgcgattgttagtgtaagaagtgtaatttgatcgtcgagaggtagcgcgtgatggtcgcgtaggtgggtgcgggcgtgcgggagttcgggtttagttttagtttttttttttttttttttttttagatggagtttcgttcggttgtttaggttgtag

SEQ ID NO: 4046 - DNA, 318 bp, synthetic construct
  misc_feature 1..318: note = Description of Artificial Sequence: Synthetic polynucleotide
  source 1..318: mol_type = other DNA
gttgttaatttattcgggagttcggggtatgaacggttacggttttttttatttgtatatgggcggttcggtgtcgtagtcgttacgggcgtttttgtagcgtacgtttaagtgcgcgcgttgtcgtaattatggcgttttgttttggtttaagggttataagcgttattgtcgttttaaggattgtatttgcgagaagtgtatttttattatcgagcggtagcgggttatggttgcgtaggtggcgttgcgtcggtagtaggttaacgagagtttggagagttttattttcgattcgttgcgcgttttgttagggtt

SEQ ID NO: 4047 - DNA, 265 bp, synthetic construct
  misc_feature 1..265: note = Description of Artificial Sequence: Synthetic polynucleotide
  source 1..265: mol_type = other DNA
aggaaggggagcgtagtttgtagattgaagttagtggcgttgcgttgaatgtaattgcgcgcgttcgtcgggtgagttagcgatttgagttaggcgggggcggttcgatttttttcgtttagtttgggttagaggaagtcgaaagcggttttagtaaggtgaggcgttcgaggttgtagaagatcgagtagaattttgtagagttcgggatgtgttgggttaggtcgttgaggatttgattggttttttttttttttttttttat

SEQ ID NO: 4048 - DNA, 259 bp, synthetic construct
  misc_feature 1..259: note = Description of Artificial Sequence: Synthetic polynucleotide
  source 1..259: mol_type = other DNA
cggaggggaggtcgcggagggtcgggtggaggtttttatcgttagttttaaggtttgtagtatttttttttggtttttgtttttagggtcgatgtgttttcgagcgaagtcgtcgtgtttgggtagaaggcgttttaggaggcgcgaggttttagtcgcggcgttgttttcgtcgttattgttgttgtttcggtttcgcggcgtttagtacggtttcgattttttagttaggcggcggtcgttttcgatttcgcggttt

SEQ ID NO: 4049 - DNA, 201 bp, synthetic construct
  misc_feature 1..201: note = Description of Artificial Sequence: Synthetic polynucleotide
  source 1..201: mol_type = other DNA
gacggggtatcggtattaattagcggttcgtttcggggttttcgcggttaaggcgagaacgtaggattaggagtattgttgtttattttttatcgtaattcgtatatttcgggattacgtaacggcggatggggcgttcgggagcggtttttgtaggggagagtaataggttttcgcgttttggaggtttggtttgcgttt

SEQ ID NO: 4050 - DNA, 323 bp, synthetic construct
  misc_feature 1..323: note = Description of Artificial Sequence: Synthetic polynucleotide
  source 1..323: mol_type = other DNA
ttttcgcgattttatcggggaaatatcgcggatagtcgggttagtagcgttcggagtttattttaggtttttaaatttgtagtattttttagagcgcgcgcgttcggagcgggatttgtttgttttagtgtacgtcgcggagcgaattatcgggttggcgggggtggaggggtgtaggcgtgggggttgcgggtcgttcgggttttgggttttttttgtcgtcgtcgtcgtttttcgttttcggttaggagtcgcgcgtgacgcggttcgtcgtaggagtttcgaaggcgcggcgtcggcgagttttttttcggtaggcgcgt

SEQ ID NO: 4051 - DNA, 201 bp, synthetic construct
  misc_feature 1..201: note = Description of Artificial Sequence: Synthetic polynucleotide
  source 1..201: mol_type = other DNA
agtcgttttcgtatttttcgttatagttttcgtagtaatcgttttagtagtcgtagttttagtagtcgttttatttcggtaagatgtaggaggcggcggtcgtggcggcggcggcggcggcggtcgcggtagtcgcggtgggtagcgtgggacgtttgttttagtttttattttacgggttgggttcggtcgtcgtcgttg

SEQ ID NO: 4052 - DNA, 355 bp, synthetic construct
  misc_feature 1..355: note = Description of Artificial Sequence: Synthetic polynucleotide
  source 1..355: mol_type = other DNA
gcgaatataattgttttagttataggcgaggtttggttaaggtgtgggcgtatttggggtaggttttgagaggtttagcgttcggtggtgcggatagaggcggggtatcgcggcgttcgtcgtcgttttttcgtaggtgattatttttttgtaggtgttttcgggttttaggtggttgcgtgtttgcgttatggttgatattttgggcgagcggtatttggtgatttgtaagggcgcgacggtggaggtcgaggcggcgttgtagaataaggtggtggtattgtatttcgcggcggttcggtgcgcgtcgagtcgcgattttacgtcgttgttttgcgatttttatacggcgttg

SEQ ID NO: 4053 - DNA, 201 bp, synthetic construct
  misc_feature 1..201: note = Description of Artificial Sequence: Synthetic polynucleotide
  source 1..201: mol_type = other DNA
ttcgcgcggagcgattgtgaggggttttgttggaatttggtagcgcggaggtttggagagaagttttatgttggtttttatttagtcggttcgtttttttcgagttttggaagttttatttagtcgtgtatttaatggttttataaagttgattataagttttagcgtatttttgaaggagttaaaagcgacgtaggtgta

SEQ ID NO: 4054 - DNA, 290 bp, synthetic construct
  misc_feature 1..290: note = Description of Artificial Sequence: Synthetic polynucleotide
  source 1..290: mol_type = other DNA
gatattttgtggagtaggtggtttaggttgtcgggtttatcgtcgggcgttttgcgtagcgtttcgtcggatattaagtagggagtcgtcgtcggggtcgcgcgcgtcgtcgaaattttgttttcgtcgtcgtttatcgataggttgtggagaaggttatcgatcgatgttatcgagttatttttgaagcggttatatttggtgcgtggaagtatgttttttcgtgggttcgttgtattcgttcgggcgttgttggtgtcggtttcggcgcgggttgtcgcgtatagtag

SEQ ID NO: 4055 - DNA, 201 bp, synthetic construct
  misc_feature 1..201: note = Description of Artificial Sequence: Synthetic polynucleotide
  source 1..201: mol_type = other DNA
tagagattgtagttttcgtcgggttggatgcgagttttttaggttagagtttagaagcgcgttgggatttgggtttggtttttgggtttgtgttttttttcgtttggttttaattgttcgtatttaagattataataaaaaggtttaggaagtaaattttttggacgcggaagggtcggttcgcgggttttcgtcgagtga

SEQ ID NO: 4056 - DNA, 201 bp, synthetic construct
  misc_feature 1..201: note = Description of Artificial Sequence: Synthetic polynucleotide
  source 1..201: mol_type = other DNA
agaggtcggttcgtcgcgcgggagatattttttttaaagtggaagcgttgcgtgggtagtagcgcgggtcgggttttcggattttagtttttgttgttttcgagattttcgtttcgcgtcgtatttttcgagtttagcgttttcgggttgcgttgggcgtagtggttttcggttagggcgtagtcggtttgggcgttagag

SEQ ID NO: 4057 - DNA, 288 bp, synthetic construct
  misc_feature 1..288: note = Description of Artificial Sequence: Synthetic polynucleotide
  source 1..288: mol_type = other DNA
cgatgtagtttagaattcgcgatttagttcggtttattatagtttttagtagcgatattcgtagttttcgattttttagatcgagtgagtttaattaagtcgttattcgcgtgttagtagttgggcgtttcgattttttagatcgcgtgagtttagtaaagcggttaggcgcgcgtttgtagttcggcgttagttcggatttcgggagtcgttttcgagttcgcgtggacggtagagggcggttgtagttcgggcgtaggcgtcgttggtttgcgggtttttttgggt

SEQ ID NO: 4058 - DNA, 212 bp, synthetic construct
  misc_feature 1..212: note = Description of Artificial Sequence: Synthetic polynucleotide
  source 1..212: mol_type = other DNA
ttatttttcgttgcgggaaggggttgtttggttgtttttgggggtttttagagttattttggtttcgggggattggaggaggaggttatttattttgcgtcgtttttaattcgtgtattattatttattaaatagagatagattttgggttttttaaagacggatgattgggggtggtgattggtttatttttaaatatttattacgtaagg

SEQ ID NO: 4059 - DNA, 201 bp, synthetic construct
  misc_feature 1..201: note = Description of Artificial Sequence: Synthetic polynucleotide
  source 1..201: mol_type = other DNA
agtagtagtaggagtagcgacgtttagattttcgggtgttgtcggggcggtcgcgttattcgtgcgtatagatttcgtagttaggtcgttcgggtcgtagcgggggcgtcgcgggcgcgggtcgggattgagttttcgtcgaggttattagtacgcgttcgcgtagtcgcggagtttttcgtattttcgtttttttgtttc

SEQ ID NO: 4060 - DNA, 246 bp, synthetic construct
  misc_feature 1..246: note = Description of Artificial Sequence: Synthetic polynucleotide
  source 1..246: mol_type = other DNA
gcggggatattttcgggggtttcgggcgcggtttcggggaagaggcggaagttgaaattgcgcgacggggatatttgttgaaaggtcgtttagttcgaaacgagcgttagattttagtaataaaaggttaggcgaggttatatcgcgttggagatagagcggttgtttcggagcgtaggcggcggttcgggcgggaagaggcgttgggcggtcggattcgtagaggggcgtgcgcggagttgggcg

SEQ ID NO: 4061 - DNA, 201 bp, synthetic construct
  misc_feature 1..201: note = Description of Artificial Sequence: Synthetic polynucleotide
  source 1..201: mol_type = other DNA
ggcgttgtatcgtttttgcggttttagaggttcgcgggtgtttgggcgcgggtggcgggcgggtcgggggtttgcgggcgtgtttgtgcgagagttgtttcgcgagcggcgtagagatattcgggcgagttgagagttttattttgttttatcggtggaatgggtatattcggaaggcgtagttgttttatttttgggagg

SEQ ID NO: 4062 - DNA, 201 bp, synthetic construct
  misc_feature 1..201: note = Description of Artificial Sequence: Synthetic polynucleotide
  source 1..201: mol_type = other DNA
ggttgcgcgacgtttttcgtcgttgggggagattagtaaagttattcgtttttggatttcggggtttgggtttttagatttcgtttcgcggcgggagatgcgtttgagttttttatagacggagcgcgttttagtttgacgtagagggatgaatagataagcgtatcgggcgggaatttcgattgtttgtgtatttggggt

SEQ ID NO: 4063 - DNA, 358 bp, synthetic construct
  misc_feature 1..358: note = Description of Artificial Sequence: Synthetic polynucleotide
  source 1..358: mol_type = other DNA
gatatttagcggttttagggtgaatttcgatcgtagtcgtcgtcgtttcgggtagagtttgcgtttttgttttgcgtttcgggcgttgaagtcgggcgggcgatgttcgcggcgtgaaagcgttcgcggcgggcgtcgatttttgttttagttttttgtttttttcgtttcgtttgtttcgtgtttttgtgattttggttttggcgtcgtcgtttaggcgtttcgtaatgtagttgtttttgcgtttcggcgggaggcgttttgtttcgcgagcgttcggggttcggagttcggtttgggggtttagtcgagttcgggcggggtcggggtcgcggtggcgatgtatcgggttcgttag

SEQ ID NO: 4064 - DNA, 201 bp, synthetic construct
  misc_feature 1..201: note = Description of Artificial Sequence: Synthetic polynucleotide
  source 1..201: mol_type = other DNA
cggtcgggttttttggagagggagtgtaaggaggagtagtgttttttcgaggaggttcgggagatttttaaggacgcggagaggacggtgagtttagtttcggggcgtttcgcgtcgcggatattgtaggcggcggtgaattaggtcgcgtggggtcgtttgcgtttttttggttgcggttgtgggcggcgaatacgtagc

SEQ ID NO: 4065 - DNA, 201 bp, synthetic construct
  misc_feature 1..201: note = Description of Artificial Sequence: Synthetic polynucleotide
  source 1..201: mol_type = other DNA
gttcgggacgcgagagggggcgcgacggcggttgcggtcggttcggcgtttatttggtcgtttttgcgagtagcgtttcgcgtttcgttcgcgcggagttcgtatttttcggtcgcgtcgtcgtcgtcggcgaggagtcgtattcgggcgtagcgtcgttcgttcgcgatgacggtcgttcgggtcggggacggggaggcg

SEQ ID NO: 4066 - DNA, 201 bp, synthetic construct
  misc_feature 1..201: note = Description of Artificial Sequence: Synthetic polynucleotide
  source 1..201: mol_type = other DNA
agagagaattcgaggttgtttttgtcgttgaaatttgagcgggagagtatttcgaagtcgtttgcgtggagcgagtagttttcgcgttatgggttagaggcgttcgggagaatttgcgggttacggattatattcgtaggggtttggcggagtaaggtgtcgttcgtcgtttgcgggtaggagtcggttttgggtttcggt

SEQ ID NO: 4067 - DNA, 277 bp, synthetic construct
  misc_feature 1..277: note = Description of Artificial Sequence: Synthetic polynucleotide
  source 1..277: mol_type = other DNA
tcgtagagatttagttttgtttgtcgattggtttttcgacgtcgtcgtcgtgtttgagtttcgttgtttgttcggataagtagaatttcggtaggcgtagcgggcgtcgaggtttgggttttagtcgtggcgttcgtttcggcgtagtggggagtcgcgggcgtcggagaagcggtcgcgttgtttcgggttattgtatcggttgaaaaaattaaaagtaaaattaatatttagaaacgaagtttgcgtgttttcgggggtttcgttttgttttttt

SEQ ID NO: 4068 - DNA, 201 bp, synthetic construct
  misc_feature 1..201: note = Description of Artificial Sequence: Synthetic polynucleotide
  source 1..201: mol_type = other DNA
agttagtggaatcggagggggatttcggaggaatttgtttttgatgtttcggttttttggttttttattagaattcgtagaggattcgttttggagttttcgtgcgttttggtagaggtcggggacgttagagtgtacgtagttttttgcgcgtcgagtttaggtttcgggcgtagggaggatcgggttgagagtagggtg

SEQ ID NO: 4069 - DNA, 247 bp, synthetic construct
  misc_feature 1..247: note = Description of Artificial Sequence: Synthetic polynucleotide
  source 1..247: mol_type = other DNA
gtaagggtcgggagtttggttttttatgaagttgttttaggtcgggattagttttagtttcgacggtcgttgcggtttcgtttcggtagtttcgtgagttcgcggaggagtttcgtattcgatcgtgtatagcgatcgagttggcgcggttcgtatgaagcgaagcgtcggttttagtagcgtagtttgagtaggggattcgcgtggtaattagggttgcgcgcgagttcggggcgattgtggcggt

SEQ ID NO: 4070 - DNA, 201 bp, synthetic construct
  misc_feature 1..201: note = Description of Artificial Sequence: Synthetic polynucleotide
  source 1..201: mol_type = other DNA
ttttcgcgcgtagttcgcgtagcgtttagagtcggacggcgtttttcggtggcggcggaggagttcggagggacgtagtcgggtaaggtagggcgtagggcgggcggcgcgaggcgtagggcgcggcgggtagaggttatttggttattttttttggcgttcggggaaggtgcggcgatggtcggggcgcgcggggcggcg

SEQ ID NO: 4071 - DNA, 201 bp, synthetic construct
  misc_feature 1..201: note = Description of Artificial Sequence: Synthetic polynucleotide
  source 1..201: mol_type = other DNA
cgttaggttcgttttcgttcggtcgttcgttcgttcggtgggtcgcggtggtcgcgggttgcgttgcgcgggtcgggtttggcgggtcgggggttgcgcgcgttcgcgagggcgttcgacgcgggttgaggggcgttggcgtgtgttcgtaggcggttttgcgcgggggacggcgcgtttttggatatcgtcggttttaag

SEQ ID NO: 4072 - DNA, 201 bp, synthetic construct
  misc_feature 1..201: note = Description of Artificial Sequence: Synthetic polynucleotide
  source 1..201: mol_type = other DNA
ttttcgagtttcgcgattttttcgtttatcggggaaggagattttagcgtcgttgttttgttttttttgaacgttgtttttgttcgatttggagtcgtcgcgggagcgttttatgttgcggaaatattgtttttagcgttgtcggtcggcgtttttttttagttttttttttttggttcggcggttttggaattaaatttg

SEQ ID NO: 4073 - DNA, 356 bp, synthetic construct
  misc_feature 1..356: note = Description of Artificial Sequence: Synthetic polynucleotide
  source 1..356: mol_type = other DNA
aatacggagtacgaatataagtaggtatcgtatatttgcgagttattcgggttttcgggggaaggtaaaaagttttaataagttttaagtaagattaggacgtttttatagttttgttttgatagttaaggaaaaaatttgttaaaaattagaggcgttgttgagtgttggcgtgggaatgttagtttagttagagttttgttttgggttatttaaataaaaatagatatgttggtggtaaatgttagttgaatacgtaggagagcggtgtttttcgggttcggagaagggtttgtagttgtatttttttttttttttttttttggtttttttagtttttttattattacgattag

SEQ ID NO: 4074 - DNA, 201 bp, synthetic construct
  misc_feature 1..201: note = Description of Artificial Sequence: Synthetic polynucleotide
  source 1..201: mol_type = other DNA
ttaacgtttgtttttattttaagttttgttatagttgttatatttattattgttcgcgtttgtgtcgtcgcgaggattgggacgtttataaggcgcgttgcgtgtacggtcgcgtgggtagcgtgtgtcgttacgtattgtagttttgtcgcgatagcggttcggtgtatcgcgttttttcgcgtatcgcgcgtgtcggtt

SEQ ID NO: 4075 - DNA, 281 bp, synthetic construct
  misc_feature 1..281: note = Description of Artificial Sequence: Synthetic polynucleotide
  source 1..281: mol_type = other DNA
agtttcgtgcgtcggtttttgtttcgttagtttcgttatggttttttatttattttcgcgggagcgtttttgtttttttattttgtattttttttagagtcgcgcgttagtttttcgtttcgtggaagcgtttttttttcgatttcggttgattttcgttcgtcgtttttttcgcgggtgcgcgttcggtttttttttcgttcggggcgggtttgcgtgggcggtgtttcgggtcggcgggcggagtttcggttttttagttttgcgtttcggtggagttc

SEQ ID NO: 4076 - DNA, 222 bp, synthetic construct
  misc_feature 1..222: note = Description of Artificial Sequence: Synthetic polynucleotide
  source 1..222: mol_type = other DNA
gtttaggttatatattagattttattggggatgtgagaagggtgtagcgggcgtgaggtttcgttttcgtcgttttttgttcgtttttagattcgcggttcgtttggtcgttttatttggtcgatggcgttggtggtgagtataggaaggttattatagttttaatttttgaggtaatggttgaagttcggcggggcgaagtcgttgtacgaggggtcggta

SEQ ID NO: 4077 - DNA, 237 bp, synthetic construct
  misc_feature 1..237: note = Description of Artificial Sequence: Synthetic polynucleotide
  source 1..237: mol_type = other DNA
cgggtttggattaggacggcgaggcgggtcggcgcgcgcgcgaggtggtttttatttatatttagcgcgagttgcggttgcgcggcgtttttttgcgttacgagttttcgcgcgtttacgagtagttttgcgagttcgtcgaggttaataggcgttttacgtttattattatttattttacggatcggcgtatcggtcgtttttttatgtgtatgattatggtcgttttcgagtcgc

SEQ ID NO: 4078 - DNA, 201 bp, synthetic construct
  misc_feature 1..201: note = Description of Artificial Sequence: Synthetic polynucleotide
  source 1..201: mol_type = other DNA
tttggttttttaatttagtagtgtttttgaatgaacgtgtgatagtttaatgaagtagtcgagtattttgatttgaatgttggagtcggggtttatagggggttgtattagttagtataggttgggttatgttattgtgataaagagttttagattttaaatttcgtttttgtgggttagttgaggtttttgttttaggtt

SEQ ID NO: 4079 - DNA, 364 bp, synthetic construct
  misc_feature 1..364: note = Description of Artificial Sequence: Synthetic polynucleotide
  source 1..364: mol_type = other DNA
gttttattagtttttcggtcgagcggaaggcgtcggcgtttagttgggttaagttgttgtagttgaggtcgaggaatacgagtttggtcgagtcgttgaacgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcggtcgcggtagtttacggtgtgcgggtcggtgtaggcgtagttcgcggggtacgcgtgttcgggcgcgagtagtagtagaaggttgtagagttcgagcgt

SEQ ID NO: 4080 - DNA, 201 bp, synthetic construct
  misc_feature 1..201: note = Description of Artificial Sequence: Synthetic polynucleotide
  source 1..201: mol_type = other DNA
gaaattaattcgttagaaaaattttttgggagaggcgggagcggtaggggtggtcgagtggtcgtcgttaaaacgcggttttattttggtagttgattttcgagatttggtagtaagacgtcgcgcgtatcgggcgggttgtattcgacgtttaagtttagttattaagtttaggagcggtttttttaaggcgtgtttcgg

SEQ ID NO: 4081 - DNA, 201 bp, synthetic construct
  misc_feature 1..201: note = Description of Artificial Sequence: Synthetic polynucleotide
  source 1..201: mol_type = other DNA
gcgtttttttttggggtgggtagcgtaggtttggtttgcgggtggggggtggagagtgagaggtacgcggggtattagtttagtttttttttggggatttcgtattcgtagtttaaggaatcggtggagtacgaattttatttttgagttggcgtaagcgttttttttttatggagatttatttcggtttttttttgaggt

SEQ ID NO: 4082 - DNA, 201 bp, synthetic construct
  misc_feature 1..201: note = Description of Artificial Sequence: Synthetic polynucleotide
  source 1..201: mol_type = other DNA
aggaatcggcgttgtcggtgtttgggggtcggggcgcgggcgaagtcgggtcgcggaggatataataggtagagtcgggggtgttcggtcgcgcgtttttcgcgtattatgtagttttttgttatttttttcgtttttaggttaaaattttgagtatgatggaagataataagtagttcgcgtttcgtatcgatggggcgg

SEQ ID NO: 4083 - DNA, 222 bp, synthetic construct
  misc_feature 1..222: note = Description of Artificial Sequence: Synthetic polynucleotide
  source 1..222: mol_type = other DNA
tgcgcgcgtgcgtgtgtggcgtgtgtttgggtgttttatgattgtttttcgtgaggtcgtgtgtgagtttttgcgtgggtcgtgagtgcggtagggagcgcggtgttcgggggtcgtttgtcggtgtgtttgtgcgtgtttgtgcgttagtttttgtttttgcgagtgcgtatttttaggatcgagtttgtttatatgagtttgtgtttgtgtgtgtgcgtt

SEQ ID NO: 4084 - DNA, 201 bp, synthetic construct
  misc_feature 1..201: note = Description of Artificial Sequence: Synthetic polynucleotide
  source 1..201: mol_type = other DNA
gataataagatttgttattgacgttatcgggttggtgatatttaggtatagtagttttagtaaacgaatatatttttatgagaattaagttttttgagagcggtaagttgttttgttttgtttatagttgataagaatacgtttgtacggttatttagtatttagtattgttatttaatcgttttattagtatgtatgaat

SEQ ID NO: 4085 - DNA, 265 bp, synthetic construct
  misc_feature 1..265: note = Description of Artificial Sequence: Synthetic polynucleotide
  source 1..265: mol_type = other DNA
aggcgtatacgaggagttcggtttagtatttttaaattagatttcggaggcgtcgttagggagcggttatcgttgggcgtcgtcgagcgtgttcggggcgcggtcgtggcgggttttttggggcggtagttttaggcgcgggcgcgtagtagtttcgaaggcgtcgtttggtttagtcgttcggttttcgagcgtcgttgtaagtggggggcgtttcgcggcgtcgcgtatattttattggggggtcgtttcgtcggcgttcgtt

SEQ ID NO: 4086 - DNA, 242 bp, synthetic construct
  misc_feature 1..242: note = Description of Artificial Sequence: Synthetic polynucleotide
  source 1..242: mol_type = other DNA
tcgggttgttttcgtcgtttatcggagagggtcgttcgggtgtttggttttgttcgaaagtttttgggtttttttttttttttgtaaaatttaaagtaatcgaataaaaagagtttaggtcgcgcgggcgggttgcgcgttcgcgttttgtagcgcgtcggcgggggttcggttcgcggggttattgtattgagtcgggtagtgtgtggtggtggtggtggtgtagcgtcgtcggcgggggc

SEQ ID NO: 4087 - DNA, 201 bp, synthetic construct
  misc_feature 1..201: note = Description of Artificial Sequence: Synthetic polynucleotide
  source 1..201: mol_type = other DNA
ttttagggcgtagggttacgagttttcgtttttattttcggtttttggtattcggcgtcggtttcgtcgtttttttttatacgtatttttggtagggtttcgcggggcgttttaaagtttgggggtagtttttaggtgtttttgggaagggaaagaaaggttataaagtaaaagaaggagtaaagagaaggcgagggagga

SEQ ID NO: 4088 - DNA, 261 bp, synthetic construct
  misc_feature 1..261: note = Description of Artificial Sequence: Synthetic polynucleotide
  source 1..261: mol_type = other DNA
tcgtttatcgatgagtcgtcgtcgttcgcgttcgggtgtaggtgcgtcgtcgtcgcgtgtaggtcgttcgcgtgtgtatgttcgtgtgcgtgttcgtgggcgtttagatgcggcggcggcgacggttttagttgcgtttcgtggttattttcgtgtagcgcgtggtgtaggttcggtttcgcgtcgttatcgttcgtcgttagtatttcggttaggtcgtcgtcgtcgtttttcgggtaggtcgtttgcgcgtatagttcg

SEQ ID NO: 4089 - DNA, 201 bp, synthetic construct
  misc_feature 1..201: note = Description of Artificial Sequence: Synthetic polynucleotide
  source 1..201: mol_type = other DNA
cggtgttttgggtcgagtcgtttggagattttagattagtatgtgggtgggaaagggcgtttcgttttgggttttttcgtttttgcgcgtagagtagagacgcgtagattcgtttttatttcgtttggtttttttggagtagtttcggcggcggtagcgatgggttgggaggggtcggtacgttggtttgcgcgggttttt

SEQ ID NO: 4090 - DNA, 337 bp, synthetic construct
  misc_feature 1..337: note = Description of Artificial Sequence: Synthetic polynucleotide
  source 1..337: mol_type = other DNA
gaattggataataatgtggcgtttgttattggttaggggaggtagacggcgttttgattggtcgggttcgcgttcggggagtttcgtattttgtagtgttcgaaagattcgaaattttaaaagttttattgcgtgtttttgggaggggagggggcgcgttaggaaaggagtggaaaaaagtgggcgaggaggagcgttgaaaattttttgataagtagttttcgtgcgttcgagagcgtgtgaattgtttttaattatcgtgttcggtgcgtttttttgcgtagatttgtgtaatttttcggtttttggggcgtcggttcggttgtatcgtttttat

SEQ ID NO: 4091 - DNA, 201 bp, synthetic construct
  misc_feature 1..201: note = Description of Artificial Sequence: Synthetic polynucleotide
  source 1..201: mol_type = other DNA
tgaagttgttttttcgggataggaagggttaaatggttgcgcgttaattcggtttcgattggggtgttagggagtaagagtcgtttgtttcgggggatttcgtttggggggtttttaggggtcgttttggcgtttcggttataatttgggcggttttgtgcggcggttttcgtttgcgtttttgcgcgttatttaaaattt

SEQ ID NO: 4092 - DNA, 201 bp, synthetic construct
  misc_feature 1..201: note = Description of Artificial Sequence: Synthetic polynucleotide
  source 1..201: mol_type = other DNA
tagtaggtagtgcgggtatagtgttgtagattattatttcgttaggttcgggtagcgtttattagacggataggcgttcgcggtcgtttttatttcggcgcgtttatttcgagttttttacgtcgcggcgggcgggcgtaatatatttttttatttttagtcgtcgaggattatatttttcgtttagttttttcgatttat

SEQ ID NO: 4093 - DNA, 201 bp, synthetic construct
  misc_feature 1..201: note = Description of Artificial Sequence: Synthetic polynucleotide
  source 1..201: mol_type = other DNA
ttttgaatcgttatttgtttattattcgggcgttcgttatttattaggcgttgtattagaggcgttatacggcgggtatgttggcgttgttttgggcgttcgttttgggtttcgtgttgttgttttcgttttgggtatcgcggttcggcgtcgcgttatcgcgagtttattattcggcgttgttggtcgtcgcggcgttgt

SEQ ID NO: 4094 - DNA, 201 bp, synthetic construct
  misc_feature 1..201: note = Description of Artificial Sequence: Synthetic polynucleotide
  source 1..201: mol_type = other DNA
gtttcgtgcgtttagttttgtcgggcgtcggcgacgcggcggtcgttgtcgttgtcgttatagtcgtgttcgtagtgttttaggcgtaattgggtattcgcgtcgcgggttagtattggtaatttagtcggggttcgagggaagcggagattttcggttttcgacgtttttgggtatcgtcgttttttttttttttagggt

SEQ ID NO: 4095 - DNA, 386 bp, synthetic construct
  misc_feature 1..386: note = Description of Artificial Sequence: Synthetic polynucleotide
  source 1..386: mol_type = other DNA
tgtttgttgaaaaataatattgtgattatttttagcggcgaagggtgtgtttgggaacggtttggggaggggatagaagagagaggggtgggatggacggcggtagaagtgggaggtatacgaggagttattggaaacggcgtttttgtggaggagtcgggggggatggggagtagagggagggggttttgttgttttagcgtttcgaggtcgtggagcggtagtagttgtagtcggagtagtattagtaatagtaatagtgagcgggacggagttaggatcgttcggagcgtataggtttcgaggtagtataaggtttgttatttttttatttgttggtagttgtagaagaagatttgttttttaagtgaaacgtatatgttatt

SEQ ID NO: 4096 - DNA, 201 bp, synthetic construct
  misc_feature 1..201: note = Description of Artificial Sequence: Synthetic polynucleotide
  source 1..201: mol_type = other DNA
aggttatataggggtcgggtgtaggttttacgcggaaaggcgcgtagtgttcggggtttatgtcggtttagggcgtataggttttcggggtttcggggttcgcgttgttcgcgtcgtttgtgagcgttcgttaagggggagggatttgggcgcgggggcgcggagttttcgggagcggcgcgcgtcgcggggggcgggggg

SEQ ID NO: 4097 - DNA, 201 bp, synthetic construct
  misc_feature 1..201: note = Description of Artificial Sequence: Synthetic polynucleotide
  source 1..201: mol_type = other DNA
tgttagggcgtagggagggcggtattcggttttagttttcgtaatttcgcgcgtttttttcgtcgtgggatttgggttttcgcgtcgtttttttgagtttcgagcgcgcggcgggcgggagttaggttgggattggtggtgaggtagggagtgaggagcgagcggagtcgcgtgcgtcggcgcgtagtttcgggtcgtttt

SEQ ID NO: 4098 - DNA, 309 bp, synthetic construct
  misc_feature 1..309: note = Description of Artificial Sequence: Synthetic polynucleotide
  source 1..309: mol_type = other DNA
tttgggtcgcggcggtttttatttcgttatcgtcgtcgtcgtcgtacggttgttcgtcgcgaataagtatcggtattattacgcgacgtagtaggtcgggcgcggcgtgtagttcggcggatgttgttaggttaggcgatttcgtcgtttttggagcgcgagcgcgttttagtttgtagcgatgattttggaattagattttgatttgcgtgggcgtgaggcgaagtaggttcgttagttgttcgcgttcgggcgtagataggtatcgttgttgtcggaagcgtcgttttaattttagcgtttgcgttt

SEQ ID NO: 4099 - DNA, 203 bp, synthetic construct
  misc_feature 1..203: note = Description of Artificial Sequence: Synthetic polynucleotide
  source 1..203: mol_type = other DNA
tattttgttttcggtcggtgattcgttgtggtttttaggttaagtgtttttcgtgttcgggcggttgacgttgtttgaagtttacgcggcgtgtcggcgacgcggcgtcgtggtggttaaggttgggtatttttacgtcgtttggaagttttcggggttagattagtgcgacggcggttggttggttgacggtagtgtgcgtt

SEQ ID NO: 4100 - DNA, 388 bp, synthetic construct
  misc_feature 1..388: note = Description of Artificial Sequence: Synthetic polynucleotide
  source 1..388: mol_type = other DNA
atcgggaagtagttcggtgttttaagttttttgagatttttcggatttgcgcgtcgttcgttcggtagggggttcggtaggcgcgggcggcgggtgggggcgggaggttttgttcgttcggtggttgtcgcggtttttttcgcgttgttttttacgtttggtttattatgtacgaggtaggtaatttgttttttttttcggggatttatttcggagataagaaggtagtttgttttttgtaatggtttttgttggagtgcggcggggtttaggcgcgagcgggggtacgggcggggagttggtagcgaaggatgcgttcggcgtttttcggcggtcgttcggagttcgaggtcggcgcgggaggagcgttgatttcgcgggtcgagtt

SEQ ID NO: 4101 - DNA, 241 bp, synthetic construct
  misc_feature 1..241: note = Description of Artificial Sequence: Synthetic polynucleotide
  source 1..241: mol_type = other DNA
gagggcggcgcgtagcggcgtttcgcgaggtttttacgtcgggcgatatggggtgtttgttgtttttgttgttttgggcgtttttttaggtttggggaagcgttgaaggtgggtggaacgagggcgtttgagtgtattcgcgggagggcggagagagggagttgggtagggacggggagggtaacgtttgatggggattggtgagattcgggacgtattggcgcgatttaggtagaaaatt

SEQ ID NO: 4102 - DNA, 232 bp, synthetic construct
  misc_feature 1..232: note = Description of Artificial Sequence: Synthetic polynucleotide
  source 1..232: mol_type = other DNA
gggttttttatttgtatttttttataaaattgtcgttcgtgtgtgtttttgcgtttggttttttgtatttttaaggggtttttgaagatagggtcgaatgcgcgcgggggttttaggtattttgcgttttacggcgggtttcgtagttcggttcgagtcggttttggaagtttcgttttggattagattggtatcgacgtcgtttttagtttgagcgttgagagggaaaacg

SEQ ID NO: 4103 - DNA, 214 bp, synthetic construct
  misc_feature 1..214: note = Description of Artificial Sequence: Synthetic polynucleotide
  source 1..214: mol_type = other DNA
gaattttttttagtgtcgtaattaggaaagttttaaaaagtaaggattttagatagataagagatttatttttttttttagtataagaaatatttcgcgtcgcgttagtcgaacgttgttcgtataaggttattcgttttttttggtcgggacgtattcggtgttttttagttttttattagaattggtttagggggcgcggaaatagagaggt

SEQ ID NO: 4104 - DNA, 250 bp, synthetic construct
  misc_feature 1..250: note = Description of Artificial Sequence: Synthetic polynucleotide
  source 1..250: mol_type = other DNA
agtagggattagttggtcgtcggtttttcgggtaagatggggaatcgggagatggaggagttgatttcgttggtgaatcgtttgtaggacgcgttttcggcgttgggatagagttgtttgttggagttgtcgtagatcgtcgtggtgggcggttagagcgtcggtaagagttcggtgttcgagaatttcgtgggtaggtaagcgcgtagggcgcggagtaaggatgcggtagtggggcgatttcgttgcg

SEQ ID NO: 4105 - DNA, 201 bp, synthetic construct
  misc_feature 1..201: note = Description of Artificial Sequence: Synthetic polynucleotide
  source 1..201: mol_type = other DNA
ttaggattttgtagattcggtcgcggtcgggtcgagtgtttttcgtcggggttttacgtttacggtttacgtttgtaatattagggttgtacggcgggttcgtagttgggtttgcgtttgggattcggggttttttgcgtttttcgtgtcgtattttttgttttaattttaagcggacgggttttggggttttatcggtta

SEQ ID NO: 4106 - DNA, 467 bp, synthetic construct
  misc_feature 1..467: note = Description of Artificial Sequence: Synthetic polynucleotide
  source 1..467: mol_type = other DNA
tcgtttttttttacgttttttttttcgttttttttcgcgtttagtttcgttttttttattttgtaaaataaagtcggggaaaatgtttgttcgtgtagttcggagcgcgtagttcgtttttgaataagaagtgagtataatggcgtgtttgtaaaaaaaagttttaagttcgttttttttaaaaaatattttgaatgttgtatgttttatgttttttagcgtttcgcgggagagattcggttatagagtaggaggtgagatttttttttcggtatttttatttttttggtcgtacgtttttttgttttagttttttttgggaggattgtaaatgtttttttttagtaagcggtcgttttttattttcgtttcgcgtttaaagtgttgggttataatttggatttggaggtaaatttttgttagattttttttacgtcgttttttttttttttttcgtcggtgttcgg

SEQ ID NO: 4107 - DNA, 201 bp, synthetic construct
  misc_feature 1..201: note = Description of Artificial Sequence: Synthetic polynucleotide
  source 1..201: mol_type = other DNA
ttcgaggggtttatagtttggtattaatttgtaggtgttcgttgttgatttggtttttttttcgatttgcggacggttttttttagcgattttcgatatacgtttttttgttttcgtcggagggtcgggtttggggtcgtcggagtttgcgggaatttagcgtttattcgttgattttcgagtcgtttcgttagttgtgcg

SEQ ID NO: 4108 - DNA, 232 bp, synthetic construct
  misc_feature 1..232: note = Description of Artificial Sequence: Synthetic polynucleotide
  source 1..232: mol_type = other DNA
ttggggtgtttttaggaagtgaaggaaaaggttttcgacgatattgttattggaaaagtgttggttacggttttcgttttattttttttatttacgggttcggagtttttaggagtagttagatcgattatcgtttttgtagttttatttgttttcggagagatatttataagttagtttacggagagtttggattcgttcgttttagtatttacgtttttttcgcgttcgg

SEQ ID NO: 4109 - DNA, 222 bp, synthetic construct
  misc_feature 1..222: note = Description of Artificial Sequence: Synthetic polynucleotide
  source 1..222: mol_type = other DNA
ggttagggatagtaaaggagatacgggtgggtgagacgtcggattttacgagggtttgttgtttttttggcgcgggcgtggaggtattggttagagggtacgtttattagttcgagattttcgggatgaggttattttttgagtttatatttggatatttattttttcgaatgcggtgattttatttatattatagcggttattagcgggtttgagatcgtg

SEQ ID NO: 4110 - DNA, 239 bp, synthetic construct
  misc_feature 1..239: note = Description of Artificial Sequence: Synthetic polynucleotide
  source 1..239: mol_type = other DNA
ggtttttaggcggagcgcgggcgcgaggtgcgggtttcggggcggagcgtacgttcgggaggcgggaagtgggtagtagcgttttcgtttggtttttgtgcgtttcgattcgacgttttttcgttcgattaggtgtttcgagagcgtatagttgggagggttttttcggtcgcggcgagatttacgtttgcggtgtgttagggcggcggcgacggtgacgggcgtggggcgcggcgttg

SEQ ID NO: 4111 - DNA, 209 bp, synthetic construct
  misc_feature 1..209: note = Description of Artificial Sequence: Synthetic polynucleotide
  source 1..209: mol_type = other DNA
cgtttcgggggtttttgtattttagtcggggaatgttgttattttgaggggggttgtttggttgcggggcgtcggggttgggggtattgtttttttaggacgcggtttcgtagtgtagagcgtcgtcgtttgcgtggggggatttggtagttttaggggttgttttgagttttttggcgagtaggagtgagttgttgcggcgagtgagt

SEQ ID NO: 4112 - DNA, 380 bp, synthetic construct
  misc_feature 1..380: note = Description of Artificial Sequence: Synthetic polynucleotide
  source 1..380: mol_type = other DNA
gaggtcgggtttcggcgattttcgagggaggttcgggaattattttcgatttaggcgttagattcggagtcgtacggggtttttagtttagtttcgcgagcggttgttgatcgtttttttcgcgttcgttagggtttttgtttcgcgttagttatcgcgcgttttttttttgtttatgtcgtagttttcgtggtttttgttttggattcgggatgttaggttgagatacgttttgtaaatttttggtagaaatgggcgtaagggggtggatttcgttttcgtttttcgggtttttttttttttttcgtttatatgtttttttattattttttttttttttttttattgtattttgatgaaatggttttgtttgtttaaat

SEQ ID NO: 4113 - DNA, 394 bp, synthetic construct
  misc_feature 1..394: note = Description of Artificial Sequence: Synthetic polynucleotide
  source 1..394: mol_type = other DNA
cgggtcggtagggattaagagtttgaaagggaatttgttttttttttttcgtagttcggttattaaggtaagaaattgtaggtagagaagttttcgaattcgatttaggacgtcggcgtttgttaggattttttcgtttgtttttcgcgtttcgcgcgcgtttatgttattattacggggagggtgtatgcggtaggtgtttggtcgaggttttcgggagcgagtcgtttttacgtgttttagtttgtttttttttcgaagttagacgttggcgttgtagttttgttgtttgacgttgttgtagaagttcgcgtttattcgggttaggtttggggagggttttttggggcggtttttgagttttatttgttcgaagtttttatggggggaggtc

SEQ ID NO: 4114 - DNA, 201 bp, synthetic construct
  misc_feature 1..201: note = Description of Artificial Sequence: Synthetic polynucleotide
  source 1..201: mol_type = other DNA
tttcgttcgggttttttaaatatgtcgtagcgtggttgtttattgttttttttgggtaagaggaggttttagatatttttacgggatttgaattttcgagcgttttgtacggagtagttatttcgttagtattttaaagtgaagttgtttataacggataagttcggagattttatgagaggtcggggtggagaagtcggg

SEQ ID NO: 4115 - DNA, 557 bp, synthetic construct
  misc_feature 1..557: note = Description of Artificial Sequence: Synthetic polynucleotide
  source 1..557: mol_type = other DNA
gtcgttatcgtttagtttcgttgtttaggtgggaggggttatttgtcgcggggtttttaagttagtgtcgtttgttttcggtttttatttattgatagtacggcgttcgagtgattttgtttagtttcgttttgcgtttttgtaaattacgttgttgcgttaattataaatttggttaatatgtttttgtaattttattatttaaaaacgtttttaggtatttggtcgttgttagattaggttcgcgggttcggaggaggtttttttatttgttttcgttagtttcggggatcgtgcgcggttttcgtgtggttttcgtttacgaggtttttcgggtaggaatcgtcgcgcgatttttgtttagcggtcgcgttttggttacgggcgatttttgtcgggaattttgttttcggttaagttgcgttttcgtatttcggtggtttttattcgagttcgcgtttgttggttttttttttggtttttttgtttgatttcgattttgttttcgaattttatttttagatttttttcgttttggaacgtcgatttttttttcg

SEQ ID NO: 4116 - DNA, 212 bp, synthetic construct
  misc_feature 1..212: note = Description of Artificial Sequence: Synthetic polynucleotide
  source 1..212: mol_type = other DNA
agttgggtttttttttattttaaaatttttatttttagtttttaaaagttattttagttcgttatattgaaattggtacggtttttaaagatttttttttcgtagttgtggcgtttttaagaaaatacgagtacggattaggttttggatgagtgttcggttatcgagaattagttattttttattttttaggattttttagttttttttag

SEQ ID NO: 4117 - DNA, 201 bp, synthetic construct
  misc_feature 1..201: note = Description of Artificial Sequence: Synthetic polynucleotide
  source 1..201: mol_type = other DNA
tttttaatggtttagtcgatcgtgtgtataaatttgcgttttattcgtcggggatcgttgggagcggagataaatttaatttttagggtaattttggtttcgttcgttttattttattttgtgtttaaatagagttttttttgaagttgcgaatatttttaggttttttgggtagggttggaggggtcgaggagagttatt

SEQ ID NO: 4118 - DNA, 201 bp, synthetic construct
  misc_feature 1..201: note = Description of Artificial Sequence: Synthetic polynucleotide
  source 1..201: mol_type = other DNA
ttttggataataatgcgcgttttcgtttttttagaaagttagggacgtttttagtcgtcgttagagttggttcggttttttagttttttttcgtggtattcgtaggcgagataaagttcgttttcggtgaggttgcgcgcgtttaaagcgtgcgggatgtttagtacggaggtttttaagcgggggatttttggttttttt

SEQ ID NO: 4119 - DNA, 294 bp, synthetic construct
  misc_feature 1..294: note = Description of Artificial Sequence: Synthetic polynucleotide
  source 1..294: mol_type = other DNA
ggtagatgacgattcgtcgagttcgtcgtttgttttttcggaggcgttcggagttgttgcgggtttcggtcgtcgttgttattgttgttgtcgtcgtcgtcgtgcggggttatttgaaggttggggcgcggaagtttaatttcgtgttgattgggttttaagttttttgcgttttcgtttcgtttcgagtgttcgcgaatttttcggacgtttacgtagattatttagttatattataattttgtttgcggagagaggagaggagaaaaaggggtcgttttaaaaatttttaaa

SEQ ID NO: 4120 - DNA, 244 bp, synthetic construct
  misc_feature 1..244: note = Description of Artificial Sequence: Synthetic polynucleotide
  source 1..244: mol_type = other DNA
tagttttgagtcggttgtcggttaggtgttgggtatattcgcgtcgtcgtcgtcgttcgtttttggtcgcgttagtcgtagggttttcggcgttcgggggcggtagtaggttggagcgtatcgtgcgcgttttgttttttcggcgttttcgtcgtttcggaggttcgggtttttcggttttcgtcggttttcgttttatggtcgcgtgtcgtcgcgttcggttttttcgtcgtttacgttcgtt

SEQ ID NO: 4121 - DNA, 303 bp, synthetic construct
  misc_feature 1..303: note = Description of Artificial Sequence: Synthetic polynucleotide
  source 1..303: mol_type = other DNA
ggtttggggttatgggaataggattaaggttttttgagcgtcgggtttggtttttgtggtttcgtaaattttttagtttgtgtgttacggcgacgcgtagcggttgagtcggagtttacgcggcgcgcgtttttcgcgaggaatttttcggtttgtaggttgtttgttattttcgtttttcgacgcgtttttttttggttcgcgttttcggagttttttttttttttggcgaggatttttttcggcgttcgcggtttcgattttcgtcgcgttgcgttcgttttttcggtttcggttgtttcg

SEQ ID NO: 4122 - DNA, 286 bp, synthetic construct
  misc_feature 1..286: note = Description of Artificial Sequence: Synthetic polynucleotide
  source 1..286: mol_type = other DNA
aatagattttcgagttgaaaaaataaaaataaattggggagttagagtttttgaaagtttcggtaggaaatttaatgggttttttgtttttttaaattttcgttttcgttttcgttgatattttgtaaagtcgcggcggtagcggcggggattacgttgcggtgtattatttttcgttattttttcgcgttgggttggggtcgagggggtttcgtagagtcggtaatcgaatcggttttggtttgttttttttattttttagttattattagaattagttttcgcg

SEQ ID NO: 4123 - DNA, 261 bp, synthetic construct
  misc_feature 1..261: note = Description of Artificial Sequence: Synthetic polynucleotide
  source 1..261: mol_type = other DNA
tggttgtggaattagatttgttttgaatttagtggagcgtatcgttggggttcggaagttatcgttcgcgggtatcgggttggcgttgttcgagtggaatcgatagtttgcgagtttcggttgtaagtggtttttttttttcgcggttgttgtttagtgtcgggtgagggttgcgagtgtggtaagttgtaaagagagttttagaggttcgaagagcgttgcgtttttattcgcgttcgttttttttttttttcggttttt

SEQ ID NO: 4124 - DNA, 201 bp, synthetic construct
  misc_feature 1..201: note = Description of Artificial Sequence: Synthetic polynucleotide
  source 1..201: mol_type = other DNA
gaacgcgtagagagttttttggagtgttttgattttgttttcgagagggtttttaattttcgtatttttttagtggttgttttggtaggtgcgcgttttgcggggagttgcgtttcgggggttatcgtcgagcgggagttgttttttggaattttgtttatcgcgaattgggtgtttattttttatttttgttttttagtg

SEQ ID NO: 4125 - DNA, 201 bp, synthetic construct
  misc_feature 1..201: note = Description of Artificial Sequence: Synthetic polynucleotide
  source 1..201: mol_type = other DNA
tcgcgttttagtatcgagtgttttaagttttgcgcgtagcgtcgggtttggaaggcggcgaatggttgtttagtcgtcgtttttattagtgatattcggtcgttagttttcgtttaggatgtgtatatttgttggtagtattggttcgggtggtagttatcgggttatttattttataggtataatcgtatttaatttaat

SEQ ID NO: 4126 - DNA, 201 bp, synthetic construct
  misc_feature 1..201: note = Description of Artificial Sequence: Synthetic polynucleotide
  source 1..201: mol_type = other DNA
gcgtttcgggaagtgtatggttttaaggtttaaggcgttaggatttaggtttttagagtttttaattagtgttattttttttcgtagcgcgggtgttagtcgcgagttcgtagtttttcgatattcgtttttttttggggttttcggggatttttttagaggttgtaaaggtgttagaagtttaaggtaggaggtagtttg

SEQ ID NO: 4127 - DNA, 201 bp, synthetic construct
  misc_feature 1..201: note = Description of Artificial Sequence: Synthetic polynucleotide
  source 1..201: mol_type = other DNA
tcggcgtcgtcgttgtcgttcgggtttcgcgattcgggtcgggttgtgggcgcgcggtaggcgggttgcggcggcggcgggacggggcggtcgcgggttgcgtggggtttgtgcgcgcgtgtgcgcgggcgtcggttgtgcgcgtcgcgggcggatagggttcggtcggcggcggtaaagttgggattcgcgggtcgggcg

SEQ ID NO: 4128 - DNA, 201 bp, synthetic construct
  misc_feature 1..201: note = Description of Artificial Sequence: Synthetic polynucleotide
  source 1..201: mol_type = other DNA
tgtttcggttgatttcgttttgtagttagtttgaggttaggcggtcgttttttgtaggttataaattttcggcgtaaaagtagggttttgaacgcgatatcgtattagagcgtttagttaagcgagttgtttttatttttattgtgtcgggcggcgtaaattgcgggcgtaggtagaggagtcgcggttttgcgtcgggcg

SEQ ID NO: 4129 - DNA, 201 bp, synthetic construct
  misc_feature 1..201: note = Description of Artificial Sequence: Synthetic polynucleotide
  source 1..201: mol_type = other DNA
ttgcggaggggtcggtgggttagagttaggttaggtagttgttgagtttttttttttttttttggcgggagtgtgtgtgtaaggggttagggggcggagtcggagaaagggttgggggtgttcgtgtttagcgttttttcggacgcggttttataatttagttgcgagaatagatggacgtagcggcggtttatttcgggg

SEQ ID NO: 4130 - DNA, 201 bp, synthetic construct
  misc_feature 1..201: note = Description of Artificial Sequence: Synthetic polynucleotide
  source 1..201: mol_type = other DNA
cgcggtttttcgtgggttggtcgggttaatgagcgcgcggttgtaggggcggcgggcggggagggggcgtcgagttttgcggatggaggcgcgggtagcgcggcgcgtttatttcgcgcgggcgttgttggcggggggcggcgtagttattggattcggatcggggtcgcgattcggggtggcgggtggcgtgggcggcgt

SEQ ID NO: 4131 - DNA, 201 bp, synthetic construct
  misc_feature 1..201: note = Description of Artificial Sequence: Synthetic polynucleotide
  source 1..201: mol_type = other DNA
ttcgtcgatttttagaggtatcggttgcgttttttggtggtttggaacggcgcggagggtaagtttgttgtgatttgttacgatcgtatcgcgtagtagtcgtagcggcgcgagggggttcggttggggttggagtataagttcgaggtcgtcgtgttttcgtttagttgggtcggtcggttttcggtcgcggggtttcgc

SEQ ID NO: 4132 - DNA, 344 bp, synthetic construct
  misc_feature 1..344: note = Description of Artificial Sequence: Synthetic polynucleotide
  source 1..344: mol_type = other DNA
gtcggttagagggtttacgtaagtttcgaaattcggggggacgttttttttatttttatttttgcgttcgttcggggttgggcgcgtcggggcgtacgtacgtcggtttgttggcgatttggcgtatttgttcgcgcgttttggttttagttgtcgtaggttttttttgtatttatttttagtttttaaagttagtgtagttagtatcgtttatttggagttttaatttttttttgcgattttcgtatatttattgtattttatttattattttcgggtcgcgtaggttcgggtttgcgaagatacgcggtttattttcggttatttcgtttatttggttaaag

SEQ ID NO: 4133 - DNA, 201 bp, synthetic construct
  misc_feature 1..201: note = Description of Artificial Sequence: Synthetic polynucleotide
  source 1..201: mol_type = other DNA
attttttttcgcggcgttttttcgcgtagtttttagattgtttagtcggtgttcgcgggcgttcgttttttgcgagttttaggttcgcgcgagttgtttgcgggaggggtcggggatacggatagacgttgttttattagggattcggaggatttggtgggtaagagtatgatttagcgattttcgtttcgggtaagcgtt

SEQ ID NO: 4134 - DNA, 218 bp, synthetic construct
  misc_feature 1..218: note = Description of Artificial Sequence: Synthetic polynucleotide
  source 1..218: mol_type = other DNA
attatttttttttttgtttaaaggattttttttttttttttgattttacgaatttatttttttaataggtttttaaagtatgggcggatgtgttttttttcgtttatcgttaggagtcgagtttcggtaggtgagcggtgtaaaatacgtatttagttgtttttagtttttttcgttttcgttgagttggttgtttttatttcgtattacggtattcg

SEQ ID NO: 4135 - DNA, 234 bp, synthetic construct
  misc_feature 1..234: note = Description of Artificial Sequence: Synthetic polynucleotide
  source 1..234: mol_type = other DNA
gcgcgtttcgtgcgttttcgtttttcgcgcgttttcggtttattttcgtttttggagagttgtcgtttgcgttcgggcgcgcggttggttgttttttcggcggcggcggcggcggttttattagcggagttttcgtttatgattggtttcgttcgggaagttggagacgggcgatgaataattgatgtgtgcggtgcggtagtcggacggcggcggcggtggcgggtagtagcg

SEQ ID NO: 4136 - DNA, 201 bp, synthetic construct
  misc_feature 1..201: note = Description of Artificial Sequence: Synthetic polynucleotide
  source 1..201: mol_type = other DNA
cgggggtattcgggtaggggtgttagatatagtattgtatttggtaatttttcggggcgtttagtgtggtttttttattcgggagtttggaagggtttttcgtagttcgtaggagacgtagcgtttttcgtttagggggagtaggaggatagttggtcgttttcgggagttttaggcgcgaagcggttttttttcgtttta

SEQ ID NO: 4137 - DNA, 201 bp, synthetic construct
  misc_feature 1..201: note = Description of Artificial Sequence: Synthetic polynucleotide
  source 1..201: mol_type = other DNA
agttatagtagtcgtatttttcgtagcgcgtcggcgtttagtgtagcgtttttagtagtagcgttagcgcggtcgttcgtacgttttttttcgtcgtcgtcgttcgtatggttgcgttttttttaggtgcgcgtcgcgtagtttttcgacgttcggtgttcggcggtttaggtgtttcggcgtgcgttttcggttttgatt

SEQ ID NO: 4138 - DNA, 235 bp, synthetic construct
  misc_feature 1..235: note = Description of Artificial Sequence: Synthetic polynucleotide
  source 1..235: mol_type = other DNA
tttcgcggtttgggggacgggagaatggggggtttacggtcgttttgggtttttatcgcgtatcgcgttcgtagcggagtttcggagttatggttttgagcgagttggcgttggttcgttggttgtaggagagtcgtcgttcgcggaagtttattttgtttatcgtgtttttggcgttgttgttggataatatgttgtttattgtcgtgggtacgtgcggatagggtatttttgt

SEQ ID NO: 4139 - DNA, 201 bp, synthetic construct
  misc_feature 1..201: note = Description of Artificial Sequence: Synthetic polynucleotide
  source 1..201: mol_type = other DNA
attcgtttattttttatttttggtttatttatcgttatcgatatttgggttatcgtttttaaggtacgtgttacgtcgcggaattgtagcgcgtcgttttcgtcgtattttttattgttttcggtttgtttcgggtgggcgtttggtaaggtttgggcggaggttttttcggttcgcgggttagcgcgttttgttgggaaa

SEQ ID NO: 4140 - DNA, 241 bp, synthetic construct
  misc_feature 1..241: note = Description of Artificial Sequence: Synthetic polynucleotide
  source 1..241: mol_type = other DNA
gttaataacgggcgggtttttatagttcgaagttaaagcgttaaaattcgagggaaggcgaggagggggcggtggcggaggcggttgcggggtcggggttcggttgagttttcgtttgtttaattttatttgttattgtacgcgtttaatcgtcgtatatttttcgtatttaatttggatgatattttgattttattattagtattcggcgtcggattgacgtagtttcgagtcggggatt

SEQ ID NO: 4141 - DNA, 201 bp, synthetic construct
  misc_feature 1..201: note = Description of Artificial Sequence: Synthetic polynucleotide
  source 1..201: mol_type = other DNA
ggggtatttgtatcggggttgggcgggcgtatttagagttaggcgggtaggaatttttgcgtagttattcggtgtttgtatgtttttggcgcggaagggacgttttattagtttcggcgttttttttttttagatttttttttcgtttttttttattgtttgtttgttgtattattttttatttagattatttagatcgtt

SEQ ID NO: 4142 - DNA, 201 bp, synthetic construct
  misc_feature 1..201: note = Description of Artificial Sequence: Synthetic polynucleotide
  source 1..201: mol_type = other DNA
ggtcggcgcgcgtgggtttcggcgaggcggcgttgtaggagttttgcgggtagttggagcgttatttgggcgcggcggtttacggttgtggcggcgttatcgtgcgcgacgtttttttcgcggttaagggtcgcgcggtcgattgcgagagttcgcgcgagtttcgggagcgggttttgcgcgtttgatgggtcgaggcgg

SEQ ID NO: 4143 - DNA, 217 bp, synthetic construct
  misc_feature 1..217: note = Description of Artificial Sequence: Synthetic polynucleotide
  source 1..217: mol_type = other DNA
tcggcggcgagcgttgtattattttacgcgggcgtcgagtcggggtcgggcgtcgcgatcggagggattttttgtttcggcgagttagtttcggagttttcgcgtagcgttcgcgtcgtcgttgagtttttttagttttttatttttaaaaaagttttttttcgtgtgtgtgcgtgcgtgcgcgcgcgcgcgtcgttttggtataagttagttttga

SEQ ID NO: 4144 - DNA, 201 bp, synthetic construct
  misc_feature 1..201: note = Description of Artificial Sequence: Synthetic polynucleotide
  source 1..201: mol_type = other DNA
tagggtttcgatttttcgtggggtacgcgcgatttcggcgtagatgttagttcgttgtttttcgggttgagggagcgaggattttagacgattttagggtcgttgtttaggtttagtttcgcgttttttatttcgttatttcgttttgcggttttagtttggagatttacggattttattgcgattttttgcgtagtgtag

SEQ ID NO: 4145 - DNA, 201 bp, synthetic construct
  misc_feature 1..201: note = Description of Artificial Sequence: Synthetic polynucleotide
  source 1..201: mol_type = other DNA
taaatgggttaaataggttcgtaaggttttcgcgggttttttggttcggaagttgagtcgcgggtgtttggtttgaagtttcgcgttttatagtggttcgcgggtttcggcggtttttgttttacgttttttaaggtattaggtaggtggttttagggtttttgtttacgatattttttgggtggggtaggattatttttt

SEQ ID NO: 4146 - DNA, 201 bp, synthetic construct
  misc_feature 1..201: note = Description of Artificial Sequence: Synthetic polynucleotide
  source 1..201: mol_type = other DNA
tgtagttcgttcggcggcgttttcgggcgagggtttggtgttggggagcgagcgcggagcgaggtgtttttttaaatacgttttgtagtgtgacggcggtcgttcggttggaagagttatttttattttgcggtaggagttcgttcgtcgttatcgttcgtttcggtttttatggttacgcgtttgttttcggtttcgggt

SEQ ID NO: 4147 - DNA, 317 bp, synthetic construct
  misc_feature 1..317: note = Description of Artificial Sequence: Synthetic polynucleotide
  source 1..317: mol_type = other DNA
cgcgttttgttattaggcgttgtagttgttggtcgagttttgtgttcgtggggttttggagtacgatagttgttaggattttatttattatttgcgggatcgtgttagatttcggtttcgcgatttaggtgagtgtcgttatcgtcgtttggagggatttaagggttttgggttgggatttggggtcgtatcggggtttgaggtagaatagcgacgcggattgggagagggcggggggcggttatcgagttaggagagtgattaagaattagcgtattgtggtttgatgttgtaattaggcggggattcgggcggtg

SEQ ID NO: 4148 - DNA, 221 bp, synthetic construct
  misc_feature 1..221: note = Description of Artificial Sequence: Synthetic polynucleotide
  source 1..221: mol_type = other DNA
tttgtattgtggagtacgttatgattgtttacggtggtcgtaggtgtagacgttagtcggaatcggaatcggaatcggagtacgggttgtcgttttcgatcgaatcgcgggcggcgcggacggcgtcgcgcgagggataaggtgcgcgaggcgtacgtatttttatttttattgtcgggagttgatttgtttttttcgcgtggttattcgtcgttgtaaat

SEQ ID NO: 4149 - DNA, 201 bp, synthetic construct
  misc_feature 1..201: note = Description of Artificial Sequence: Synthetic polynucleotide
  source 1..201: mol_type = other DNA
tcgagagttttgcggcgttcgtttttttgttggcggacgtgttttttgagtcgttttcgcgtaggtaagaggttgtcgtttttagcgagggagagagtagcggcgattttatttagttatcggacgtcgtttcgtagtgttttgcgggtgcgaattttaattcgatatattaggtgttttgaggggatggtggtcgtttat

SEQ ID NO: 4150 - DNA, 201 bp, synthetic construct
  misc_feature 1..201: note = Description of Artificial Sequence: Synthetic polynucleotide
  source 1..201: mol_type = other DNA
gtaggggagagcgagtatgtttttgtttcgggcgtcgtgcggtcgtagtagtagcgcggttttttttagtgcgagtcgtgtttggaatgtttcgggtaagcgaagggttagtaagcgaggcgaaacggatattataaagtagagagtggtgtgagttttttcgttttttgaaaagatggtaagttttcgtttcgggaaggt

SEQ ID NO: 4151 - DNA, 201 bp, synthetic construct
  misc_feature 1..201: note = Description of Artificial Sequence: Synthetic polynucleotide
  source 1..201: mol_type = other DNA
gagttttacgtcgtcgtcgtcgcgttagcggtggggggcgggttgggggcggggcggtcggggttgttttttcgggcgtatatgcgagcgtagtattcggcgttgtcgagttatttttttcgtcgttcgttagtaagtttggcggttttaagttaggcgcgttttaggatttaggtttatttgtttttatttagtttcggt

SEQ ID NO: 4152 - DNA, 201 bp, synthetic construct
  misc_feature 1..201: note = Description of Artificial Sequence: Synthetic polynucleotide
  source 1..201: mol_type = other DNA
gggtatagttacggtaatttttagtttgttaatgttaaggcgggcgcgtaaggtcgtttaaatttagatttttttttttatttattttaaaaaataataacgtgttagttattttcgtagatatcgtcggttggtgtttgtttaggagacgttagggttagagcgttatttttagtatcgaaatggtagagagaaagcgta

SEQ ID NO: 4153 - DNA, 230 bp, synthetic construct
  misc_feature 1..230: note = Description of Artificial Sequence: Synthetic polynucleotide
  source 1..230: mol_type = other DNA
tcggtgttttttttcggtcgttttatttagtaatttttcgtgttttgtttttcgattggaaatgttttacggaagcgttttggatagggttttcgttaggcgataagagttcggtgttgagatgtgttacgtttttatttttttattaattatggatggaaataaataaggaagagttaattttgttgagtttttttttcggtaacgagaggcgttttgtagtcgggagg

SEQ ID NO: 4154 - DNA, 201 bp, synthetic construct
  misc_feature 1..201: note = Description of Artificial Sequence: Synthetic polynucleotide
  source 1..201: mol_type = other DNA
gttttttcgagttggtcgtttttgtagatttttacgtttagttgttatagcgtcgtttcgattttttcgttaagtatattttgtattgtaaggttaagtacggtcgtcggtttgggatttagtgttatcgggaggaaaagagagagatttggggttggggtatggatgatggggggaagggcggtcgtttttgttattgtt

SEQ ID NO: 4155 - DNA, 201 bp, synthetic construct
  misc_feature 1..201: note = Description of Artificial Sequence: Synthetic polynucleotide
  source 1..201: mol_type = other DNA
tcgtagacgtcggaggcgttatggtcgttaagttcggcgagttgatgggtatttgttttagttattaggcggtgatgtcgtatttcgtgtgtttggtcgacgagttttcgtagttcgtgcggttcgttaagttgtttaagggtcggggtcggttgcggcggtcgcgttagtttcgttttaagacgtagtcggtgattttcg

SEQ ID NO: 4156 - DNA, 201 bp, synthetic construct
  misc_feature 1..201: note = Description of Artificial Sequence: Synthetic polynucleotide
  source 1..201: mol_type = other DNA
gtagttttaggaagtcgtagtcgtcgtcgtcgtttaggtagagtagtagcgcgcgcgtggcgttggtgcgtaggttgaagttgagttcgtcgttgttcgtcgcgttcgtttagcgcgcgtagcgagtttattgttcggggtcgtcgtcgaattttaggtcgttcgcgcgcgtcgttagcgttagtagtagtagtaatagta

SEQ ID NO: 4157 - DNA, 201 bp, synthetic construct
  misc_feature 1..201: note = Description of Artificial Sequence: Synthetic polynucleotide
  source 1..201: mol_type = other DNA
aagtttttattttttggattcgggtttggcgttttcgttttcggcgcgtttttattcggcggacgcggtcgcgtataaggtttagtacggttcgcgttttcgtagttcggtcgcggttgaatatttttagcgcgaagcgggtgggcgttagtagtttcggggacggcggtttttaggtttgaaagttggcggttcggggtt

SEQ ID NO: 4158 - DNA, 201 bp, synthetic construct
  misc_feature 1..201: note = Description of Artificial Sequence: Synthetic polynucleotide
  source 1..201: mol_type = other DNA
ggttttttagtttgggttaggtcggggcgcgtgtttcgggttttttgtggttgtatcgcgcgttttgtgtttacgggcgaaggcgttggaattcggcgttcggagttcgagtttttgaaggcgggaggcggcgttcgattttaggggttgcgttgggttgtcggagttaagagtgtttgcgtttttagtttcgcgttagaa

SEQ ID NO: 4159 - DNA, 201 bp, synthetic construct
  misc_feature 1..201: note = Description of Artificial Sequence: Synthetic polynucleotide
  source 1..201: mol_type = other DNA
ttagagtgtgattgagcgggttggttcggcggtcgttgtttttcgttttcgttttttcgcgtttggtcgcgttatttattgtcgcgggtgttcgcgtgcgcgtcgtcgatgcggtcgtcggggagcgtttggaggtggaagtcgatgtttacgttgtagtagagtcgtcgtagtcgtttgatgtttagtaggtagtcgtcg

SEQ ID NO: 4160 - DNA, 201 bp, synthetic construct
  misc_feature 1..201: note = Description of Artificial Sequence: Synthetic polynucleotide
  source 1..201: mol_type = other DNA
tatttagaaaatggaaagttgagtggtcgatgaatcggaattgggagtagttttttatgaattagagaaaatgtaagttaaaaggagatattattttttacgtattagattggtaaatattaggaaatattaagttttgttgaggaggaggggtttagggagtttttatattatgtgggtgggattgtaatttggtataat

SEQ ID NO: 4161 - DNA, 201 bp, synthetic construct
  misc_feature 1..201: note = Description of Artificial Sequence: Synthetic polynucleotide
  source 1..201: mol_type = other DNA
ttttcgggacggacgttttaggcgcggcgtcgagtggaggcgagggggttgcggagggggaaggggttacgcgggttacggggtttaatttttgatttttcgcgacgttaagaatgtaggagggtagagttgagggagattttaggtggaatttttaggtggggaaggttgagttgtcggggttgcgggtatcgggaaggt

SEQ ID NO: 4162 - DNA, 201 bp, synthetic construct
  misc_feature 1..201: note = Description of Artificial Sequence: Synthetic polynucleotide
  source 1..201: mol_type = other DNA
tcgtcgtcgtttgttcgggacggtttcgtgaagaaggacggaggtagattgcgtgttcgtagcgggatttttttggtttttgggatcgtcgtggttttcgcggggtttgttacgttttttttcgcgtttttagtgttcgtattttttagttcggtcgtcggcgtagttattttatttttcgtcggttcggtattttcgggg

SEQ ID NO: 4163 - DNA, 268 bp, synthetic construct
  misc_feature 1..268: note = Description of Artificial Sequence: Synthetic polynucleotide
  source 1..268: mol_type = other DNA
gcggttagatttcggttttgtaagttggcggtcgcggcggtttgcgacgtttttcgtcggggggtagttttgtcgtgggtcggggtcgcgattgtcggggcgttaggggcggttagcggtcgtttggttggcgtgtcggcggcgttcggggagggcgggtcggggggcgcggcgtttatgaggtcgttgtagcgtttgatttgtttttgtaggtatttgcggtggtttatttttcgtttcgatttgttcggtttgtttagcgttagtt

SEQ ID NO: 4164 - DNA, 614 bp, synthetic construct
  misc_feature 1..614: note = Description of Artificial Sequence: Synthetic polynucleotide
  source 1..614: mol_type = other DNA
agagttattttgttcgttgttttggattttgaaatttgggagatttatattaaaggagggaatcggtttttttattttttaagcgcgtcgtgttttttatcgtttttttttttggttcgattggttttggttttttttacgtttttagtttttaaattggcgttcgttttatggttcgtgtaggacgttaaaagtacggtaaattttagggcgatttttagtagacgttttcgacgtatgatgtcgagtcgttatcggttttcgtcgttttttgtcgcgttcggggttcggtttgcggtcgtcgttgcgttttgaagcgtatcgcgtcgtcggggtttcgttatttcgtcgttcgtttttcgggtcgggtttttttcgttttttttaggcgttgtttttattttaggcggtttttgttagttgtaatatagagataaattttcgaggcggggagatttttagggtatcgggatgttgaagtttcgcggtttttatttttaagtttaattcgtgcgtcgtttgcgcgtggcgtagttaatttgggtaagggaagatcgtttggtttatagttggttggaaagtttaggttttcggcggtagtagtttcggtcgat

SEQ ID NO: 4165 - DNA, 201 bp, synthetic construct
  misc_feature 1..201: note = Description of Artificial Sequence: Synthetic polynucleotide
  source 1..201: mol_type = other DNA
gggtattagtttcgagtttaggttttattttcgggcggttcgggacgaattttttttataggttagtgtgtgtgtagggtaagtgtagggggttgaggggcgttggcggggaggtagtagaggtggtttggattattttggcgcggcgcgcggtgagcgcgaggatttcgttagtgggagtcgttgagttaaagtgtattt

SEQ ID NO: 4166 - DNA, 201 bp, synthetic construct
  misc_feature 1..201: note = Description of Artificial Sequence: Synthetic polynucleotide
  source 1..201: mol_type = other DNA
ttcgcggcgacggtgacgcgttttggttttgataagtttggttttttttattttatcgggtggcgtcgttgttgattttacgtttagtcgtttttattttcgtttgaaattttttcgatagggtttcgtttcgggggtttagtttttagcgcgtatatattcgcgtggtgtcggtttagttttttgtaaaggaagtagggt

SEQ ID NO: 4167 - DNA, 201 bp, synthetic construct
  misc_feature 1..201: note = Description of Artificial Sequence: Synthetic polynucleotide
  source 1..201: mol_type = other DNA
ttgtagttagtcggcggtttaggtaagagataaggtgtgagtaaaggtttttgatggtcgggtggtttgacggttaggtgcgagtggggaggatagtttacgcggtttgagtagttatttttggttatagttttagttttcgtttttgttttcggtttttgttttggtttgtttgcgcgttatttcgttatttcgtagtgt

SEQ ID NO: 4168 - DNA, 201 bp, synthetic construct
  misc_feature 1..201: note = Description of Artificial Sequence: Synthetic polynucleotide
  source 1..201: mol_type = other DNA
cgttcggtcgtcgtttttagttaattcgggttttttttacggcgattaattagtgcgaagttggttgggcgggaagtcgcgagaggtttttattgcggcgcgggtggcggttaggagttgttaggatagtttttcggtgttttagtttaacggtttcgtttatttatcgttaagagaaatttcgttttgcggtcggttttt

SEQ ID NO: 4169 - DNA, 201 bp, synthetic construct
  misc_feature 1..201: note = Description of Artificial Sequence: Synthetic polynucleotide
  source 1..201: mol_type = other DNA
cgggtattgcgaattgtcgggcgatgttgtcgttgtcgtcgtgatacggagagtaatagttttttagtaatattttttttcgatataggtatatatttttcgataggtacgtatatttattttatagtgttcggttcggttgcggtgagtgaggggtcgggaagaggcgtatcgtttagcgagcgtcgcgcgtcggggttt

SEQ ID NO: 4170 - DNA, 261 bp, synthetic construct
  misc_feature 1..261: note = Description of Artificial Sequence: Synthetic polynucleotide
  source 1..261: mol_type = other DNA
ggatcggcggtgatatcggagttcgtcgtgcgttttcggtcgttttcggtgggtgtcggtttttgtatttgatgcgttcgggatgttttttttattttggcgcgttcgtcgttagttcgtatagcgtttcgtatattttcgtacgcgtttgaaatgcgtacggtttcgtcggttcgcggaattattcggacgtacggagcgtttcgtatcgattcgttcgtcgttttttcgagacgttcgtatcgtgtttgggtcgggcgc

SEQ ID NO: 4171 - DNA, 201 bp, synthetic construct
  misc_feature 1..201: note = Description of Artificial Sequence: Synthetic polynucleotide
  source 1..201: mol_type = other DNA
cggttagggtaatagttagggtaaagggagagagaagtcgtttcggggcgagaaggagaaaagttagagggttgaataggtgacgttgagtttgttggagcgtgtgtgttttattacgtaagggcgcggagttcggtcgttttatttttcgttatttgcgcgttcgggggtacgttttttgcgatagtttggaatttagat

SEQ ID NO: 4172 - DNA, 201 bp, synthetic construct
  misc_feature 1..201: note = Description of Artificial Sequence: Synthetic polynucleotide
  source 1..201: mol_type = other DNA
gggtatcggtgtcgacgtcgcgagggtagcgttcgcggcgggaatattaatgtattttaaagggtacggtcgtcgtcgtagtaggtaattagttggatcgcggcggagcgcgcggaggtggttgttggttgtaaggattgcgtttagttttcgtttcgtttttcgaggttttcgcgtgggtcggcgggtagtgcgtgggtt

SEQ ID NO: 4173 - DNA, 201 bp, synthetic construct
  misc_feature 1..201: note = Description of Artificial Sequence: Synthetic polynucleotide
  source 1..201: mol_type = other DNA
ttttttgtttcggtttcgtgttttcgttggggattgtttgcggtgagtttgtcgtacgtacgttagggtcgaggtagtgatgcggggtagcgtgggaggacgggttgcggagttcgcgttattttgtttgtggggagcgttgtgtttgtttttttgttagcgcgtttagttgtttcggtcgtcgttacgcgggattgtttg

SEQ ID NO: 4174 - DNA, 201 bp, synthetic construct
  misc_feature 1..201: note = Description of Artificial Sequence: Synthetic polynucleotide
  source 1..201: mol_type = other DNA
ggaaaatagggtattcggagtgtaggagattttttagggtcgttttttttttcgggggtgttttgaggaatcgcggcggggattcgtcgttggtagtttgcgggttttggtgttagcgcgtatgggcgggttgtgcggacgtggttggttttttaaaggttttagatttcgttcgggtcgtttagttttttaaagttgtgt

SEQ ID NO: 4175 - DNA, 219 bp, synthetic construct
  misc_feature 1..219: note = Description of Artificial Sequence: Synthetic polynucleotide
  source 1..219: mol_type = other DNA
tttcgggttaggaagttgttaggtaggggagggttagcgttagttgtggacgtttcgggatagttttttattttagtttttgtttttgttttcggcgcggcgtaaacgtaaaagttttcgtggtcgtagttttagtttcggtggtcgttcgattttcgtcgggatttcggttgtatttattggagaagcggcggtttcgattttcgaggaggcggcggc

SEQ ID NO: 4176 - DNA, 268 bp, synthetic construct
  misc_feature 1..268: note = Description of Artificial Sequence: Synthetic polynucleotide
  source 1..268: mol_type = other DNA
tttattattgtttttttttttcgttttttatttttttgtagcgttaagtcggttttttaatttggtttgttgaacgtaaatcgttgagagtttgttgtatcgttttttggggtttttggttgtcgagtttcgttaaggtaaagacgttagtaagcgaggaagcgtagcggaagaaaaataagcgggcgcgcgaggggagttttaggagggttgtcgagtggttggtaggcggttttcgtttttttcgggtggtttcgtcggcggttga

SEQ ID NO: 4177 - DNA, 201 bp, synthetic construct
  misc_feature 1..201: note = Description of Artificial Sequence: Synthetic polynucleotide
  source 1..201: mol_type = other DNA
tttttcggttttaggattggggagtgtgtcgcggggtcgagggtggggaatagttagagggagacgcgaattaggtcgttggcggagggtttagggggagcgtagaggcgacggtttttatgtcggcggttaatatgatggagaatcggtcgttgttcgttttgtaggtgttcgagtcgtagggtgcgttcgagggtagtt

SEQ ID NO: 4178 - DNA, 517 bp, synthetic construct
  misc_feature 1..517: note = Description of Artificial Sequence: Synthetic polynucleotide
  source 1..517: mol_type = other DNA
tagagcgcgggttttcgggttttatttcgggaaaagtttgggtttgttttgcgttgttgcgtgttgcgtttttgggatttgttgattgttttagagggaacgtttcgcggtagtgttagttttttggggattaggaagggcgatttttgtttgggagttagtgtttgggtcgtcgggttcgggtaagcgttgggggtttggttcgagaagatgcggataggtggtttagggcgtcgcggattttcgttttttgcgggtatcgggagtttagggtcgaggcgcgtcgtttcgaggggtttttttttttaataatgcgttcggaatggagttcgcgttttgatagcgcgggttagttcgaaatcgtttagaattcgtttcgatgagtgggtgagtcgttttgggagtttgtcgcgtttcggtagcggagggtttgagtggaaaaatttttattggatgtattttttaatggttggtttgtttcggttttcgttcgagtttttttcggtagtaggcgttg

SEQ ID NO: 4179 - DNA, 226 bp, synthetic construct
  misc_feature 1..226: note = Description of Artificial Sequence: Synthetic polynucleotide
  source 1..226: mol_type = other DNA
cgcgtttttttagtcgcggttttttttttcgtcgtttttttttgtttttttagtttttttttttacgtgtggatgacgttaaaatttcgcgaaaaagtcgcgtggtggtttttcgagcggaggcgcgatttcgtcgtttagcggttttttttcgggggcgtttggagggggagaagggcggaggcggtcggtttttttttttttcgggaggtaggatttttcgacg

SEQ ID NO: 4180 - DNA, 201 bp, synthetic construct
  misc_feature 1..201: note = Description of Artificial Sequence: Synthetic polynucleotide
  source 1..201: mol_type = other DNA
ttttcgggaggcgagtcgcgggttgttgggcgcggaggttggagtcgcgagaggttcggttgttgaagcggttattgttttttagagttaggtttcgcgtcgcgcgttttcgtcgtcgtcggtattgtgtatttatttatttttcggagattggggtaggggaaaaaagttttgaggcgtttttatttttgttttcggggt

SEQ ID NO: 4181 - DNA, 212 bp, synthetic construct
  misc_feature 1..212: note = Description of Artificial Sequence: Synthetic polynucleotide
  source 1..212: mol_type = other DNA
tttcgggcgtttggtatttttttttatcggggtttcggcggcgcgcggcgtttgttcggaggggggttcgggtatggtgttgcggtagttggattcgtcgcgagtttttcgcgtttcgtcgtcgtttgcgtcgcggagttggtttagttgtaaataaatagtagttttttcgtttttttcggttatcgttatttttttcgttttattgcgta

SEQ ID NO: 4182 - DNA, 388 bp, synthetic construct
  misc_feature 1..388: note = Description of Artificial Sequence: Synthetic polynucleotide
  source 1..388: mol_type = other DNA
ttttttcggttatttgtgttgttttcgttttggttgtttttgtttcgagggaagatgttcgagtattttttttattttatttggtcggcgaagtatagttcggtgacgatgtgtagagttttttggtatagattgtttatttcgttttttttgtggaaatttatcgtttggtttttttttcgtttttttttttttttttagttagtcgttttttttttttttcgtatttttaatttttttggcgttttaagttatagttcgttcgcggtgattttggttggagattgcgtcgttgagagtcggtaatttttaggagttttacgttggttttatggcgggagcggagggcgtaggggaaggagaggcgcgcgaggaggttgcggttgtc

SEQ ID NO: 4183 - DNA, 201 bp, synthetic construct
  misc_feature 1..201: note = Description of Artificial Sequence: Synthetic polynucleotide
  source 1..201: mol_type = other DNA
tttttggatgttaaattcggtttagggagtttaggagtcgttgtagttttagtttttttttttttttttttcgatgattcgggtaatgttaattttttttcgggattgaaagttttaaatttaaggtgttaagttgatgggcggtttttgtttttatttttcgatttcgggcgcgtgttttgaaagataggagagaaaaaa

SEQ ID NO: 4184 - DNA, 201 bp, synthetic construct
  misc_feature 1..201: note = Description of Artificial Sequence: Synthetic polynucleotide
  source 1..201: mol_type = other DNA
tcgtggtattttcgttagagtttaagtagttttttaggcgtggggtttggtggacgttggtttggagcgttcggagggcggggtgggggtgggggggacgcgttgtcgtttggggtgttttcgcgtatttttgttgggcgaattttggtttttcggtgttggttgttatttgagtaattgatgggtttttaggggaagtaa

SEQ ID NO: 4185 - DNA, 212 bp, synthetic construct
  misc_feature 1..212: note = Description of Artificial Sequence: Synthetic polynucleotide
  source 1..212: mol_type = other DNA
ttcgtcgttttttttttatttcgttttttatcgtcgtttttagttttttttcgggatgagagagagtcgcgttgcggagtaattttagtggatgggttcgcgggggttgagcgggcggaggacgcgggaatttcgtgatatcgattagttgacgttgttcgcgtgaaattagagtcgggtattagggttttatttttattgtttttgtattt

SEQ ID NO: 4186 - DNA, 250 bp, synthetic construct
  misc_feature 1..250: note = Description of Artificial Sequence: Synthetic polynucleotide
  source 1..250: mol_type = other DNA
taggagggtgggtgttagtttttttttttatttttcgagtttttttttcggcgtttacgtgggcggagtagcgcgagggtgtgcgtggtaggggtcgcggcggcgtgtgtcgtgcgtggggtggggtgcgggttgggcggtttcgttttcgggtttcgcgtcgtcggggcgcggtttttagttttattttttttgttatttgggcggagatttgggggattgtgatttattttgcggaagatacggaggg

SEQ ID NO: 4187 - DNA, 488 bp, synthetic construct
  misc_feature 1..488: note = Description of Artificial Sequence: Synthetic polynucleotide
  source 1..488: mol_type = other DNA
atacgtttttcgttagtttgggcgtcgggtttcgaattttcggtttgtaaatttgcgtattttttttcgtcgcgttcgttagataatttggcgaatagttcgttcgttcgtatttcgtttttttcggttttttttttaaattttaaacgtatcgtcgtgttttaaagaaggtgtttacgtcgtttttagatttcggagcgttttttttttattttcgggattttttaggtcgtttatttttttcgtttttcgtttagatttgagagggatcgaaaatatattttcgattcgggtagttagggtcgaaattgttaagaggagaaaaggtaaagcggaaggagggtggttataaatagatttttttgtttttttttaaaaggatattgtcgttttaaaagtttttttttcgggtttttatttttcgtattttcgtattttgggggagcgtatttaattgaggtaacgtagtttttttttagtgtttgtag

SEQ ID NO: 4188 - DNA, 201 bp, synthetic construct
  misc_feature 1..201: note = Description of Artificial Sequence: Synthetic polynucleotide
  source 1..201: mol_type = other DNA
ggttgaggagaagggagggagagtagagggaggggggaattcggtcgggggaggaggagagaggcgaggaggcggttttggtagcgcgcggcggcggcggcggtagcggtagtagtagcggcggtgcggagagtttggattgggagtttaaagttcggttgggtagcgggagaggaggagtcgtaggagttgtagttttgt

SEQ ID NO: 4189 - DNA, 364 bp, synthetic construct
  misc_feature 1..364: note = Description of Artificial Sequence: Synthetic polynucleotide
  source 1..364: mol_type = other DNA
ttttataattaaggagtatggtggagttgggttaattttaggtatagtttagtcgagttaggcgaggtttagagagatttgattcgtttggtagttttaacggatttgttttcgtagtcgttgcggatttttcggtcgttatggcgattgtgaaatgtggggtggggcgtatgcgttggaagttattcgcgcgggtagtttttgagtgtttttttacgtgttttttagcgcgagtagtattttcgtttttgcgttttttagagcgtgtagttttcggtgagggtagttttacgtatagttttttatattttttttagcgtttgtagttttcggtgcgcgtaggttttaagtttatatgcgtagt

SEQ ID NO: 4190 - DNA, 220 bp, synthetic construct
  misc_feature 1..220: note = Description of Artificial Sequence: Synthetic polynucleotide
  source 1..220: mol_type = other DNA
gtttttatttcgagcgcgtagttttacgtagtttttttatattttttttagcgtttgtagtatttttagtgcgtatagttttgttagtcgttttttcgggcgtcgtttttgtattatttcggtttataattttgcggcgattgtttgaagaatttttcgtggttttattttttttttcgggtttagttttagttgtgatattttaattaaaagattatac

SEQ ID NO: 4191 - DNA, 201 bp, synthetic construct
  misc_feature 1..201: note = Description of Artificial Sequence: Synthetic polynucleotide
  source 1..201: mol_type = other DNA
tcgtttttttcgtttcgagcgattttttgttttagttttgtaggtttcgtattgtagatgtttgttggtttttttgcgttcggcggttttcgcggtgtttcgtaagttttcgtgattttttagtattagtcggttgtgcgttttttgtttttacgggtcggttagtcgtagatatttatttagtttcgcgagtttagtcgt

SEQ ID NO: 4192 - DNA, 201 bp, synthetic construct
  misc_feature 1..201: note = Description of Artificial Sequence: Synthetic polynucleotide
  source 1..201: mol_type = other DNA
ggggtatcgcgttggtatttgtagggagcgattggtttggaagggtagagggtagacgggggtttgggtggggtagcggttattttaggcgcggagaattcgttgtttttatttttttttcgcggatttttattttgcggtttgtgtgttcggtttttttcgcgtggcggggaagtgcgggtggttgttcgggtttttaga

SEQ ID NO: 4193 - DNA, 201 bp, synthetic construct
  misc_feature 1..201: note = Description of Artificial Sequence: Synthetic polynucleotide
  source 1..201: mol_type = other DNA
gtgtcggttttcgaacgtatttcgaggcggggtgagggttggtagtcgtttttgtattcgtcgttgcgagtcgcgttttttaaatttaggtatgggatttcggaaaatcgattcgttgttttgagtgtttattacgtgaggaattggagtggtcgagttcgttaaggcgtcggggatatttgagtagatgagaattggagt

SEQ ID NO: 4194 - DNA, 358 bp, synthetic construct
  misc_feature 1..358: note = Description of Artificial Sequence: Synthetic polynucleotide
  source 1..358: mol_type = other DNA
gcgtagcgtttgagtttgcgtttcgttaagtgtattaagtacgagatttagagcgttatggagatcgtgttgttttggggtttggtcgcgtattgtacggcggttgcgttggtcgtattgtttttttataatatgagtagcgtcggcggcgatcgtttgggtcgcggtaagtcggttcgttgcggttttatttttttcgtgggtcgcgtgtatcgttggatggtggatagtcgcgtggcgttgcgtatttacgagtacgtcgttatttatttgatagtttgtatggagagtttttttcgggatatttattcgcgggtcgtggttttcggggtgtttcggagttgtagtggttttgggt

SEQ ID NO: 4195 - DNA, 201 bp, synthetic construct
  misc_feature 1..201: note = Description of Artificial Sequence: Synthetic polynucleotide
  source 1..201: mol_type = other DNA
ggagttttcgggcgcgttttgggcgtattggggaggttttcgggcgggtaggcggacgttttggggcggcgggcggcggttgtcggggttcgtcggggttcggtcgttcgttgtttatcgataggtattaggaattgatttcgtcgttgttttttgttcggtttagttatcgattagttgtcgcgattatggagaagcgtt

SEQ ID NO: 4196 - DNA, 328 bp, synthetic construct
  misc_feature 1..328: note = Description of Artificial Sequence: Synthetic polynucleotide
  source 1..328: mol_type = other DNA
cgtagggagggagggggtatcgtttgtttttttgttcgaaaggtggaggtaaagagggatttcggattttagagaggtttataattttttataagtaaggcggggggcggaatttagagaggtaaagtgattcgtttttaaatcgtaatattaggaggatagtagggttagatggaatttttcggtttatagttttcgatttcgggtaagtgttttattcgggcgtacggtttgtttttagattagaattaggcgcgttcgtagttaaggaagtttggcgggagattttttcgaggttttcggtttttaggttagcggggttaaggag

SEQ ID NO: 4197 - DNA, 201 bp, synthetic construct
  misc_feature 1..201: note = Description of Artificial Sequence: Synthetic polynucleotide
  source 1..201: mol_type = other DNA
cgttcggtgaagtcggtgtatttattatattttttgttgtttttagtagggaagtcggcggtgaggcgggggagtaggtatggtggtttcggggtttatgcggggtttattgtttatttagaatagcggttattgttgtttattagggcgtatttatcgttggagttttcgcggcgattgtttatttttaatatatatttt

SEQ ID NO: 4198 - DNA, 319 bp, synthetic construct
  misc_feature 1..319: note = Description of Artificial Sequence: Synthetic polynucleotide
  source 1..319: mol_type = other DNA
tggagtcggcggtcgcgttcgcgtcgttgttgtttggttcgttggcggcggggtcgggggttgtcggagttgattttatgtttttttttaatgtagagatcgttggagatggcgagtttcgagattttttttattttttgtttttagagtaattttatggtattaaaaaaaaaaaaaaaaaaaaaaaaaaaaaaaaaaaaaaaaaaagaaggagaaggcgatcggcgaaagtaggagggaaaaagtaggcggcggcgggcgggtaagtaaaagcgcgagggagcgcgcggagtgtttgggtggacgtgtgtgtgcgttc

SEQ ID NO: 4199 - DNA, 201 bp, synthetic construct
  misc_feature 1..201: note = Description of Artificial Sequence: Synthetic polynucleotide
  source 1..201: mol_type = other DNA
atcgcgggaggagagcgtaaggaggtttttcgtaaagttggaggttaggtcggagcgatgtttcgggagcggagtttttttagtttcgggtttttagtcgcggatagttggtagtgttaaagatttcgttattatttgcggttcgtagttgcgattcggtcgtagagtcgggtatcgaggaaggcgtaaagttgagtttgg

SEQ ID NO: 4200 - DNA, 370 bp, synthetic construct
  misc_feature 1..370: note = Description of Artificial Sequence: Synthetic polynucleotide
  source 1..370: mol_type = other DNA
agggcggttcggggtgggggcgttttatttttgttttttatggcgtgtacgaagtttttttggtatagttggttgcgaagttttttttttaggttgaagtcgcggacgttgacgattttttttacgttcgataagttttcgttttcgtcgtatcgttggcggttaatcgggcgttgcgaggatttaaattagagagttcgggatattattgtgggggttggaggtcgttttttaatttgggtttagtattaataggtgtagtagtcgagcgttttttgtattttattattgtaatttaagtaattttgcgtaattgttaaagatgttgaaaagtaggataaggagaggggttcgtatttcgagggtttag

SEQ ID NO: 4201 - DNA, 201 bp, synthetic construct
  misc_feature 1..201: note = Description of Artificial Sequence: Synthetic polynucleotide
  source 1..201: mol_type = other DNA
gttatgttggaatttggaggggaggggggatgttggagaggtatacggtgatggatatggaaggattcgggaggtgtggagtggtgggttcggttcgtcgcgggaaggatatagagggatataggttgttttggagaggcgttttcggatatttggaggggcgtatagtgttgggatttggcggcgtttggggcggagggg

SEQ ID NO: 4202 - DNA, 201 bp, synthetic construct
  misc_feature 1..201: note = Description of Artificial Sequence: Synthetic polynucleotide
  source 1..201: mol_type = other DNA
gtttttcgtttttacgtcgtagttcgggttagcggggttcgtcgcggtggcgttcgcggatgttgtcgtattggtcgttgcggtacggacggcgtagtttcgggcgcggttcggtataggcgtcggcggttttcgttagttagtagttcggcgaggcgttggtttatttatggttttcgggcggcggtttttgcgtttagt

SEQ ID NO: 4203 - DNA, 201 bp, synthetic construct
  misc_feature 1..201: note = Description of Artificial Sequence: Synthetic polynucleotide
  source 1..201: mol_type = other DNA
attcgttcgttcgtgggtgagttgggaggggcgcggcgagggagggtgggttcggggcgggggcggcgcggggcgcgtttgcggttatgcgatattgtttcgttcgcgtttcgtttttttttttgggttttttgggttttttgggttgtaggattcgtcgacgcggcgcgttggtcgtacgggggttgggcgtcgttgtat

SEQ ID NO: 4204 - DNA, 263 bp, synthetic construct
  misc_feature 1..263: note = Description of Artificial Sequence: Synthetic polynucleotide
  source 1..263: mol_type = other DNA
tgggttattcgtgtcgtatgtcggcgtagttgttcgttgtggtaaggggggggcggtcgggtttcggagcgggtcgggagggcgcggggcgcgtatttcgcggtaggtgagcggcgcggttgtaggtgagtagtagtttcggttcgcgcgtttagtttttttcgtcgcgttcgttcggtttatacgtttttcgcgcgcgcgtcgttttcgtttcgcgcgcgttcggtcgttcgttcgttcgtgggattttcgcgaggtcgcgc

SEQ ID NO: 4205 - DNA, 201 bp, synthetic construct
  misc_feature 1..201: note = Description of Artificial Sequence: Synthetic polynucleotide
  source 1..201: mol_type = other DNA
gttttgttttttttgtttttaacgaattggtaagtaaaatattagttgtttattttgaaatttgttttaattattttcgtattttttgaagttcgttgggcgcgttttgggttgtttttttttgagtagtcgggtttagagttaaggcgcgatgattgtcgcgtaagttagggtttacgcggtcggggtttttttttcgtt

SEQ ID NO: 4206 - DNA, 201 bp, synthetic construct
  misc_feature 1..201: note = Description of Artificial Sequence: Synthetic polynucleotide
  source 1..201: mol_type = other DNA
ttttttatttcggtatttttttttggtgacgttaaggggttttttattttttattcgtttttttatttattttttttttttttttaggttcgtttttttgcggttacggagaggggcgggggtcgacgagggcgggtggttcggggtcgagcgcgcgtggggaggtgttggcgacgcgggttcgggagcgcggtttcggta

SEQ ID NO: 4207 - DNA, 201 bp, synthetic construct
  misc_feature 1..201: note = Description of Artificial Sequence: Synthetic polynucleotide
  source 1..201: mol_type = other DNA
ttatttagttttgggggtcgttcgaaattggggaagggataaggttgaagtttcgtcgtttggttttaggggcggaaagttcgatttaagggaagttggtcgcgttttcgcgacggtgtttttggtacggaggattgaggcgtagttcggttgtttttttttgtttgtttttttcgcgttgtttcgtcgtttttgattttt

SEQ ID NO: 4208 - DNA, 201 bp, synthetic construct
  misc_feature 1..201: note = Description of Artificial Sequence: Synthetic polynucleotide
  source 1..201: mol_type = other DNA
cgcggggtcgggcggggatcggtcgggggcgtcgcgcgttcggtcgggttgattgtcgggggcgattttcgcggggtaaggcgggggcgcgggagtagcgcgtagttgcggggttattttatttgagcgttttgaggttagggtcggggtttgaggatacggcgttgggtttcgggggacgcgggtttacgtcggcgttcg

SEQ ID NO: 4209 - DNA, 215 bp, synthetic construct
  misc_feature 1..215: note = Description of Artificial Sequence: Synthetic polynucleotide
  source 1..215: mol_type = other DNA
ttatatttatcgtttcgggcgcgtcgttcgcgcgcggtttcgtttcgggtcggtatttttcggttcggttgttttcggttttcgtttcggtttcggttttcgtttcgtagggttcggtttcgcgatggtggtcgcggcggcgagcgcggtagggagggcgtgtgtatgcgcgtgagagcgcgtagcgtgtgtatgtgcgtgtgcgcgggagggtt

SEQ ID NO: 4210 - DNA, 201 bp, synthetic construct
  misc_feature 1..201: note = Description of Artificial Sequence: Synthetic polynucleotide
  source 1..201: mol_type = other DNA
cgcgagtgttttttaatggtagcgcgggcgtttttaatcgcgaggggttgcgttattatcggcgtttgttggagcggttgcgggagttgggcgtgtagttcgtggttattttgtattattgggatttgttttagcgtttgtaggacgtttacggcggttgggttaatcgcgttttggtcgattattttagggattacgcgg

SEQ ID NO: 4211 - DNA, 201 bp, synthetic construct
  misc_feature 1..201: note = Description of Artificial Sequence: Synthetic polynucleotide
  source 1..201: mol_type = other DNA
gtgttagtagtttcggggtcgttcgtacgtaacgttttcgggtcgggttaggttggttagggtagggcggtcgtttttcgaggaattgcgggcggggcggcggggttaagttgagcgttcgttttgttttcggcgtttcgcggttgcgggcggagcgggttttgcggagtttttcggtcgtttttttcgtagttttcgttt

SEQ ID NO: 4212 - DNA, 201 bp, synthetic construct
  misc_feature 1..201: note = Description of Artificial Sequence: Synthetic polynucleotide
  source 1..201: mol_type = other DNA
ttaggttgtttgtagcgtcgttttgtttttttattttagagcgtaggtgagtggttatttttttaggggatcgcggttgagagcgtttatttttttttttcgtatttggaaattgagtttggcggtagggttgggttatttagagtttgtatatttcggaagggaaagtgattttagaagggagagaggaagtgttgagtt

SEQ ID NO: 4213 - DNA, 217 bp, synthetic construct
  misc_feature 1..217: note = Description of Artificial Sequence: Synthetic polynucleotide
  source 1..217: mol_type = other DNA
tgtagttggtgttgtttttgggacgatgtagacgttttatatttaggcgcgggtgttaggtcgtcgggtattagtttatttttagggtttgtgagttgcgcgtattttttcggtcgcgtattttttgggaggttgtagttagagcgtttttgaagggagggcggtagaagatattttttttcggtttatgtaaatcgttgggggaattttagttaat

SEQ ID NO: 4214 - DNA, 317 bp, synthetic construct
  misc_feature 1..317: note = Description of Artificial Sequence: Synthetic polynucleotide
  source 1..317: mol_type = other DNA
aagcgagcgattttttgagttcgggtggttcggcgggtaagggcggcgcgggagattcgtagggcgcgggcgcggattcggggaattagggttatcgttgcgggcggatgggggttatcgaggcggttcgtttttaggcgtatatttcgtatatttttttgttaagtgaaggggttaaaatgtatagatgggggagtttatttaggaatagaggcgcgagacgtatagttatttttgggttgggagtacgagttagtagattttcggagcgcgttaaacggataatatgttcggtgttgtaaatagaggtttttgtt

SEQ ID NO: 4215 - DNA, 201 bp, synthetic construct
  misc_feature 1..201: note = Description of Artificial Sequence: Synthetic polynucleotide
  source 1..201: mol_type = other DNA
tatttttgtgggggggagggtgtagcgaaggttgttagggatttcgcgatcgcgttttaatacgtattggagcgagtgtgcgagtgattatgagtgtgagcgggtgcgagcgttcggcggggttgatcgttacgttggcggggtcggcggggttaggtagtttttttcgcgttttttttttttcgtttcgtgttttttttt

SEQ ID NO: 4216 - DNA, 201 bp, synthetic construct
  misc_feature 1..201: note = Description of Artificial Sequence: Synthetic polynucleotide
  source 1..201: mol_type = other DNA
acggtgttaagggatttagtttggcggatattttttattaggagatcgtaggtaagcgcgggcgcgttgtaggggtaggttgtagttttcggttgtcgtacgttttattggtcgttcggcgtttttttttttttttttgttgttgagttggtgtttattttttgttatcgttatgggatttcgcgttttcgtgttgggcgg

SEQ ID NO: 4217 - DNA, 201 bp, synthetic construct
  misc_feature 1..201: note = Description of Artificial Sequence: Synthetic polynucleotide
  source 1..201: mol_type = other DNA
gcgtcgtagtttttcgggtatcggcggcggtgattaatttgtaattttagcgtttagagttgttatggtgttcgcgggcggcggcggcggcgatagtgggcgatcggtaggattagtgttaggcgcggcgtttagggcgggcggggacgcgggttttttatttacggcggtttagtttaggtagcgcgttcggttcggttg

SEQ ID NO: 4218 - DNA, 201 bp, synthetic construct
  misc_feature 1..201: note = Description of Artificial Sequence: Synthetic polynucleotide
  source 1..201: mol_type = other DNA
gcggtgtgtacgggagttcgtcgggtatacgcggggtatatttaagtgtattgttaggaggtcgggagtttagcgtgcgagcgtgaggttagattgtgtacggtatcgaggattagttttatttttgagtatgaaagggtgaaatcgtttattttaagttttatttcggagttattaaataatgaatgtattagttatatt

SEQ ID NO: 4219 - DNA, 201 bp, synthetic construct
  misc_feature 1..201: note = Description of Artificial Sequence: Synthetic polynucleotide
  source 1..201: mol_type = other DNA
gggttggtcgcggattcggacggtcgggagcgggcgcggcggtcgtagagacggttttttttcgcgcggttttagcgtagattttagatttggagtcgtgcgggcggagacgcgcggggttttttttcgtttcgtcgtcgttgggtttttagcgttttcggattcgcgggaggataggaattattcggagtgaagttgcgt

SEQ ID NO: 4220 - DNA, 221 bp, synthetic construct
  misc_feature 1..221: note = Description of Artificial Sequence: Synthetic polynucleotide
  source 1..221: mol_type = other DNA
tcgagatataaagatcgaggttgagatcgttaggggttgagggtgaggtcgcgtttcggggtcgttggagcgcgggcgttatgcgagattgtttcggttgcgcgtcgttttagaggagttcgagcgttttttttagtcgcggcgcgttggttttggtcgggattgtagttaggtgggcgtcgcgcgtgtgagcgtcgcgcgtgtgagcgtagatttggatt

SEQ ID NO: 4221 - DNA, 311 bp, synthetic construct
  misc_feature 1..311: note = Description of Artificial Sequence: Synthetic polynucleotide
  source 1..311: mol_type = other DNA
gattattgtcgaatagtcgttggagattcgtagagaagggcgggttttgcgttcggggcgtttcggaggtaagttcggagagttcgggtcgggcggagggcgggagcgtacgagtgtgtgtgtgtgtgtgtgtgttcgcggtgtgttcgcggttcggtgtatacgcgcgcgggttgtaaagttaggagttgcgggagcgtttttttgtttcggtttggtttcggagtattgcgggtcgcggaggtgtgggggtttttgtcgttgcgtttagggtagcggcggaaaaggtgtgtgcggatgcggggcggggt

SEQ ID NO: 4222 - DNA, 308 bp, synthetic construct
  misc_feature 1..308: note = Description of Artificial Sequence: Synthetic polynucleotide
  source 1..308: mol_type = other DNA
ttgagtcgtagaaggtttttttcgcgtttttttttagtagggatttttggacggggagatcgacgggtttgtgggcgttttttcgggatatatttcggttcgttttgtttgggttgggtttatttacgttttgggtggggtttaggaattgcgtgcgggcgtagcgggtgagtatgttgatgatgattatttggttttatttttttacgtcgattagtaggttatagagttttcggtagtttttgtgaattaggtcgatgcgtttcgggtagatttttttaaaggttattattatattgttcgttatt

SEQ ID NO: 4223 - DNA, 201 bp, synthetic construct
  misc_feature 1..201: note = Description of Artificial Sequence: Synthetic polynucleotide
  source 1..201: mol_type = other DNA
aatgtgatatagatattagtttttcgtgtttttggtttttagggttttttttatcgcgttttagtatttgtagtttttttatttttatagcgttcgtcgtcgttaaggtaatagagggatgttcggtgatagattcggcgtcggttttcggcgtcgtaagagaagcgttcgcgcgggcgttttggattcgtagagttttcg

SEQ ID NO: 4224 - DNA, 201 bp, synthetic construct
  misc_feature 1..201: note = Description of Artificial Sequence: Synthetic polynucleotide
  source 1..201: mol_type = other DNA
ttattttatttgagcgtggttaaattgttgttatttagtggggagtaaaaaaaaataatttgtattatcgaaacgagttagtaattggttgggaggcgggcggtagttgggtttcgcgtgttttcggcggtcggggtttttttcggggagaggtatatatacgtatagtcggatcgcgtttcgttagggtcggagttattt

SEQ ID NO: 4225 - DNA, 201 bp, synthetic construct
  misc_feature 1..201: note = Description of Artificial Sequence: Synthetic polynucleotide
  source 1..201: mol_type = other DNA
ggtgggagtcgcgaggagcgtttagtggcgcggtttgtcgggtatggtggtcggttcggcgatcgttgattcgtcgggttcgggggttttggaagcgaggcgcgtttttcgatttcgagattttgtagggttgtaatagacggtggggaggtaaaaaaaaaaaaggaaaaggaaaaaatggtgttaaagttattaagtttt

SEQ ID NO: 4226 - DNA, 630 bp, synthetic construct
  misc_feature 1..630: note = Description of Artificial Sequence: Synthetic polynucleotide
  source 1..630: mol_type = other DNA
tcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggtt

SEQ ID NO: 4227 - DNA, 201 bp, synthetic construct
  misc_feature 1..201: note = Description of Artificial Sequence: Synthetic polynucleotide
  source 1..201: mol_type = other DNA
aaatgggattagagcgcggagggagtttggttaggaggttttttaggatttagtcgcgacgttgaaaagtatgaagggtcggaattaggtatttatttagcgagcgttattaattcgaagttatagcgttaattttttgattcggtcgtttttatacgtagcgtcgggattagaggcgcggtcgtcgttcgtttcgttttt

SEQ ID NO: 4228 - DNA, 239 bp, synthetic construct
  misc_feature 1..239: note = Description of Artificial Sequence: Synthetic polynucleotide
  source 1..239: mol_type = other DNA
gaagaaatcgggtaaatagttgtttttaggttcgtgttacgagttttggcgggatttttttttttttttgtattttttatttttcgattttttttgtgtgcgtcgcgtttcgttgtagtttcgttggagagatggggacggtttggtagaaggtggcggcgataggggttcgggacggtttggggagaggagggtgggggcgcggttgttgtggggtgttttcgggcggggtttacggg

SEQ ID NO: 4229 - DNA, 201 bp, synthetic construct
  misc_feature 1..201: note = Description of Artificial Sequence: Synthetic polynucleotide
  source 1..201: mol_type = other DNA
tgtttagtttttcggaggagtattatgttttgatattttcgttttatcgttttaaagttggtttggggtttcgtagggagtggtttgtatggggagggttcgcgtgttgtgtttttgggaggggtaagagagtgggggcgtagggggcgggttaggtttttgggcgcggcgcgggttcgggggattcgcgcggttgacgtt

SEQ ID NO: 4230 - DNA, 221 bp, synthetic construct
  misc_feature 1..221: note = Description of Artificial Sequence: Synthetic polynucleotide
  source 1..221: mol_type = other DNA
ggtagttggcgcgttcgttttggtcgtagttcggtttggggattcgttgcgtgttttggtattagtgcgtggtgaggaaagcggtggtggcgaatagtagcgttagtaggtttagggttacggttaggagcgttcggtcgcggcggttagtttttatgtcgttcgcgtcgtcgggacgggattgtatcgtcggggagtttcgcgcgcgaagttggtagttg

SEQ ID NO: 4231 - DNA, 201 bp, synthetic construct
  misc_feature 1..201: note = Description of Artificial Sequence: Synthetic polynucleotide
  source 1..201: mol_type = other DNA
tagttttacgtcggttcgtttttcgtttacggttcggtttttttttcgtttggttcggcgttttttcgtttcgagttttttattttttggatttcgggttcgcgggggcgcggagaagaggatttaggaaaggtttgggaatttgatgggtttgtggttggggggaggggtagttttttcgttattttatttttttttcgt

SEQ ID NO: 4232 - DNA, 246 bp, synthetic construct
  misc_feature 1..246: note = Description of Artificial Sequence: Synthetic polynucleotide
  source 1..246: mol_type = other DNA
tgggtttttttaggatttattttatgtagtttttatatggtttttagagttttgatttcgtggttggagtgtttgtttttttttaagtattggtagtatacgggtattttgtattgtacgtagtatatgttgtggttttttagttcgtggtttgtgtaggtggagattttgcgtgggtttagttttcggtttatacgattttgggtcgggggtattaggcggtgtttggttaggggttttcggggc

SEQ ID NO: 4233 - DNA, 223 bp, synthetic construct
  misc_feature 1..223: note = Description of Artificial Sequence: Synthetic polynucleotide
  source 1..223: mol_type = other DNA
tgatattgggggtaggtgatataggagttgcggggtatcggggttagggtcggtgataagtgggtggtcggtggcggtatagtcgggggaaatacgcggacgtcgttgggggatttttggtacggggtagtgggggcgttggcgaatttttcgtaggagttatagtcgttgttcgtttcgttgtataggtttattttgtttaggtttagatagttatagtcgg

SEQ ID NO: 4234 - DNA, 201 bp, synthetic construct
  misc_feature 1..201: note = Description of Artificial Sequence: Synthetic polynucleotide
  source 1..201: mol_type = other DNA
gggtttttcgttagcgtttgcgtttggtttttagttttgagtttcgcgtttatttatcgcgggcgagtgttgcgtagtacggaggacgttttttttttttcgttgttggtagttttcgtaggcgttttattcgggtttaggtttttgtacggtagtggggttttttttttttttcgtgaattcgttgacgtcgtgttttgg

SEQ ID NO: 4235 - DNA, 244 bp, synthetic construct
  misc_feature 1..244: note = Description of Artificial Sequence: Synthetic polynucleotide
  source 1..244: mol_type = other DNA
tgcgtttattcgttgtataacgcgtttcgtttcggtttttagtttatttttcgcgtcgcgttagtttcgaatttggattttcgcgggcgtttgggcggggcgggattttaggtttatttagtaagttaattggttgaggttttcggttggggattaattatcggttttgagaaagttcggtagtggttattatatttggttttcgttaatttttttaaggtagcggtcgttggagtagcggggt

SEQ ID NO: 4236 - DNA, 201 bp, synthetic construct
  misc_feature 1..201: note = Description of Artificial Sequence: Synthetic polynucleotide
  source 1..201: mol_type = other DNA
tttttatttttggttgtttggcggggtttgaaagggtaggtggttttggcggcgcgtttcgcgagggatgtggtagaagggcgtgcgtttggcgtcgaggcggagggattttcgatgtcgtgtggtagcggggtttgttatcgtagtttttcgcgggtattgtttttaggtttagagttagtttttagcgagtcgggtaaa

SEQ ID NO: 4237 - DNA, 457 bp, synthetic construct
  misc_feature 1..457: note = Description of Artificial Sequence: Synthetic polynucleotide
  source 1..457: mol_type = other DNA
tttttttaaatatacgtttttttgttcgcggttcgttattttcgttcgggtttcgggttgtgtagtttttttttaggtttgttcgggtttatgtttttttcgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcgggtcggagtcgtttaggtttgtattcgggggttcgcggtcgacgtatgcgtacgcgcggtggcgggtttgtaggttcgaaggttcggttttttttttaa

SEQ ID NO: 4238 - DNA, 244 bp, synthetic construct
  misc_feature 1..244: note = Description of Artificial Sequence: Synthetic polynucleotide
  source 1..244: mol_type = other DNA
gagcggtgattggaatttacgttcgggagaggttcggagtttcggtcgcgggcggcgggggatttttgtaggaaggggtaggaaggtaagtagttcggcgcgttttggcggtttcgagggatttgggttcgggtttgcggtcgcgtcgtttgggttttttttgggttgggagcgcgtcgggttttcgttttgtacgttgttatcgcgggagacgtttcggtttcgtcgcgcgtagaggggacgc

SEQ ID NO: 4239 - DNA, 206 bp, synthetic construct
  misc_feature 1..206: note = Description of Artificial Sequence: Synthetic polynucleotide
  source 1..206: mol_type = other DNA
gtttcgacgttgcgggcgatagggtttggttttagtagtcgtcgtcgtcgtcgtcgtcgttattcggaggatttagtaaaagtttggatttgggggagggcgcggcgttgagcgggattattattagggttggaaggagatttcgagaatttttgtaggtaacgcgcgtttttaattttttttttttatgtttcgtcgttgcgttt

SEQ ID NO: 4240 - DNA, 203 bp, synthetic construct
  misc_feature 1..203: note = Description of Artificial Sequence: Synthetic polynucleotide
  source 1..203: mol_type = other DNA
ggaagtagtggggggcgttcgaagagtagggtagttacggttatcgtggtcgtcggatcggttatgtgttaaagtttttggggttcggcgtttcgttgggcgcgtagcgcggggagtagacgcgtcgtgggtggggtagcgcggtgttgttggcgttcggttttcgcggggtgtagttttgcgcgtttttatgttgttttttt

SEQ ID NO: 4241 - DNA, 266 bp, synthetic construct
  misc_feature 1..266: note = Description of Artificial Sequence: Synthetic polynucleotide
  source 1..266: mol_type = other DNA
ttaggttatttcgattttggtttttaggttcgggataacgtgttagttttaagagagcgttgtttatagtttcgggtgggttgggtttaattgtacggggcggggcgttaatagtttaggatttgggttgtaggttggtttttgtattaattagcggggcggtttcgggttttagtttttttatttcgtttacgaagggaggcgattgcgagcgtttggggtttttgacggatttcgtttcgggggtggggcggggagtggttacg

SEQ ID NO: 4242 - DNA, 242 bp, synthetic construct
  misc_feature 1..242: note = Description of Artificial Sequence: Synthetic polynucleotide
  source 1..242: mol_type = other DNA
gtttagtagagatttggagttagaagtttagagatagtcgagtgcgtcgtgcggttttcggacgttcgttgtttagttcgattttcgttaattgtgtaggcggttgattcgtagcggtagcggtagtagcgaggattcgagcgttggttgtagcgatattatggattttttttttatggtcgcgtaggtaacggggcgttttttttacgcgtttcgggtcgttaagtttggggaggttcggg

SEQ ID NO: 4243 - DNA, 201 bp, synthetic construct
  misc_feature 1..201: note = Description of Artificial Sequence: Synthetic polynucleotide
  source 1..201: mol_type = other DNA
agtttagattcgcgcgaacgtggatgggtatatagtttcgtttttttttattttgttttttcgaggcgttagtaatttgttttttgtcggtgatttcgggcgttttttttgtcgtcgtttgaggaaggttttgagattcgttttgtgatcgtgattcgttaagcgtcgacgcgtcgcggtcgtttgttttgttttgttttg

SEQ ID NO: 4244 - DNA, 201 bp, synthetic construct
  misc_feature 1..201: note = Description of Artificial Sequence: Synthetic polynucleotide
  source 1..201: mol_type = other DNA
ttttgtttcggtttttgcggggatggatgttttacgtagtaagcgagtaagcgagttttggagatcggggttttgggtgtgcggtcggtttagtgttacgcggtgagataggtatggttattaatttacgttaaggcggttgtgtatttggtatagaaaatattgttgttgaatgttgtttttatagttattcgttagcgt

SEQ ID NO: 4245 - DNA, 312 bp, synthetic construct
  misc_feature 1..312: note = Description of Artificial Sequence: Synthetic polynucleotide
  source 1..312: mol_type = other DNA
ttttttaatattcggtttgtacgtttggcgggggcgtaatagtgttttacggttcgggagttcgtttttggtttttgagtaaggtattttttttatttgtcgtgtgtttagttgaatttagtatatttttttcgtatttttcgtttttttttttttttttttgaatttgtttttttgttttgcgggtttttaatttttttcgaatttcgggcgttcggttcggtttaggcgagcgttcgcggttggggacgcgggtggggacgcggcggtttgggcgttgtaggatgcgtttggtcgcggaggagacgatta

SEQ ID NO: 4246 - DNA, 203 bp, synthetic construct
  misc_feature 1..203: note = Description of Artificial Sequence: Synthetic polynucleotide
  source 1..203: mol_type = other DNA
cgttggttttggttgtttgtggggtttttttaggtttcggggggtttgcggcggtttgggaggtagattttcgcgggtaggtgtggtcgtgtttcgatcgcgcgaggatcgaagttggcggaagtttttgtgcggtgttttttagttcggaggaggttggtttgaagtttttaggcgttgtcgaagtttttttttgttagcgt

SEQ ID NO: 4247 - DNA, 201 bp, synthetic construct
  misc_feature 1..201: note = Description of Artificial Sequence: Synthetic polynucleotide
  source 1..201: mol_type = other DNA
cgtatgcgcgcgcgtaattagattttcgtcgtcgtttttagcgttttttttcggggtagggatttatttaataggttggggtttttggagtgcgcggggtcgcgtggggaagcggggattttattttttttacgcgtcgtttagtattgggtaagggcggggtattttttgggttttcgtttttcgtcgttcgtttcggga

SEQ ID NO: 4248 - DNA, 283 bp, synthetic construct
  misc_feature 1..283: note = Description of Artificial Sequence: Synthetic polynucleotide
  source 1..283: mol_type = other DNA
agcggcggcggcgggttttaggagtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttat

SEQ ID NO: 4249 - DNA, 201 bp, synthetic construct
  misc_feature 1..201: note = Description of Artificial Sequence: Synthetic polynucleotide
  source 1..201: mol_type = other DNA
gttttcggggcgttttgttttgcgttatcgcgcgttcgttcgttcgttcgtttaatttatttgttgaagattaggtagtttaggtggttgattttgtggtcggagcggtggcggttgtagtttttttataggtttttgaaggtcgtgatggttaggatgaagagtatcggcgttagtgttaggtcgggttggaaggcgttt

SEQ ID NO: 4250 - DNA, 247 bp, synthetic construct
  misc_feature 1..247: note = Description of Artificial Sequence: Synthetic polynucleotide
  source 1..247: mol_type = other DNA
ttgagcgcgtgatatggtttgtcgtttttgattaagacgggtacggttattcggcgcggcgagggtaggggcgttatttttatatttttttcggttcgggcgcgttttattttgtagcggtggttttggaattagattttgatttgcgtgggcgtgaggcggatgaggttggttaggtgttcgcgttcgggcgtcgataggtatcgttgttgtcgaaagcgtcgttttagttcgtaggtttgcgttt

SEQ ID NO: 4251 - DNA, 427 bp, synthetic construct
  misc_feature 1..427: note = Description of Artificial Sequence: Synthetic polynucleotide
  source 1..427: mol_type = other DNA
ggggcgtttttttaggggattgggggtggggaggagggcgtacgggtcggggagggggttatcggatttggatttcgggatatttcgggggtttggggggcgggtcgcgcgtttatttgcgttttcgtcgtcgaaggagtttatgtacgggaagtagatggcgagcgtttcgaaggaggcggatagattgaggcggttttgcgagcgttttatgttcgcgtcggcgtcgggcgtttcggtcgcggcggcggcggcggcggcgggcggtttgggtagtttggtcgttttatttttgacgcggagtacggcgcgcggcgtggtggcggcggttcggggtcgggtcgaggtttcgttgcggggttggcgggcgcggcggggtcggcgggcgggttaggagttggcggcgcgcggagttcgaggcgcgttg

SEQ ID NO: 4252 - DNA, 246 bp, synthetic construct
  misc_feature 1..246: note = Description of Artificial Sequence: Synthetic polynucleotide
  source 1..246: mol_type = other DNA
cggtttatagtcgggatgcgttttcgtcggggttatcgcggcggcgaacgtttcggatttcgtatttcggtgattttttgggatgaatcgaagtcggattcgtattttggtcgtaataagcgcgttttacgtcgttacgtattagcggtgattttcgagttttttgtcgttttggttttttcgtaggcgggtttcgaggttttcgtagggagtttagggttacggttacgtgtagtcgttttcgag

SEQ ID NO: 4253 - DNA, 384 bp, synthetic construct
  misc_feature 1..384: note = Description of Artificial Sequence: Synthetic polynucleotide
  source 1..384: mol_type = other DNA
tgcgcgtcggtttggtttgtttgcgggttttagagtttcggcgttcgttgtttttttcgtttttttttttttttttatttttttttttttttagtcgcgacgcgtagggggcgggttttatttttttttcgttttcgtttcggttttaagtcgcggaggcgttcggtgggatttcgttgttgtttaattaggggggatcgggtgagtttttttttttggagtcgggttttattagcgtcgtaggtttataggtcgggggtgggggttttggatcgaggggcggcgcggggcggcgcggggcggcgcgcgcggttttggagcgttagtatttgtttttcgatttttcggtcgtcgttttcggtcgtttcggggatttcgttatta

SEQ ID NO: 4254 - DNA, 415 bp, synthetic construct
  misc_feature 1..415: note = Description of Artificial Sequence: Synthetic polynucleotide
  source 1..415: mol_type = other DNA
tgggtagttttaggtcgtcgaattcggcgtttagcgggggtagttcgcggaaggcgcgagtcgagttagacgtcgcggggaaaggttcgggcggtggttgcgggggcgttaatttcgggagtaggaggtcgggttttagtcgtcgggttttgcgcgtttgttttttgcggcgcggtcggtatttgtagttggggtggtcgcgtaagtgttgtacgcgtagtcgttcggttttttttacgaagggtcgttttttcgtcgcgtttagttttttttacgttttgtttgcgggtcgtgggcgttagtgagtggaacgtcgtcgggcgggtgggcgtcgagtttttcgtgcgttcgggacgtttcgcgagggtttggcgtagttttcgtatttcgcggttcgggatttttgtttttttcg

SEQ ID NO: 4255 - DNA, 543 bp, synthetic construct
  misc_feature 1..543: note = Description of Artificial Sequence: Synthetic polynucleotide
  source 1..543: mol_type = other DNA
tgcgttttacgttttggagcgtgaagtcgggcgttaaaaagttgttgtcgggtcgtagttttagatttagttgttggttaaaggcgtgtaggcggaggcgcgtggtttcgtgtttcggggcgcgttttagtttcggtattattagtttttcgtttttttcggaggggcgttcgagtgcgttcgatacggttagtagcgtcgcggcgagtagtagtagcgtgggtattggtttaaagtttcgagatttcggagttcgtttcgcgttttttatgtcgttgtttagtttgcgtttttcgaatttttcgggtatagttcgttgtattggagttttaggagatatcgttcgtagtagcgtacggagcgagggatttttagttcgggtcgggagagtaaagtttcgttggtttgttttggattgttaaaattaataatttttattattcgttggaagggcgcgtagagtcggttatagtcgaagttttcggagttattaaaaggaggcgttgtagttttgtcggcgcgcgggaagttttttttttagcg

SEQ ID NO: 4256 - DNA, 227 bp, synthetic construct
  misc_feature 1..227: note = Description of Artificial Sequence: Synthetic polynucleotide
  source 1..227: mol_type = other DNA
ttaggagcgatggttgtaatgtttttttttttgttttgtttttcggtgtcgggagttttgtttttcgtcgttatttttggttagttttgcgtaagaacgtcgttttgtttggtagttaggtcgagacgtagtttgaatgtgagtaggaattcggagaagggaagggagagaattagaaagaaggttcgggagggattcgggaagtagtgggaggtttgcgttttgga

SEQ ID NO: 4257 - DNA, 323 bp, synthetic construct
  misc_feature 1..323: note = Description of Artificial Sequence: Synthetic polynucleotide
  source 1..323: mol_type = other DNA
tcgtcggaagagttttgtagagtgagtttttagggttatttcgttgttttttttttcgttttcgtagtcgttgtagttagcgtgggagtcgggtaggtcgcgtggggcgttggatttatcgagaggttagcgtcgtcgtcgggggagggcgtgtttcgtacgtgtgtgttcgcgcgtgttcgcgttcgcgtgtgttagcgcgcgtgttttggtcgtgcgcgtcgagtcgggtcgtattaattttttcggcgtcgacgggtttagtttatggtgtgggcgtcgggtttagggaggtttcggttttcgttaatcgcggagtaggg

SEQ ID NO: 4258 - DNA, 279 bp, synthetic construct
  misc_feature 1..279: note = Description of Artificial Sequence: Synthetic polynucleotide
  source 1..279: mol_type = other DNA
ggtacgagcgttagtagttcgtaaaataggtagagtacgtttttcgtgagggttatacgcgttttggtcgggttcggggttacgtaggtggtgtattgcgcgttcgttagggttacgaagagcgtaacgaacgttagtagtacggcgtttacggtgagcgttcgcgtcgtttgtatttcggtgtttagagttagtatcgagtcgtatattttgtattgtatgtgttcggtgttttgtattacgtacgatatttatagttttttttaggtggtttgcgtc

SEQ ID NO: 4259 - DNA, 261 bp, synthetic construct
  misc_feature 1..261: note = Description of Artificial Sequence: Synthetic polynucleotide
  source 1..261: mol_type = other DNA
ttcggcgcgcgtttttcggcgtatacgttttttattttcgcgtcgcgcgggtcgcggatttgtaggttgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttggcggttttcgttagtcgcgatttttatcgacggaga

SEQ ID NO: 4260 - DNA, 364 bp, synthetic construct
  misc_feature 1..364: note = Description of Artificial Sequence: Synthetic polynucleotide
  source 1..364: mol_type = other DNA
gttcgggttttgggcggcgagggcgtagcgagggttgtcgttttttcgggtagtttcggggggcgcggcgttgggtcgcgggttcgggggttgtcgtgttcgatcgtatgcgtcgatttgtcgttgggcgttcgtttttttttgttggggttgggcgcggtttcggagtttggcggcggtggtgagggcgtacggttagttgtagcggcgttgtgtttgtcgtggatttaggatattttaggtttggtggcggggttaggtggcggcggttttttgcgttcgggcgatggcgatagcgataggtttttaatttcgtttcgggttcgggtcggtcgggtttcgcgtcgggttacgcgcgcgtata

SEQ ID NO: 4261 - DNA, 242 bp, synthetic construct
  misc_feature 1..242: note = Description of Artificial Sequence: Synthetic polynucleotide
  source 1..242: mol_type = other DNA
ggcgttttttgagtttagagaagtgggttaagataagggaagaaaattttttatagaagaggagattttcgtttttagtgttggggattttcggtattcgcgtttttgtgtttttggtggtttcggcgttttttcggagcgcgcggtatgtttgtttttatacgtttagtatttttgtttttagagtaaatttattttttagggtatacgtagaggggtagttaggtatcgtttttattttg

SEQ ID NO: 4262 - DNA, 285 bp, synthetic construct
  misc_feature 1..285: note = Description of Artificial Sequence: Synthetic polynucleotide
  source 1..285: mol_type = other DNA
acggtcgttcggggtcgtattttcgttcggtggcggcgttcgaagacgttagtcgcgttacgtattgtttgcgtttcgcgttttagtcgtcgcgtattaacgtcgtcgttttcgtcgggagttaagttcgtcgggtcggttcggttttaggtgggtagttcggtttgtagttggttggaggtggcggtcgttgtagttttggtagcgggtatatttttaagtatacgtatttaacgttttttttttgagttacgaggatggagtagttatttcggttcgggattg

SEQ ID NO: 4263 - DNA, 222 bp, synthetic construct
  misc_feature 1..222: note = Description of Artificial Sequence: Synthetic polynucleotide
  source 1..222: mol_type = other DNA
ggtattgattttttagttttttgtttgttttttcgttttttttttttatttcggatatttttaggataattagggttgaagttttcgggagaagtagtttcgagttcgtgggataagggggcggttcggtttcgtttaggatttttttcggatttttttttcggttgtttcggttggttgtagggcgcgttatttcgcggggaggcggcggtagcggtggcg

SEQ ID NO: 4264 - DNA, 201 bp, synthetic construct
  misc_feature 1..201: note = Description of Artificial Sequence: Synthetic polynucleotide
  source 1..201: mol_type = other DNA
gcggcggcggcggcggcggcgggggttggggcgcgggggtcggattatgagtcgttgagtcgggtaaattttaggttatcgagttagcggattttcggagcgtagttttgcgtcgcggagtaggttttaattaggcggcgaggcggttatacgtatcgagttagcgattttcgggcgacgcgcggggttagggagcgttac

SEQ ID NO: 4265 - DNA, 298 bp, synthetic construct
  misc_feature 1..298: note = Description of Artificial Sequence: Synthetic polynucleotide
  source 1..298: mol_type = other DNA
gggattattttttacggtgttatcgtatttatttcgcgtttttttttcgttttttggagtttatcgggattaggtggcggcgggtgtttttttgggggtgcgcggttatgtaattggtggatttttttaaatcgttttggaggggggagcgcggcgttgggggcgggagagcgtttttggttgtgagttgtttttgtcgtttcgtttcgcgtttttttgtcgtttcgtttcgggtttttcgcgttttttttttcggttcggtcgagcgcgttgtttcgacgtcgttatttagagtcgg

SEQ ID NO: 4266 - DNA, 272 bp, synthetic construct
  misc_feature 1..272: note = Description of Artificial Sequence: Synthetic polynucleotide
  source 1..272: mol_type = other DNA
tgatagggatcgggtttagatttgttaaatgttgcggaggtagaatttgatagtgcgggagggtaggcgtttgggaggtaggagttggtggagatgatagcgtggaattcgtgagttttacgtaacgtttttttgtcgtttagggtgggtttttagaagtatagaaatggtcgggttgcgggatattatagcgaggaattagcggagtataggggttttaggagcgtcgggatatgttaggtcgggtagatagtttcgggtcggagtgagtg

SEQ ID NO: 4267 - DNA, 201 bp, synthetic construct
  misc_feature 1..201: note = Description of Artificial Sequence: Synthetic polynucleotide
  source 1..201: mol_type = other DNA
gagtatgagggagagtgttattttttagttgaaggttattgtgttttgtatttttggtttgggtaagtgaggagtttgttagtttttggtaggaagtgtacgtgatcggcggttggttaggggtatagagacgtattttatatagaaatttaggttggcggggtgggcggtcggggagttagttttgtagatgttattaag

SEQ ID NO: 4268 - DNA, 251 bp, synthetic construct
  misc_feature 1..251: note = Description of Artificial Sequence: Synthetic polynucleotide
  source 1..251: mol_type = other DNA
gtaggttgaaggcggagttggagatattcggggagtaggttcggagcgttttcgaggtcggggtcggcgagggagaggtagggagttcgaggaagggaggcggggcgggtagggatcgagttaggagagagcgggcgggggttttgggagcggttttcgagagtggggtttgtggggagtagggcggtttcggggatagaggaagtcgcggtggaggtttagggtagacgcgggcggacgcgaggagcgta

SEQ ID NO: 4269 - DNA, 249 bp, synthetic construct
  misc_feature 1..249: note = Description of Artificial Sequence: Synthetic polynucleotide
  source 1..249: mol_type = other DNA
attcgttttcggagtttcgttcggcggtatttgttttggttacgcgttttagtttcgttaggtttttcggcgggttcgaattcgtagtcgggaaggtatacgcgagtaggagggcgtattttatggttaggtgcggacgcggcggttgcgggtggttagacgcggtaggcggagcgtacgggcggcgcgtatttttttcgcggtttcggagttcggcgttttaggtgcggttttaggtgagagtcgtcg

SEQ ID NO: 4270 - DNA, 249 bp, synthetic construct
  misc_feature 1..249: note = Description of Artificial Sequence: Synthetic polynucleotide
  source 1..249: mol_type = other DNA
gttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcggggatttgttggtgtttcgagatttattgagttgcgggggttttggagatttttaggtttgaaaagttagttttagaga

SEQ ID NO: 4271 - DNA, 201 bp, synthetic construct
  misc_feature 1..201: note = Description of Artificial Sequence: Synthetic polynucleotide
  source 1..201: mol_type = other DNA
ttgttcgcggcgtcgggcgcgtcggtcgtcgggtggtggtggtggtcggcggcgtggtggtggtggtggtggtagtgcgggttcgcgtcgttttgcgcggcggtcgcggcgattacggcggatattacggcggcggcggggtttattttttcgtcgttgtcgtttaaggaggcgtcggtatcggtttcggtcgtcgcggtt

SEQ ID NO: 4272 - DNA, 201 bp, synthetic construct
  misc_feature 1..201: note = Description of Artificial Sequence: Synthetic polynucleotide
  source 1..201: mol_type = other DNA
acggtatttacggtcggggggttcgggggattcggcgggcggcggacggcgtatattcgcgattcggttcgggagtcgttgttttttttagtttggttttcgtttttacgatttaggggcggttgcgcgttgttttttggcgtcgtatcgggtttaggcgcgcggcggggttggggcgcgcggggcggtcgtttgggttat

SEQ ID NO: 4273 - DNA, 251 bp, synthetic construct
  misc_feature 1..251: note = Description of Artificial Sequence: Synthetic polynucleotide
  source 1..251: mol_type = other DNA
cggcgtcgggtagcgcgtagagttagtcgcgtgtgtagggtcgggtgtcgttgcgtgcgggcgcggggcgcgggttcggggcgggtgtagggcgcgggatcggggtagcgtaggagtaggtaggggttcgcggttcgcgtgggttttaggcgcgggatggcggcgtttagtagcgcgggttcgcgtagggcgcgtagcgttgggggtaatagcgtggggttcggtcggtagtggggcgcgggttgcgcggt

SEQ ID NO: 4274 - DNA, 201 bp, synthetic construct
  misc_feature 1..201: note = Description of Artificial Sequence: Synthetic polynucleotide
  source 1..201: mol_type = other DNA
tacggtggattttgtgggtcgttgagttttttgattttcggtttgttttattttgttttgttagtgggttttgcgttcgcgttaataattcgaatgggtacgtttttgcgttttagaacgttgttcgtttttttatatttagattgaggtggaatttacgttatataaatcgggtcgtaaggtttagtttagcggggtttt

SEQ ID NO: 4275 - DNA, 201 bp, synthetic construct
  misc_feature 1..201: note = Description of Artificial Sequence: Synthetic polynucleotide
  source 1..201: mol_type = other DNA
tggcgcggggcgtaggtgtacgtaggttggtcgcgggcgcgcggggttcggcgggagtttcggggtggttttcgcgtggggtcgggggcgttcgcgcgggcggggcgaggtcggggagggtagttgttcgtttttttcggtattgggagttttcggttggtattgcgggaggagttttcgggtgattcgcgggttttgaaa

SEQ ID NO: 4276 - DNA, 201 bp, synthetic construct
  misc_feature 1..201: note = Description of Artificial Sequence: Synthetic polynucleotide
  source 1..201: mol_type = other DNA
tgaggaattggatattaggcgttggtcgttttttatttttagtcgttgggtgtttagagtttatttttagcgattagagtagaattgtagagaagacgttcgcgttcgggtttcgtttggggagttagggcgcgcggggagcgttcgggtcgcgcggttattgatcgttggttgtacgggggcgtcgtgcggattcggttt

SEQ ID NO: 4277 - DNA, 337 bp, synthetic construct
  misc_feature 1..337: note = Description of Artificial Sequence: Synthetic polynucleotide
  source 1..337: mol_type = other DNA
tttagggttttcgggatcggtgttcgttagtgggtataggacgtcgggtgttcgaagggttgtttggagatgtaattgattttggcgggtattagaatgacgagtggtagtagtaggagcggggtgacgaataagattacgaaggatttgaatttggagatatagtttagcgtcgaggttatcgcgcgggagggagattggcgggcgagacgagtgaggggtagttagaggcgtcgcgggtttaagaaggggttatagttttcggggattggggagggggcggtgataatttcgtttcgtacgggggcgttttttcgcggttttggggcggggttat

SEQ ID NO: 4278 - DNA, 201 bp, synthetic construct
  misc_feature 1..201: note = Description of Artificial Sequence: Synthetic polynucleotide
  source 1..201: mol_type = other DNA
ggttcgtgtagagtcgtttattttttttcgtagcgtcgggttgttttaaattgtttttggattttatttgtgagtcgcgtggttgggttgggttgggttgcgcgggatttgttagcggttttcgttattttgttcgtaggcgtttatcggttgttttttgggtcgtcgttggtcgtcgttatacgtgggacgtcgagggta

SEQ ID NO: 4279 - DNA, 201 bp, synthetic construct
  misc_feature 1..201: note = Description of Artificial Sequence: Synthetic polynucleotide
  source 1..201: mol_type = other DNA
atatggcgtatgatagggaattggtagggttatagtttcggattattcggggtagggtagggaaattacggtagattgcgtagcgtattttgttcgggtgcggtgagggttgcgtttcgtttggttttcgttataatttatagaaagttttcgcggagtattggtgtttttgaatttattaggcgatttcgtcgtaaagaa

SEQ ID NO: 4280 - DNA, 201 bp, synthetic construct
  misc_feature 1..201: note = Description of Artificial Sequence: Synthetic polynucleotide
  source 1..201: mol_type = other DNA
tcgattttgtttcgggtaatcgatgggaaatttttcgagagcgcggtttttttggggattcggcgtttttgacgtttttaggcgttttttcgggtcgttgcggttttttttcgtcgttcgttagcgtttaaggtcgcgttttttttattttcgtttttttttttttttcggcggttttcggatttggatagagttgtagga

SEQ ID NO: 4281 - DNA, 1216 bp, synthetic construct
  misc_feature 1..1216: note = Description of Artificial Sequence: Synthetic polynucleotide
  source 1..1216: mol_type = other DNA
gaagygaagaggggttttttgatttgtaatatagaggaaagygtygttttygtttagtttggtatttaygygtttataygtattyggygtyggtygggtygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtygygggtggtggggggygttgtgtttagtaggggygatagygtaggyggggttttttgtagtttttttttttattttyggtygygtttyggtttttattttg

SEQ ID NO: 4282 - DNA, 365 bp, synthetic construct
  misc_feature 1..365: note = Description of Artificial Sequence: Synthetic polynucleotide
  source 1..365: mol_type = other DNA
ggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtt

SEQ ID NO: 4283 - DNA, 201 bp, synthetic construct
  misc_feature 1..201: note = Description of Artificial Sequence: Synthetic polynucleotide
  source 1..201: mol_type = other DNA
gyggaaagtaaggygygtttatagtygtttttttttttggaagttygygtttatttttgygyggyggtygtttyggaggygtygggttgggygtgaggaygtygtatttattattgggttygygagygtygttagtttagtygttttttttygtaggttygggggtagygtatttygtaggttttataagtygttaygtta

SEQ ID NO: 4284 - DNA, 201 bp, synthetic construct
  misc_feature 1..201: note = Description of Artificial Sequence: Synthetic polynucleotide
  source 1..201: mol_type = other DNA
gygttggttgggtagtttttgggagatgaagygaygtaggygttttaggtattggttgtagagttygatgtygttgtgttyggygttttttatttatagyggttttatygttttggggtagygttygtagagygttagttygtgygagaagtygattatttygtttttygtgtygtggatgatgagtaygggygaygtgat

SEQ ID NO: 4285 - DNA, 201 bp, synthetic construct
  misc_feature 1..201: note = Description of Artificial Sequence: Synthetic polynucleotide
  source 1..201: mol_type = other DNA
tygttttggtygaagygtagttygagygtygygaygygttttaygygtaggaagtygtyggggtygyggtygtatatttygaatatttygygtaggyggygtayggagygtagtagagtygygggggygttygattagttygygtygttygttattygggtyggttygtagtttagttyggatttttygttygtygygttc

SEQ ID NO: 4286 - DNA, 201 bp, synthetic construct
  misc_feature 1..201: note = Description of Artificial Sequence: Synthetic polynucleotide
  source 1..201: mol_type = other DNA
ygtttygygttatgtatatttattgtggtgatgagagttygygtttygtgttygttayggttattgtgygtttaataaaaataaatattgtygaggagtygtygygatgyggggyggaygygyggttyggaaaggggagggggttttaggaagagttatattygygagtygggtttgggttaggggygaggggagagygtt

SEQ ID NO: 4287 - DNA, 201 bp, synthetic construct
  misc_feature 1..201: note = Description of Artificial Sequence: Synthetic polynucleotide
  source 1..201: mol_type = other DNA
gtggttttttggtttttttaggtagttaatattataattttttttgggagggggttygtagaagggygygygttgtttttttygttttttaagttgtagyggggygggtygggagttagggttagggtttggagatttgggaggggatyggtgttagaagygaagagttagggttagaaagttaggttaattaaggggggg

SEQ ID NO: 4288 - DNA, 201 bp, synthetic construct
  misc_feature 1..201: note = Description of Artificial Sequence: Synthetic polynucleotide
  source 1..201: mol_type = other DNA
ggagaagggggttygtgtaaattttaggttgaygatygygtaygygtttttygggttattagttttgtygtttttggtggggtatatygaggagatygtygtggggaatyggggatyggattgtttgatagtygagygttgaagattattttttttgagtttagggaggtttggttgttttgagttttttatttttgggtt

SEQ ID NO: 4289 - DNA, 213 bp, synthetic construct
  misc_feature 1..213: note = Description of Artificial Sequence: Synthetic polynucleotide
  source 1..213: mol_type = other DNA
ttttgyggttggttaggaggagtttttygtygtttttattttagtygygtygggygttgggttygatttttagtatttttggtattgatgtgtttggtgygygttgagaygygaaygttttgtaagatgagtttttatttattygtttttttttttttttatttgtttattttataaattgagtgtttggttattttggtttaggtaagaggt

SEQ ID NO: 4290 - DNA, 201 bp, synthetic construct
  misc_feature 1..201: note = Description of Artificial Sequence: Synthetic polynucleotide
  source 1..201: mol_type = other DNA
gtttagyggtttgtatygagagttaggagaggtttagatyggatttygatttttygaggygygggagtttayggagygyggtgggygyggygttygggtygygtagttaggtggggagyggygygtagttttagattygtaggtaggtagyggyggattgtatttgtttygtttygtagygttttttgtttgtygtttttc

SEQ ID NO: 4291 - DNA, 201 bp, synthetic construct
  misc_feature 1..201: note = Description of Artificial Sequence: Synthetic polynucleotide
  source 1..201: mol_type = other DNA
gygttygaggtyggygyggtggggatygygggtttattattagttaagtttagttatttaattatttgtagagttgttgtaggtataggtttaggttttygttttttattttttygygggtgatgygttttgatagyggtygygggagygggggtaaaggyggtagttggggyggyggyggyggtayggtygagtgtttyg

SEQ ID NO: 4292 - DNA, 201 bp, synthetic construct
  misc_feature 1..201: note = Description of Artificial Sequence: Synthetic polynucleotide
  source 1..201: mol_type = other DNA
tygtaaggggtattyggttttgtgygygggggyggygggggttttgygyggggtygggttgggtygggttgagttggttygtttyggygtyggggattaygygygattggttagattttgtygtgatttttggaaaattgtgattattttatatgttttgtttagttyggattttttgygttaaygagttaggtttttttt

SEQ ID NO: 4293 - DNA, 324 bp, synthetic construct
  misc_feature 1..324: note = Description of Artificial Sequence: Synthetic polynucleotide
  source 1..324: mol_type = other DNA
yggggttygggttgggatygyggggtgggyggtttygagagygtttygtagtggttggagttttgggygttgtaaagygtgtttygtygggttttygagygtttygygttttygtttygttatgtttttgttgttggggttgtgtttggggttgtttttgtgtgtggggtygtaggaagaggygtagagttggggttatttttyggagtaggtaagtggagtygaggggagtygggtttygggygyggtygttttttttttttygtyggttyggtygyggagtttttgttygggtttttttygatygttttttaggtttttatt

SEQ ID NO: 4294 - DNA, 201 bp, synthetic construct
  misc_feature 1..201: note = Description of Artificial Sequence: Synthetic polynucleotide
  source 1..201: mol_type = other DNA
gagggggyggttggaggattyggatttttaagaatttggttttgggttttgattygggyggtyggagagaaggygaagaagaggtygagtagataggygygyggyggaygygagagaaggaygygggygaagygtttaagaygttygtttttagggtygtygagttttttttttttttygtttggygyggtagtatygygg

SEQ ID NO: 4295 - DNA, 330 bp, synthetic construct
  misc_feature 1..330: note = Description of Artificial Sequence: Synthetic polynucleotide
  source 1..330: mol_type = other DNA
agtttagtttagttaagtagtagagagaataggayggaggtttttattttttagggattgtagygtttttaaatygtttatttgygayggtttygygagygtgygtagtttagtttttttyggaygttttygttttygttygggtatatygtgtttygtatygaggtagagaggggtaygyggattttagtttttgygagtttttttgttygtygttattttatatttygtattgttttagttgtygttttagaagatgtatygtttggygygtaaagyggtgtayggtttttagttygygygtagtagtttggaggggygttagagttt

SEQ ID NO: 4296 - DNA, 293 bp, synthetic construct
  misc_feature 1..293: note = Description of Artificial Sequence: Synthetic polynucleotide
  source 1..293: mol_type = other DNA
gygttttagttygtggygttgtyggygtagatttygygtggggatyggygaggttaattttttttgyggttyggggtyggtagagtaygtaaggggtygygggtygygtgggtttgggygygtygtggtgggtaagyggggttagyggagygggaattygtatatttttygagyggagtygaggataggttygtgygggtygyggggtttttttggygttaggaagyggyggtygaaggagataaygagaaygtagtttyggtttagggaggtttaaaagttgagatgttgaa

SEQ ID NO: 4297 - DNA, 201 bp, synthetic construct
  misc_feature 1..201: note = Description of Artificial Sequence: Synthetic polynucleotide
  source 1..201: mol_type = other DNA
atygtyggygtyggtagttagagygggatttagtttttatygygttttttattggagtttttttyggtttttyggygagtgyggttygtggggagtgggygtyggygygaggaagtttttyggttygggygatttyggtttttgagyggtttttttttaygtygtygttygttaggtygayggaggatyggggyggggayg

SEQ ID NO: 4298 - DNA, 201 bp, synthetic construct
  misc_feature 1..201: note = Description of Artificial Sequence: Synthetic polynucleotide
  source 1..201: mol_type = other DNA
yggygttttaygttttttttttggagtaaattygtttygttttttttttggagtaaattygtygtattttygtttgtatygaaattttgagygtygtttygygttatttttagttygygttygygttgttttttttttygggtygtaggttgagaggttgggtygtattttggttaygttttgttyggttttagygggata

SEQ ID NO: 4299 - DNA, 226 bp, synthetic construct
  misc_feature 1..226: note = Description of Artificial Sequence: Synthetic polynucleotide
  source 1..226: mol_type = other DNA
tyggggttgttagggygtygggttygtgygyggatattgggggygtattyggttttygggttaggygyggttggagatttygaggttggggttttgaagygygtaagtatttttttttttatygygtttttgtaagtagtttgaagttttaagtygttgtttayggattttygtttttaattttttaattgaaaaaatttgtygaggagagtggaggtatygttat

SEQ ID NO: 4300 - DNA, 363 bp, synthetic construct
  misc_feature 1..363: note = Description of Artificial Sequence: Synthetic polynucleotide
  source 1..363: mol_type = other DNA
tattygggygygggagtaygggygggtygggggygtttgggtyggtttgtygtggttygggggttyggggyggygygatttatttggygttttyggggtygygatttttttygggaggtgtttgygaaggyggttttgtygyggtgggggtggggaggttagggtttyggatygttggagttggggtygtagttagtttttggygagtgttttttggttgttgtygtaggggtttgttttttyggattttttttttaatttygtyggatttttttttttttttttttaygttygttaagtttatggtttttgtaatgyggtgggtgtggttatttagtaaattgtaattgtggttttttgtaa

SEQ ID NO: 4301 - DNA, 201 bp, synthetic construct
  misc_feature 1..201: note = Description of Artificial Sequence: Synthetic polynucleotide
  source 1..201: mol_type = other DNA
tttttyggagtgggggattgygagggggtttyggttttaygaggtgyggaggaagagttygaggtttggggygaggygygygggatagtggggttgaygygtggtttyggygtygygyggtttttygaatttygagtttygygttyggygyggtyggggtttttaatygttttttygttygtygggatttttatygggtyg

SEQ ID NO: 4302 - DNA, 201 bp, synthetic construct
  misc_feature 1..201: note = Description of Artificial Sequence: Synthetic polynucleotide
  source 1..201: mol_type = other DNA
ttygttyggygttgtattttttygtggttyggttgtaaggatttgyggtggaggtttggyggaggygggttygygttttagagagagygttaygttattygagaaggygaygttgggggttgttgagttttttaattttttttggygygttttgtttagaagtyggggagtttttggtyggyggttggyggggaagygygg

SEQ ID NO: 4303 - DNA, 267 bp, synthetic construct
  misc_feature 1..267: note = Description of Artificial Sequence: Synthetic polynucleotide
  source 1..267: mol_type = other DNA
ggtgagttattgggatttygttgttagggagtaagttggtaggtaggaagtagttaagatttgggggaattttttttagggaaygaatatagagaaggaygtatttgaaaatttygtygtagttattttttttttatgggaaagtttygatttyggygggtttagygttattyggtttttyggggtgtggaatattgagygaggtaggtgyggygggagtatgygygyggggygggtagggggyggttttygygtttttatttygyg

SEQ ID NO: 4304 - DNA, 707 bp, synthetic construct
  misc_feature 1..707: note = Description of Artificial Sequence: Synthetic polynucleotide
  source 1..707: mol_type = other DNA
agggaatggggagggttaygtatattttgtgyggttygagtggttyggatggtatagtttaggtgttygggttaaagttggtatttttaaagtttagaaygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtygtygttttgtttgygttgtygttttygttygtyggtygggtttaattggtttttagygtygyggygttagttygtttttttgtagtygtygaygttatygt

SEQ ID NO: 4305 - DNA, 201 bp, synthetic construct
  misc_feature 1..201: note = Description of Artificial Sequence: Synthetic polynucleotide
  source 1..201: mol_type = other DNA
tggtgttgagtgygggtygggtygtttttyggyggyggtgggtgggygygygagggyggagggggtygggagttttggtttygaggtagygaggagagaygggtaaatagtagagygttaagttaagtttttaaagtgttaatagttgtagaagttygaattttagyggttttaggggygygggtatagggttttgggttt

SEQ ID NO: 4306 - DNA, 201 bp, synthetic construct
  misc_feature 1..201: note = Description of Artificial Sequence: Synthetic polynucleotide
  source 1..201: mol_type = other DNA
gttgttyggggttgttgtataagtyggtgatattgttttgygggtttayggtttgtgagygttgygtggagttggggttygygyggttaygggygygggygygggygygggygygtgaaygtagtgttgagtygtttgttggagaggtttttttyggtygagtgttygttgygtaggttggagggttaggygyggagtttg

SEQ ID NO: 4307 - DNA, 201 bp, synthetic construct
  misc_feature 1..201: note = Description of Artificial Sequence: Synthetic polynucleotide
  source 1..201: mol_type = other DNA
agttagygyggttttygggtttttgygtttatggygagggtygygggggaatagtttttggtaggtaatttgtygggtatttatttgagtttttygtatygyggttygaaaatttgggagygttttaggataaagggttagttttttggaattagtygtgtgtgattagtgtgtgttagttygtatgtgggggttttagtg

SEQ ID NO: 4308 - DNA, 201 bp, synthetic construct
  misc_feature 1..201: note = Description of Artificial Sequence: Synthetic polynucleotide
  source 1..201: mol_type = other DNA
gttgygtaggtatygggtttygttygggygtyggggtagggttgtyggggttagtaggtttttygygttttttttggyggggttttaggggttggattgygggttttttttgtttttttttyggggtygagtaagttygyggggggtgtttttaggtagtaggagggtgaggtaggataatttttaggttttgtagttttt

SEQ ID NO: 4309 - DNA, 203 bp, synthetic construct
  misc_feature 1..203: note = Description of Artificial Sequence: Synthetic polynucleotide
  source 1..203: mol_type = other DNA
atttttaaagaatgataaaataaagaagygtaygttaggtttttaaggagatatygtttttttttttttattattttttatttttattagattttttatygyggattaaagatgaatttgttattaattaagtttttgtttaagttattttatttttygtagtttttttatttgtyggggyggtgttyggygtattttaggtt

SEQ ID NO: 4310 - DNA, 201 bp, synthetic construct
  misc_feature 1..201: note = Description of Artificial Sequence: Synthetic polynucleotide
  source 1..201: mol_type = other DNA
tgatygggygtygaaaygtygggagtygggggttaagggttygagttaggaggtttyggagtagtagtygttygttttttaygtygtygtygtygttttygyggttgtttggataygggataatygatttggggtttygatygtagtagagtyggaggggtgggtaggygygggttygggagaygygyggggaaaygygyg

SEQ ID NO: 4311 - DNA, 201 bp, synthetic construct
  misc_feature 1..201: note = Description of Artificial Sequence: Synthetic polynucleotide
  source 1..201: mol_type = other DNA
ttattttaaagyggtagygtatttttagagttggttttttttttygtttygggttttyggatyggttgtaggagttttttttttygggtygggyggyggygtttggygttttygggttgggttattgttttatgtttttttttgggygtttggygygtgttttatygtygttatygygtttaaaggttaggttggaagttc

SEQ ID NO: 4312 - DNA, 208 bp, synthetic construct
  misc_feature 1..208: note = Description of Artificial Sequence: Synthetic polynucleotide
  source 1..208: mol_type = other DNA
gggggygttttattgattttttttggygtttgtttttttttttaggttgygttttttttatttattgygagygtgagttagygttgaaggtttagagygygttgtaygagtagaagattttgttyggggtaagtggygttygtygtggygtaagyggtygaygygtygatagggggygatttygggaggtygggyggyggygyggygc

SEQ ID NO: 4313 - DNA, 201 bp, synthetic construct
  misc_feature 1..201: note = Description of Artificial Sequence: Synthetic polynucleotide
  source 1..201: mol_type = other DNA
tattgatgaatgygygttyggattttygggyggattttttttaagtyggttygtttttttagtttaaataaataaataaagttagatggaagaaaaaagygtttattttattttygtygtygtttygttygttatttttgtttttgtttygttygtttggygttttaatagagtatagtttggtggataaagtttttttat

SEQ ID NO: 4314 - DNA, 201 bp, synthetic construct
  misc_feature 1..201: note = Description of Artificial Sequence: Synthetic polynucleotide
  source 1..201: mol_type = other DNA
gaaaggaaaaagygatatttttgtttygtatagagttaaatattggaagtaygagatagtygaygtggattaggattattttggtttttygtgyggyggyggyggyggyggttgygygygggttttttgtggygyggttttggggygygggygygggyggyggyggggttgygggagtygtyggggygggaggyggagygc

SEQ ID NO: 4315 - DNA, 595 bp, synthetic construct
  misc_feature 1..595: note = Description of Artificial Sequence: Synthetic polynucleotide
  source 1..595: mol_type = other DNA
tttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttggtttaygagtttaagatggatgygtttattatttyggtgattatggaggtgtygtgygatagtyggggttaaygtatgtggtgggtttttttggtttttt

SEQ ID NO: 4316 - DNA, 201 bp, synthetic construct
  misc_feature 1..201: note = Description of Artificial Sequence: Synthetic polynucleotide
  source 1..201: mol_type = other DNA
tttttttttttygtttttttttttttttggagaagagagttggtgttaagagttagggattttggttgtgtgtttgyggatttgtagtggyggyggyggyggyggyggyggggaggtagtaggygygggagygggygtaggagtaggyggyggyggtggyggyggyggttagatatgaaygtygtttyggygtyggyggtg

SEQ ID NO: 4317 - DNA, 269 bp, synthetic construct
  misc_feature 1..269: note = Description of Artificial Sequence: Synthetic polynucleotide
  source 1..269: mol_type = other DNA
tttatygatygtattatttgatygygggaaaygaaatttgagtttaggaatttgaattgttttaygtaygttygttttyggataaattttttagaggatygtgatttttttatttagagattatttagggagatgttttggatgggataagtagataaatggyggttygaggaaaatgtaggaaattttatattgtagaygtttaagtattaattgtttgggtttyggggtagggaaygggagatattatttatyggaaatattatatt

SEQ ID NO: 4318 - DNA, 201 bp, synthetic construct
  misc_feature 1..201: note = Description of Artificial Sequence: Synthetic polynucleotide
  source 1..201: mol_type = other DNA
ygyggtygygaggyggggttggagggygttgygggttgygyggaggttgygggaagygyggggagtaygyggagttygattagtagggagatygygtygygtygggtataggtaygggattygygttttaggagggygtagygagaggygtattgygtatttaggggttgyggtttyggtygtygtgyggtgataagttga

SEQ ID NO: 4319 - DNA, 267 bp, synthetic construct
  misc_feature 1..267: note = Description of Artificial Sequence: Synthetic polynucleotide
  source 1..267: mol_type = other DNA
tgaaatttagaggaaaataaaaatgtagyggtttttayggaggtttttggtttgtaggatatttgagggtggagataaggatgtygyggagggaggattygggagttyggtygygttttttagtttyggtattygygtttagygygtygygtttygygtttttygygygtggtygtttttygygggtygggtyggggttgygttgttatttagyggtygygygtttagygtygygttatygtttttgtaggtygtyggggtttttgt

SEQ ID NO: 4320 - DNA, 287 bp, synthetic construct
  misc_feature 1..287: note = Description of Artificial Sequence: Synthetic polynucleotide
  source 1..287: mol_type = other DNA
ggtttagatttygygagtttygggtttygtttattyggtyggyggttttttyggggyggagygyggygtttttggagtyggtatttyggatttyggygtygtttygygtatygttttygttttagtttttagtggygyggygttttttygygatattygygggtttttaggagygagtygattttyggttgggtttggagtyggggttaagtttattyggagggagtayggagtttatttagttgtttttgggggtaggaggtttaggttttattttgtatatygtt

SEQ ID NO: 4321 - DNA, 201 bp, synthetic construct
  misc_feature 1..201: note = Description of Artificial Sequence: Synthetic polynucleotide
  source 1..201: mol_type = other DNA
ygatttggtattagygyggaggttattttgygtagtygggtaggtayggyggtttttaggtattttygtagtagttttagtttttggttygyggygtygygagggygagaattygtgggygtyggttttttttttygtygtyggtgttttgtaaagtggaggtyggygttttyggygttttygtygygttyggggtaggtc

SEQ ID NO: 4322 - DNA, 201 bp, synthetic construct
  misc_feature 1..201: note = Description of Artificial Sequence: Synthetic polynucleotide
  source 1..201: mol_type = other DNA
yggaggtttaygttgagttygygtagygygtayggttygtyggyggyggtggttttygygttgygttgtgttygattyggttygygyggatttygttygygttattttaygygtaggttttgtagygtttttaggagtagtagygttygtaggggatygtygaggtygtyggggttatttgggtagagygygagtaggygc

SEQ ID NO: 4323 - DNA, 286 bp, synthetic construct
  misc_feature 1..286: note = Description of Artificial Sequence: Synthetic polynucleotide
  source 1..286: mol_type = other DNA
gygygggaggygtygggggtygyggaggyggggyggggaggggtyggyggyggyggyggygygyggaggagatygtagtgyggtyggygttaggattygygggggttttttaggtygyggygtttttygtttttttttatttttygattttttttygtttttaaaatgaggaaayggagtaattygttttaagttgtgtagtygggatygtttyggggtgtgtagtyggttygyggaggtttttttgggggygggygyggggygyggttygggggygttttttgag

SEQ ID NO: 4324 - DNA, 244 bp, synthetic construct
  misc_feature 1..244: note = Description of Artificial Sequence: Synthetic polynucleotide
  source 1..244: mol_type = other DNA
aatgtttagtattatttaaaaagaaaattatatatattagttaatgatatattttaatttttaataaagttggtatttttttttgattatagattttgtygtggtaaattygggtttygaygatagaggtagygtagaagttygtttttaaatgagataattttattaaaattataattttttgtatttttatagygtttttttagtggyggagattttaggtgttttaygttagggtttatta

SEQ ID NO: 4325 - DNA, 201 bp, synthetic construct
  misc_feature 1..201: note = Description of Artificial Sequence: Synthetic polynucleotide
  source 1..201: mol_type = other DNA
gttttaattttttttygagatttygggyggyggggattttttttygggtggttgygtgygygtttagtaattyggtgggtggaggtttggagtttygttygyggtygttttygttgattttttagtgtttttgtttgttttttagagtttaggtagttagtttttygttaggaaggtagagtagygagattttyggtttac

SEQ ID NO: 4326 - DNA, 372 bp, synthetic construct
  misc_feature 1..372: note = Description of Artificial Sequence: Synthetic polynucleotide
  source 1..372: mol_type = other DNA
ggattygtygtttaggttygygtggggatygtagggaattygygttaygtygggggttattgtttatygygaggtgttgaagtggtttygtgatygtygygggtygtggttgatatygyggagaagttaggatttttatagtttttgttagatttgaaagtaagttggaaatygatagttgttttagttgttttagattttaatttggtttgggttttttttttttttatttgaaaatagatttagggtaatgtttaagagaattttaatygayggaagtggtygggaaattttgttttyggtattgagggatgttatyggagatttttttgttttaggtttgtyggagtttattatattygttaatgttat

SEQ ID NO: 4327 - DNA, 201 bp, synthetic construct
  misc_feature 1..201: note = Description of Artificial Sequence: Synthetic polynucleotide
  source 1..201: mol_type = other DNA
aattttttygtgttttttgtataatttgggagagaygtagygttgtgggtgtagagttgtttagagagggttttaggttagggtagggaagagataggaygtygyggggttyggttgtyggygttgttgttattttatggttgaaggggattgaggtygaattgggtaaggagaagtyggtygtagattgtggagttgatt

SEQ ID NO: 4328 - DNA, 247 bp, synthetic construct
  misc_feature 1..247: note = Description of Artificial Sequence: Synthetic polynucleotide
  source 1..247: mol_type = other DNA
ggggtaggattttagaagttatttaattagggaygttgggttggaaatygtttaattaggtayggggtaggagaggatagggyggttttygggatgtggyggggtttttgtttttggttgtagttggagttttgygtttygttttygtttttttgtgttttttgttgttagaggtttagtttttgtggttttgtgatttgygggtattgggggatttatagttaagaygttaggatttttyggaagt

SEQ ID NO: 4329 - DNA, 201 bp, synthetic construct
  misc_feature 1..201: note = Description of Artificial Sequence: Synthetic polynucleotide
  source 1..201: mol_type = other DNA
tygttttttttttygggatgtyggatyggtatttttattatttttaggtttttagggggttttggygttttagttgtggattttttaatattygtaggtygtagggttatataggttgggtttttaygtgtagaggatataaagtagatagaygaaaattggagtttyggyggtagygagaaataaaggtygygttaaatt

SEQ ID NO: 4330 - DNA, 201 bp, synthetic construct
  misc_feature 1..201: note = Description of Artificial Sequence: Synthetic polynucleotide
  source 1..201: mol_type = other DNA
ggattttgagttggggatygtttaattaggtaygtaattggagyggatagggyggttttygggatttggyggggtttttgtttttygttgtagttggagygtttggtttygttttttttgttttgtgttttttgtttttagaggtttagtttttgtggttttttgatttgtaagtattgggagatttatagttaagaygtt

SEQ ID NO: 4331 - DNA, 235 bp, synthetic construct
  misc_feature 1..235: note = Description of Artificial Sequence: Synthetic polynucleotide
  source 1..235: mol_type = other DNA
atttygttttttgtaagtttgtaatatttygtatttagattygtaatttaggyggaggataaagggttgtagyggagggygtagagtagatgtttagggyggggtagagggggygggaagttggygttayggtygyggygagggygagtagtygygygttttyggtgttaggaggaatgttygtagagyggaggttggtaggygygagaggttttaagygygtagttygattaag

SEQ ID NO: 4332 - DNA, 201 bp, synthetic construct
  misc_feature 1..201: note = Description of Artificial Sequence: Synthetic polynucleotide
  source 1..201: mol_type = other DNA
gyggtatttygttttyggttttgygygtttatttyggggygygtygaggttatygtagggtatttatttggtatttgtttttgagtgtgtagatygtygyggtttttatttgggtttttaaataagttttagggagaaagaaggaggtaaaaaaaaaaaatttaattatgtaaatggatttyggattgggaggygygggat

SEQ ID NO: 4333 - DNA, 201 bp, synthetic construct
  misc_feature 1..201: note = Description of Artificial Sequence: Synthetic polynucleotide
  source 1..201: mol_type = other DNA
gtygygttaaygaaygtaggyggygggaggttyggyggyggggttygygtttttgtatygygatygygttagaaaatatttyggggttgggyggygtttyggagaygtatttttttgttatttttatygtttttggtaaygattattaatgttattatgttttatttttttttattttttttygtttttagagtygygttc

SEQ ID NO: 4334 - DNA, 201 bp, synthetic construct
  misc_feature 1..201: note = Description of Artificial Sequence: Synthetic polynucleotide
  source 1..201: mol_type = other DNA
aaagagggagaaagagattaaaaaaagaaaaagataaggggagggggaaggaaggaaggagagaaggaggaagaagtttggggtttgttgttttaggagygtttaggtagtyggtgttggagygyggggygttygttttygtygggattgtyggtttyggggtttgygagagygttagagttttagtyggygygttygggc

SEQ ID NO: 4335 - DNA, 201 bp, synthetic construct
  misc_feature 1..201: note = Description of Artificial Sequence: Synthetic polynucleotide
  source 1..201: mol_type = other DNA
gtttttgygygyggaaaggygttggaggyggttttatagtyggggaggttagyggyggygtatttgtattttgggagaygtttggatttagtttaagttygtaggttgggygagyggagatttttgattttatygtgtgggtgagattattgtttttyggtttaaaagaaaagaaagtatgttgtgaatttttgaaataaa

SEQ ID NO: 4336 - DNA, 201 bp, synthetic construct
  misc_feature 1..201: note = Description of Artificial Sequence: Synthetic polynucleotide
  source 1..201: mol_type = other DNA
tggaatttayggygtttygttygtttygygtttaggaatattgtgygtttagygtagatgygtttttaygattttttgtttggttyggggttatgtggtygygtatyggtttttgaagtttttatttgattgttggggaaggygtttagaattaggagygggttggttggggattggttttygygttgggtygtttygttt

SEQ ID NO: 4337 - DNA, 296 bp, synthetic construct
  misc_feature 1..296: note = Description of Artificial Sequence: Synthetic polynucleotide
  source 1..296: mol_type = other DNA
tygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggta

SEQ ID NO: 4338 - DNA, 201 bp, synthetic construct
  misc_feature 1..201: note = Description of Artificial Sequence: Synthetic polynucleotide
  source 1..201: mol_type = other DNA
gtyggtygagtttygggagtygaggttggaaaygttggagygggygttgtttatygaaggyggttygggatygggaygygggttygagygatyggagygygggttgtygtggygttggtygtagtttaggttgatgtygttggatygggygttgtygttatygtygtygtygtyggatttygttaggttggttygtgggtt

SEQ ID NO: 4339 - DNA, 201 bp, synthetic construct
  misc_feature 1..201: note = Description of Artificial Sequence: Synthetic polynucleotide
  source 1..201: mol_type = other DNA
attygttattgtgtatttggaygttatttgtagatttagygtttgyggggatttyggaaaygggagagygggttttyggaaayggtgattaatgggaaaygtgattagatgttattaggygaatagttygtttttaggtaatatagaaggaagagaygtttttagttattttaaaatagayggagtttttagttaatggat

SEQ ID NO: 4340 - DNA, 266 bp, synthetic construct
  misc_feature 1..266: note = Description of Artificial Sequence: Synthetic polynucleotide
  source 1..266: mol_type = other DNA
ggaaatygttagttttgagygtyggattttttgtgttgggtgggagtgggggttygyggttttggtgttttaatttttggaggaggaygtygggyggggygatgtttgtgtttgtggttttttgaggtagtgggagtggygtgtgaaggattgtgagagtttggygtgaagtgattgttatttgttagatattygtttggttgagtgtggtttygggatygtgttygtaagyggatttygtggaggygtttttttttttatttttt

SEQ ID NO: 4341 - DNA, 201 bp, synthetic construct
  misc_feature 1..201: note = Description of Artificial Sequence: Synthetic polynucleotide
  source 1..201: mol_type = other DNA
taaagaagtygygggtatyggtttaataaggtgtagygaatagtygttygttttygttttaatttatagttttatattttayggtgttattgattttttygtatttagttatataggaygtggataggtatayggggtgatagtttygtattgaayggtattaatttttattygtatyggagttatatagatggtttgyga

SEQ ID NO: 4342 - DNA, 228 bp, synthetic construct
  misc_feature 1..228: note = Description of Artificial Sequence: Synthetic polynucleotide
  source 1..228: mol_type = other DNA
aggataygttggatagtttygaaaagatatagtgggtggtttygggygtgggtaatygggtgyggaattatagygtattyggagttgygaatttagaygygggtgattgttgattttttgttttgtygtttttatttgtgtatgtaggtggyggttagttggggttagggaagygtggagggtgggttttaatygagttaagaaaagtttggggtgttttgaattttg

SEQ ID NO: 4343 - DNA, 248 bp, synthetic construct
  misc_feature 1..248: note = Description of Artificial Sequence: Synthetic polynucleotide
  source 1..248: mol_type = other DNA
tygggattgagtttttgtagttttgaggtttggaggttygggyggtagtaattgtgtyggattaggttygtgggtgyggtttgtggtgtagttggagatygaggtttygygtattttygttygygttttagttatttaggttyggtygtagygaaaaggtttaagagggaagttagaggtgaaygttttaggatgaaggttttttgtaaaaygttgggatttagatttggggtgggtgtttggggttt

SEQ ID NO: 4344 - DNA, 387 bp, synthetic construct
  misc_feature 1..387: note = Description of Artificial Sequence: Synthetic polynucleotide
  source 1..387: mol_type = other DNA
aagtygaggtgttggaggaygtgttgygggagtagttygggtygttgttttagttggtygttgtttgtyggtttaagyggttgttttygggyggttattygtttattgaaaatttttagttggtgttggagyggyggygtgtggttaaygttaaggagygtgagygggtgagggatttttagggtygaygttygttttttttttttttgttttattattaaatatttggttaatattygggggttygtttatygtttattttygttygaggygatttygagttttygaggttttttaygtttttagtttgttaggagaatggtagtggttttttttttttgtattttygtgtagttgttygttggyggtygttgyggtggtygtttc

SEQ ID NO: 4345 - DNA, 203 bp, synthetic construct
  misc_feature 1..203: note = Description of Artificial Sequence: Synthetic polynucleotide
  source 1..203: mol_type = other DNA
ygatttaggttttttagttttygtttagtttttygygtgygggygtygggatygtagtatttgtgaygtygaagtttagtaggtygtagaygggagttaygygyggttttggtatagggtaaaaatttaygtttaggtaggygggtagttaygatgtygggtaagtttagggtagattttyggtggygtatagggaagtagyg

SEQ ID NO: 4346 - DNA, 203 bp, synthetic construct
  misc_feature 1..203: note = Description of Artificial Sequence: Synthetic polynucleotide
  source 1..203: mol_type = other DNA
tgygaataagattaaggygaggtgaggtttaggttttygggattgatagygtygyggtagggggttygaggygggagttggggattttagygttttttaygygygttttaygggggttgtygttaataaaggyggagggtaagggtgygtttatttaagtaagggggayggtgggtygttygggttgagtagyggagygtagc

SEQ ID NO: 4347 - DNA, 312 bp, synthetic construct
  misc_feature 1..312: note = Description of Artificial Sequence: Synthetic polynucleotide
  source 1..312: mol_type = other DNA
ggtttaggaggagtygygtygggttyggttataagaggtyggttagtaggygtttygttagtattygttygatttyggttyggagtatygggygtttagygygggtgaaggyggagtygtagggttggtttttaaagggatgttttygttygagyggygagattagtttygttygtttttygtygyggtygygtygtagtygtttayggtygtygatatggttttttattgyggygataatttyggagtgtattygtagttyggtttgttttygttygtygttatygtygtygtttygggygttttttyggt

SEQ ID NO: 4348 - DNA, 407 bp, synthetic construct
  misc_feature 1..407: note = Description of Artificial Sequence: Synthetic polynucleotide
  source 1..407: mol_type = other DNA
tttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaag

SEQ ID NO: 4349 - DNA, 295 bp, synthetic construct
  misc_feature 1..295: note = Description of Artificial Sequence: Synthetic polynucleotide
  source 1..295: mol_type = other DNA
attttgggtygygggagaagtgygtgtagttygggtaaggtygggyggggtygggygygggygggyggtygagggatgygatagggtygggtayggtttygtattttttygtattyggygtygtygtttygtygttttttttygtttgtagggtygtttygggtattttagggttgttgaggggygggygggtygtaaaagttaygagagaggggyggtagggyggygyggtttgygagygtygygggatttygaggagyggygyggggagtataggggygygyggggygggygc

SEQ ID NO: 4350 - DNA, 435 bp, synthetic construct
  misc_feature 1..435: note = Description of Artificial Sequence: Synthetic polynucleotide
  source 1..435: mol_type = other DNA
ataattttggttttatatattttatatgtttygtataaagaaatagaaagygggygataygttttgggagggygggttggyggtttttttagttyggagygygtggaggttgygygtaggggttygggaygygggatagggatttygygtagtttaggygtyggggaatyggggttggagtyggggatttgagtttagyggaygtttttttygtttggaggttyggtayggatygggatattagggygttygtggtygtggttyggtttttggttgttgygggtygyggtttttagtgggtttttaggatttttttttayggygggtatttatygaggttgagaggttaygtygtgttgttggggtttttygtygattatatttttgggygttagttygggtagagatygyggggattggttaggtygggttagg

SEQ ID NO: 4351 - DNA, 410 bp, synthetic construct
  misc_feature 1..410: note = Description of Artificial Sequence: Synthetic polynucleotide
  source 1..410: mol_type = other DNA
tggttgtgttagtygatatgagtttttttttttttaggaaggygtaggattyggggaagttttygyggttaggtygtttgtttattygtagatttygggygtygttygygttttttgttttttattttttaatttttgygtggttttagggtttatatttttggagtttttttttttagtaaatagtgttgttttttatttaatagtagaggygtttaggagtttaggygatgtgtttaaggtygaatagagggatagtagtgagttgtttaatttttttagttgygtagttaggatayggttgggggygggtggagatgtggygtagggttagggttygggtttygggaagtaatgatygagggyggtgattattgtttttagtttttyggygggtttttttttaaggg

SEQ ID NO: 4352 - DNA, 392 bp, synthetic construct
  misc_feature 1..392: note = Description of Artificial Sequence: Synthetic polynucleotide
  source 1..392: mol_type = other DNA
tggaagtattygttttatygyggggtttggtatttaggttttgggatttttgttattgttaaggattttttyggggattygagttttygggttgaggatygygggggattttaggtygggayggagttttttttggttygttgtgygygtaygtttggaaaggygggatttaaggtagygatgttgygggaggttttgtagtgttaaygagttttygaayggtttygttttattttttttttgtgtgtttygtaagtttttgtttagtaaatygttatagtttyggygygygagagtggygttggtaygtttaaatttyggggtttttggttaggttaggggggygggygtgyggyggggtygggtygggtygggtgygtttagygggtttc

SEQ ID NO: 4353 - DNA, 203 bp, synthetic construct
  misc_feature 1..203: note = Description of Artificial Sequence: Synthetic polynucleotide
  source 1..203: mol_type = other DNA
ttygattttagttygtygtygttttttaggyggattttttagaggtaggttttagttttyggygyggggaggyggygygttttagaggggygtagggtgygygggggtygttggtttttygggtattttttttttgyggttttttygttttttttyggagttggtgtttgaggtygttgggattttagtttggygtttttttt

SEQ ID NO: 4354 - DNA, 398 bp, synthetic construct
  misc_feature 1..398: note = Description of Artificial Sequence: Synthetic polynucleotide
  source 1..398: mol_type = other DNA
gggttyggggataaagggtgaygtgtggttttggggaaggttygggatgagggagttgaatttagttgtttygygyggtgtttagagtgttttatygygygtaataaattttygtagatatygtatttttaatgyggtgtttttttgtgttagtgtttyggyggtttttgtagggtgttaatgttayggttgtatatygttttttttttttattatttttatttgaatagatttggaggaggyggaaatggaaattagggtatgtttataagttggattygttagatttttttgttyggyggtatgtttgtgtatgtttgtatgtyggtaaggagttayggatagggaaggtttaagagttggttatttgagygtagtagatgggttttygtagtttt

SEQ ID NO: 4355 - DNA, 286 bp, synthetic construct
  misc_feature 1..286: note = Description of Artificial Sequence: Synthetic polynucleotide
  source 1..286: mol_type = other DNA
gtyggtttttttatatttaygtgtttttygtgtgygygttttyggtttgtagatgttataaggttggygtygtttggattttygggyggttttatttttygyggtygttaygtttygttttttgtatttagtttttttggygttttygttgtagtatttaagattaggygtygtttttgttagtygtgttgtttagtaygtttgagggtygttgtyggtaggttttatttttygttygggttttttatttatttttttttttggayggtggggtttaagttttgta

SEQ ID NO: 4356 - DNA, 267 bp, synthetic construct
  misc_feature 1..267: note = Description of Artificial Sequence: Synthetic polynucleotide
  source 1..267: mol_type = other DNA
ttttattttttttttttttttttagtttggttgaagaaygtttttaaggaaattygggttgtttttttttatttggaagtggttttttttatatyggttygtaaattgattatgaaatataygatgttaattyggagttgtattttttagttgggtattttygygygttggttttyggggtttygttttttattttttgtttttttttttygygttttgtttttattttttatttttygygttggttatttygtttttttggtagtt

SEQ ID NO: 4357 - DNA, 260 bp, synthetic construct
  misc_feature 1..260: note = Description of Artificial Sequence: Synthetic polynucleotide
  source 1..260: mol_type = other DNA
gaaattaygataggtttgtattatygtttttttttttaygttttygtttaggtttgtaaagtyggttgtttttggttaataggygttttttttgttttayggtgaaaattagtttgtggtgtattgagatttgtaaattattttttgaatgttaggggygttgtaaaatagtygtygggtgtagtgggtygggygttyggttattttggttgygattatygtagttttttaaaggatgygggtagatgtagayggttttg

SEQ ID NO: 4358 - DNA, 239 bp, synthetic construct
  misc_feature 1..239: note = Description of Artificial Sequence: Synthetic polynucleotide
  source 1..239: mol_type = other DNA
gtgagyggggtaygagagtgtagggtttygttggtgtttttttttyggygttygtyggatttatygtttttatygttgyggtgttygaattygyggattyggatyggyggtagtagaagyggtagyggtaaagtattygtagaatggggtatygygaaatagttttttttttttttttttttgttggtggtgtagtygygatagttygttttttaggtaggggtttggagtttgttttt

SEQ ID NO: 4359 - DNA, 846 bp, synthetic construct
  misc_feature 1..846: note = Description of Artificial Sequence: Synthetic polynucleotide
  source 1..846: mol_type = other DNA
ggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagt

SEQ ID NO: 4360 - DNA, 526 bp, synthetic construct
  misc_feature 1..526: note = Description of Artificial Sequence: Synthetic polynucleotide
  source 1..526: mol_type = other DNA
agttgtgaagaggygtgggggtygygggaatttttttttggtyggtgygatgaaagtygggyggaygaggtggtttaayggggttgagagtggttyggtygaggygygggttgagtttttagtatttggtttgagyggygtgggtagtagtttgtatygyggatatttttaattttgtygygtttgygtygtattttggtygtggtagygatttttygggtatttttgaggtygtttttagttttataagtatttagtygtttattttagagtagyggygtygatygttttaagaggagttagttttygatatygttttttatttatttttttatatttttatygttggagggggtgagtgtygtggataggygttttygttyggggatagtttagyggyggtagttagttygattttttttygygygggtygtttaaatttgattagtagagygagyggtttagygtagtagtygttttygyggtttttagttgtagaaaagtaaagygtygggaggaagtagta

SEQ ID NO: 4361 - DNA, 201 bp, synthetic construct
  misc_feature 1..201: note = Description of Artificial Sequence: Synthetic polynucleotide
  source 1..201: mol_type = other DNA
gtttttygtagataagtaaataatttggaygtgaaatggaaatggtaattaatgtagtaatgttgttatatttygagtgtgtaaattttattgattygtygygttayggggggtgtygggygtayggggatyggtggygtgygtttaggttgtttattttttttttttttttttttttttttttaggttttygggyggggc

SEQ ID NO: 4362 - DNA, 523 bp, synthetic construct
  misc_feature 1..523: note = Description of Artificial Sequence: Synthetic polynucleotide
  source 1..523: mol_type = other DNA
ttttaygagaagaataagaagggttggtaaaatagtattygttataattttagttttaaygagtgttttattaaggtgtygygygagggyggyggygagygtaagggtaattattggaygttggattyggtttgygaagatatgttygagaagggtaattatyggygtygtygtygtatgaagaggttttttyggtygtygttygygtatttttagttyggtaaggggtttttyggggtyggaggygtygtaggygggtgyggygtggygggygtyggggtygayggttayggttatttggygttttttaagtatttgtagtttggtttttttaataattygtggtygttatygtagttttttttatttatgttttatgttttttgttagatggyggtagtygtagyggttgtagtagttgyggttgtagtygygggtttyggtagttttggygyggtygttgtggttaaggggttggygggttyggtygtttygtaygggtygtatataygygtgtagagta

SEQ ID NO: 4363 - DNA, 276 bp, synthetic construct
  misc_feature 1..276: note = Description of Artificial Sequence: Synthetic polynucleotide
  source 1..276: mol_type = other DNA
tygtttaggtagtattttygtagtagtygttaaygagttgtagtygtygtttattgttygygtyggttttygtttttyggtgtttgtygtatygtgggtygtttygtygtgttygatgggtgygtttttagygttgtygtygyggygttyggtttygggttttygtygttgygtygttagttygtyggtagtagtygygtttattggygyggattyggagyggtttaggygtttatttygggayggttygtgaygttayggagggagggaggtggt

SEQ ID NO: 4364 - DNA, 357 bp, synthetic construct
  misc_feature 1..357: note = Description of Artificial Sequence: Synthetic polynucleotide
  source 1..357: mol_type = other DNA
attttttttttaggtaggagtagatatttgtttgtttttayggygygttagygttttgttttagtygtttttgggttagagttygaaatttatttattgygtttttatttyggtatagatagtttttaaagttgttygtattttttagatttygttttttgtttagttttyggatttygtttaggggttgagttgaygttygygggtggatttttttggttygttgygtagggaattgatttygggaatttagggygtatagaggttaaagaagttgyggtaagggagggtgggtaaatttagtttgagtttaggtttttgtygtttttatttttaagtttgttttgtttttttttt

SEQ ID NO: 4365 - DNA, 278 bp, synthetic construct
  misc_feature 1..278: note = Description of Artificial Sequence: Synthetic polynucleotide
  source 1..278: mol_type = other DNA
tgtygygttgtygtygtagttagtygygtygtygtygttgtygtagygygggyggtygygygtyggtagtaggggtttggygaggaagtygttgagtttygygygtttygygtttttggyggtygtagygttgtttattaattgatttttttattgatttatttaatttttaggagyggttgttyggaggtaygggtttttttttaaatttgtagygaygttttyggygtgggtataaaggtttygayggyggtyggygggggttgtttagygttygg

SEQ ID NO: 4366 - DNA, 336 bp, synthetic construct
  misc_feature 1..336: note = Description of Artificial Sequence: Synthetic polynucleotide
  source 1..336: mol_type = other DNA
ggtgatgaagtttgggtagaaattttttgtyggtygttygttttaygtttttttyggggtygatattgttaattttttygggtattgaggatatttttgygttttggagyggtgggaggaygyggagygtygttttttggttttygatattttgttygttttttttagtgggtttgtggttgygttttttygaaggaagtaataaatttttttgattttgggggttagaggagaygttttagtttttyggaggggtgtgygggygggatygttttttygttttattggatttttggtyggggttgtttttgttttattgtgttttatatgyggagt

SEQ ID NO: 4367 - DNA, 311 bp, synthetic construct
  misc_feature 1..311: note = Description of Artificial Sequence: Synthetic polynucleotide
  source 1..311: mol_type = other DNA
gggagggyggtaaggagtgyggaggtttaaaygggtatgagtayggggyggttyggtyggaggyggttttgggygtttttagttgttttyggttgttttygttgyggtatttagyggtttatyggggttgtattgttgtagyggttttttgtgttatttgtagtttaggaggttgagtatagtgagtattagtagtagtgtatagttygygtataatattagygtttttttayggaatatttttatttygagaggggaygygggttagyggygttttgggygtyggggttattgygggagtagggtaygyg

SEQ ID NO: 4368 - DNA, 201 bp, synthetic construct
  misc_feature 1..201: note = Description of Artificial Sequence: Synthetic polynucleotide
  source 1..201: mol_type = other DNA
aaygtyggtatyggttgggaagtttyggtgtttygggttttttttggygagggyggagaagtyggyggtttttgtttagaattttgtgattgtagggatygagatattaagggygggggtgtagaggattataagttttttagygygttttatttgtatataaatgtgttttgttttttaattttgtttttgttatttgtg

SEQ ID NO: 4369 - DNA, 201 bp, synthetic construct
  misc_feature 1..201: note = Description of Artificial Sequence: Synthetic polynucleotide
  source 1..201: mol_type = other DNA
tttttatttygygtttttyggaattttagaattygggtggtyggtttttggaaagtygtagtyggygygatgtattttgtagattttattttgttgggayggattttttaatttttagaatygygggtygtagggagttaaattgttgtttttttttttttttttygtgyggttggtggtttgttttttaaaggaaygttt

SEQ ID NO: 4370 - DNA, 481 bp, synthetic construct
  misc_feature 1..481: note = Description of Artificial Sequence: Synthetic polynucleotide
  source 1..481: mol_type = other DNA
tyggggtygtatygttatggygatttgtttatttgattygtttygggtggattygtygygatttttgggygtttaggtttttgagggtttaaygggygayggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyg

SEQ ID NO: 4371 - DNA, 280 bp, synthetic construct
  misc_feature 1..280: note = Description of Artificial Sequence: Synthetic polynucleotide
  source 1..280: mol_type = other DNA
gagttagtyggaggggyggyggyggtttygygygtttagagttttagtttatgaatgggattttattttgagygttttttttygggtttggggaggyggyggygyggyggyggggggygtttygtaagttygyggttttgagyggttattygygtagtaagttgggygagttggtagtygtttgtatttgttttttggtttyggtttttgatttygttttyggttttaagygttygggttgygttttyggttgtttygygaggtagttttaggaggttta

SEQ ID NO: 4372 - DNA, 252 bp, synthetic construct
  misc_feature 1..252: note = Description of Artificial Sequence: Synthetic polynucleotide
  source 1..252: mol_type = other DNA
gygtggggagtttggtattttatttaattagagygttggattgagaattgtttaattaggygygtagtyggagaggagggggyggtattygggatttggygyggtttttgttttttgygttagygtgagttyggttagggtttttayggtygtgtttttattttttagggaggygtyggtgattyggttatagttttagttttygtygttttgtgatttgygggtattggatgattygtagttgagatttyg

SEQ ID NO: 4373 - DNA, 239 bp, synthetic construct
  misc_feature 1..239: note = Description of Artificial Sequence: Synthetic polynucleotide
  source 1..239: mol_type = other DNA
ataggygatggatttttygggttttygggggygttttaygtgggtgttggtygggggttttttggtagtggttttggygttggggggtygaggttgtttyggygttagtttaygttttygttggygttttttyggygygtagttatttygggatttttaggtggtttttaggtttgggttyggtttgaggattttttyggggyggagyggggyggggttygagagtagtaygtaggtaa

SEQ ID NO: 4374 - DNA, 405 bp, synthetic construct
  misc_feature 1..405: note = Description of Artificial Sequence: Synthetic polynucleotide
  source 1..405: mol_type = other DNA
agtttttaattaggtttaaggagtygtagagtyggggtttygggttygtaggatttagaagttaygygtttygygtttttygtttygtygttgtttgttyggtygatttatttggtgtygygtgygttggyggttygygyggtagttaagttaaaggtygaggtygaggtygagygyggygtttagtagtayggygggggttagtagggygggygtyggtygtagygygtttygttttagtagtagtygygygtygtttttgtaggtygtttygtygygggttattyggggygtttaggttgtygtttygtygtatttygtygtttgttgtatygttttygttagggyggygaygygggatttggagttygggygggttaggggygyggttygtttygtagattt

SEQ ID NO: 4375 - DNA, 237 bp, synthetic construct
  misc_feature 1..237: note = Description of Artificial Sequence: Synthetic polynucleotide
  source 1..237: mol_type = other DNA
ttaagttgttgtygtttaaggttattaagtagaatttttttaaygaygagggttgttagagygatttggaggataaygtttygtagggtagtagygaygygttgttgttgygyggggyggyggtygtygtgttttygggttygggagygtayggtggtggyggyggyggyggygygtaggataagygttygggtttttttaygttgggttatyggggtttttatattatygtgygyg

SEQ ID NO: 4376 - DNA, 204 bp, synthetic construct
  misc_feature 1..204: note = Description of Artificial Sequence: Synthetic polynucleotide
  source 1..204: mol_type = other DNA
agtygagtagtagttttagagtttttygtaagttttttttatattttttygttttygttttaaaggagtagtagtttttttttgtttttttattgtygtygtygtatyggyggagtttttttttygygygtttttttttygatggagttygggygtygtygaygtygtygttgtttygaattttgagyggggtygtttyggtyg

SEQ ID NO: 4377 - DNA, 224 bp, synthetic construct
  misc_feature 1..224: note = Description of Artificial Sequence: Synthetic polynucleotide
  source 1..224: mol_type = other DNA
ggtyggggtgygygygtgtgtatgttgtgaatgygttgygygatgtgygtttttattttatatttagtyggttttttgtttgtgttgttygagtgtggaygtgtgtaygygttgtattygttyggtgtggtagygtttygtgagtttttggaggtagggaaaggttatttgtgtttagaggttttgttgagggygggaggggtttagttttagtggggagtttt

SEQ ID NO: 4378 - DNA, 278 bp, synthetic construct
  misc_feature 1..278: note = Description of Artificial Sequence: Synthetic polynucleotide
  source 1..278: mol_type = other DNA
agygggtttgttttttatttttttagtttygygtygtyggtttatagyggttttttttggggatagtttttttygggtgtygttttygttttttttgtgygttttttttttttttttttttttattaaatattatttgggaattgtttaaattttttttttaaaaaaagagagaggyggggaggagtyggagttgtggagaagtagagggatttaggtaagtatttgtggatttaaaygggygtttttggaaattttggagaaygtyggatgggagac

SEQ ID NO: 4379 - DNA, 232 bp, synthetic construct
  misc_feature 1..232: note = Description of Artificial Sequence: Synthetic polynucleotide
  source 1..232: mol_type = other DNA
gggaaataggtyggygtgtygaaagatatygagtaggtagaaataaggtaaatttatagaggygtaataggttyggtttttygtggttagggygagtygyggtttygygtggygtttyggtygttgttttyggattttgagyggttattgttggggttttygaaagaggtgtyggttttttgggagtyggaagagttgtttgggtgggtttygttttgttttttattttatc

SEQ ID NO: 4380 - DNA, 331 bp, synthetic construct
  misc_feature 1..331: note = Description of Artificial Sequence: Synthetic polynucleotide
  source 1..331: mol_type = other DNA
tgttttgtttggattttatygtggtygagaaggaggaatggtatatygttttygtgaatattatttaygtygagttygygtyggatttyggggtyggggyggygggyggyggyggygyggagttgtatayggagaagayggagtgygggygttayggagagtattygtttaagtaggaygttygyggggaggtggttatggttagttyggtttaygatygtttggtttgygattttaatattaagttygtygtttygattygyggtaagaattggatagtttttatttttaagggtaattgtaygtatagggataagattyggaaygygtt

SEQ ID NO: 4381 - DNA, 231 bp, synthetic construct
  misc_feature 1..231: note = Description of Artificial Sequence: Synthetic polynucleotide
  source 1..231: mol_type = other DNA
gttgygttttgggygtatttgygygtttggtttygygtttygyggagagggygatgggtttyggttaggattgagtttttttttttttttttttagtttygtttggtatttttttttttgtttygagggygagttayggtttgygtygtygttttttttttyggtgttttyggttygtygttttttygygtttttttttttyggattygttttyggggttattatggtygc

SEQ ID NO: 4382 - DNA, 201 bp, synthetic construct
  misc_feature 1..201: note = Description of Artificial Sequence: Synthetic polynucleotide
  source 1..201: mol_type = other DNA
tgttyggttttgggtttagttygtyggygttgttgggggyggtaagtttygtattagtttttattygttttatttttttyggttgaatgagtgttagttygygtattggggttatttagaggagaygggtaaagtygyggttttaygggttgtattattggtygyggagtttaggggagttgtaggagaaattattgygag

SEQ ID NO: 4383 - DNA, 201 bp, synthetic construct
  misc_feature 1..201: note = Description of Artificial Sequence: Synthetic polynucleotide
  source 1..201: mol_type = other DNA
agttygatgattaggagttttyggttttygaagttgygttttatygtgtaaattttgttgatggyggtgtattgtagttatayggataygagygtttygygtagttyggggtagyggtggtattygaaggagatgtygtttttttgttgtagtygtyggygtygttttatgttygtygygggygtttygggtttttgggtt

SEQ ID NO: 4384 - DNA, 219 bp, synthetic construct
  misc_feature 1..219: note = Description of Artificial Sequence: Synthetic polynucleotide
  source 1..219: mol_type = other DNA
tygttgtagttatgaggagaatttttatttttatggttggtttatyggttatttygagatgtygtttttygattatagtatggttttgttttatagtttygagtatgttagyggygtygtyggtttggattatttttattaygggggggtgtygtygggygtygggttttygggtttgggggggtygygttyggtgaagygtygaggtatygttaatyg

SEQ ID NO: 4385 - DNA, 284 bp, synthetic construct
  misc_feature 1..284: note = Description of Artificial Sequence: Synthetic polynucleotide
  source 1..284: mol_type = other DNA
gtygggggaggtggggtygtyggggaggaggygagggaaayggggagttttagggagayggttttygagggagagtgagaggggagggtagttygggttyggtaygttttttttttyggtygtttttttttatataagygtaggtagagggygygttagttatgttttgtttttgygttygtygtygtygtygtygtygtttagttyggygygttttggaggattttgygtygyggygttttygggtttygtygtygttagtygtttygtygtttttttttygt

SEQ ID NO: 4386 - DNA, 429 bp, synthetic construct
  misc_feature 1..429: note = Description of Artificial Sequence: Synthetic polynucleotide
  source 1..429: mol_type = other DNA
aaagtattttttttttaatttatgaayggatttygatttttgttttgttattatttatgygtttygtattygaggtgtygtttttatttataygttttayggtttygygaaattyggttttttagttygygggaygygttgtttgttaggygggttyggyggtatttygggggygggaggggtyggtygtagggtttttagtttggygttygyggggygttygtagygaaggggtgggtgtygttygtgaaygtagtagggattagtttagttygygttygtttttgggtttyggttatygttttttygttattttttyggtttttgygtggatyggttygtggygggggttgttttgygttttygttttygtagtagtygyggatttttattaaygttgaygagttagtgtygygattyggggagaga

SEQ ID NO: 4387 - DNA, 283 bp, synthetic construct
  misc_feature 1..283: note = Description of Artificial Sequence: Synthetic polynucleotide
  source 1..283: mol_type = other DNA
aaaagatygyggtggagaagatggggygtttttygygatattyggttgtttagaggtgtaaagtyggtgggygtaygttyggggyggttttatagttttygggtygttagttttagggtgtygggttttaattaaggtttygaagtttttaygtatttgagggtattttgattagtttttgygggttgttttgyggtygtagtgggttttgaaagtttatttyggygtagggtggaaatyggygggaggygttgttgattttygattaaataatagtgaygag

SEQ ID NO: 4388 - DNA, 241 bp, synthetic construct
  misc_feature 1..241: note = Description of Artificial Sequence: Synthetic polynucleotide
  source 1..241: mol_type = other DNA
ygygggtggyggyggttgtggggtygtttgggatttttygtagtattgattttgtaattttttgtgtttgygtttygtggtgaggggyggygggatgygygygatttttttttgatttagttaaayggaaaagttygygygtttyggttggaaggtggaggttaggtaggattyggtaaaggtatattttaaaygaagtagattttattttttatttgtagagggaaggyggtgtggaygg

SEQ ID NO: 4389 - DNA, 244 bp, synthetic construct
  misc_feature 1..244: note = Description of Artificial Sequence: Synthetic polynucleotide
  source 1..244: mol_type = other DNA
gtagtagttttaygttgttggygtaggyggygygtaggagggtygtygttttygggaygtttttygggaygtttttygggaygtttttygygttttygaygtygtgttttttttygttttygaaagggtagaaagagtygttygaggygatgttgygggtgtttggtagattygagaagtttttaaatttttygtagttagyggggtttttttygatttgygygtttyggggtggggayggygg

SEQ ID NO: 4390 - DNA, 225 bp, synthetic construct
  misc_feature 1..225: note = Description of Artificial Sequence: Synthetic polynucleotide
  source 1..225: mol_type = other DNA
gtagggggygttgygttygtygagttyggaggggtygtygggtygggygttgygtattygygtygggagtygtttttygttygyggygttygtttttgtygttygttagtattttttgtttygyggtygygtttagataataaaagyggaagatgttgtagttgggtaaggttaggattttgttttgaagtygggyggygtygygtaygttttttttyggattga

SEQ ID NO: 4391 - DNA, 249 bp, synthetic construct
  misc_feature 1..249: note = Description of Artificial Sequence: Synthetic polynucleotide
  source 1..249: mol_type = other DNA
ygtygttttygyggyggtattgggtatgtttygtattyggggtyggtttyggyggyggggyggaygtttttttattagtygggygttygggtyggtygtygaggtttaggtggaggttgaggttgtygygygtygygggaggagtttygttttyggyggttgaggyggyggyggtataggtggygygggtygygygyggggygtagttygggagygttyggygtygggygtygyggyggttttaggttc

SEQ ID NO: 4392 - DNA, 255 bp, synthetic construct
  misc_feature 1..255: note = Description of Artificial Sequence: Synthetic polynucleotide
  source 1..255: mol_type = other DNA
ttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtat

SEQ ID NO: 4393 - DNA, 243 bp, synthetic construct
  misc_feature 1..243: note = Description of Artificial Sequence: Synthetic polynucleotide
  source 1..243: mol_type = other DNA
aygtttgtttgagtygtgttgtyggggattagygattttttatttttttttttttataggagygtttyggttttygttttygttttaatygtyggygygygtttttatygygtaygygtttttttygygygygtataygttygygtatataygttttttygttttygttygyggagtttttttttattttttagtygtttygtyggttgaagtatyggygttgggaggyggyggygttgttga

SEQ ID NO: 4394 - DNA, 201 bp, synthetic construct
  misc_feature 1..201: note = Description of Artificial Sequence: Synthetic polynucleotide
  source 1..201: mol_type = other DNA
yggtttgttttgggttygtgaggygaggtygtagygtttygaygtygggtgggygtgtgggtggagtggagatttgggtttttyggygtatgggagtttygtygtttgyggtagggaatygttttttatttttggttyggttygggtygggagtygtgtttygygttgattyggtgtaattttttagtttattttttttta

SEQ ID NO: 4395 - DNA, 208 bp, synthetic construct
  misc_feature 1..208: note = Description of Artificial Sequence: Synthetic polynucleotide
  source 1..208: mol_type = other DNA
gagaattgaaaaggaaggygaggagtaggggttgygggtygggtttttgttgttygyggttttygggggtygygtygygtygggttaygtgggggttttygtttttygagygggygtyggtgggaaatttgygyggygagagatagggggatggggygtttttgaygygattgtggggtgygggtagttttggaggaggatgttyggt

SEQ ID NO: 4396 - DNA, 257 bp, synthetic construct
  misc_feature 1..257: note = Description of Artificial Sequence: Synthetic polynucleotide
  source 1..257: mol_type = other DNA
tagygttttygttttggttatggagyggtyggygttyggygaggtggttatgagttaagttatttagtyggygtaygttattgygygyggygagttgagygyggggtagttgtttaagtggatygatattatygtttgtttggygggtaggygggygtyggggttgyggggaggygygggatyggggttgygggagyggyggyggttgggggttggggggggtaggaaggygaggaaggtatttgyggagagttgaa

SEQ ID NO: 4397 - DNA, 350 bp, synthetic construct
  misc_feature 1..350: note = Description of Artificial Sequence: Synthetic polynucleotide
  source 1..350: mol_type = other DNA
aaagtgtttgtaaagtttgagtagagtgygyggggtygagyggggagaagggtgyggggtatyggggtgagatataggaaagaggaggayggtggggagyggtagaagatagygtttttaggattagygattttgtggtttattyggttattgggtttyggygtaaattttttttaggtagtgygggygatgttgattgtagaygtygggtagggttttygtgygggygggagygggggaagttagtgygttygggygttagttagttgatgygggaagaggttggggagttgtagggtygttygttttygggtgyggtgttttggygtagggtttgggttgagtygttc

SEQ ID NO: 4398 - DNA, 216 bp, synthetic construct
  misc_feature 1..216: note = Description of Artificial Sequence: Synthetic polynucleotide
  source 1..216: mol_type = other DNA
ttattttgttygttagtatattttagagtttttaatttttttttgtatgtaagtttaggtagagttttgttaggttttatattagagtatatttttgtayggattttttaggatygyggygtyggttggttgtttyggtttttygyggtygygtgagtttttttttggtggtggagggygtattttaatttggaaatttttagtttttaatttggt

SEQ ID NO: 4399 - DNA, 269 bp, synthetic construct
  misc_feature 1..269: note = Description of Artificial Sequence: Synthetic polynucleotide
  source 1..269: mol_type = other DNA
tygygaagggtataatttgagaagttygtggtagtttttygtagygtygggtgatatagggtttttttatttttaggagaagtgggtaggagagagggtygttygttgtttttygttgygtttagggatggagggttttattatttatggaattgttggtttttttgygtggttygggattttagtygtggtttygygttaagagggtattttttttaaaygaaatygtttygttygttygttygttygttygttygggtagtaatgtc

SEQ ID NO: 4400 - DNA, 258 bp, synthetic construct
  misc_feature 1..258: note = Description of Artificial Sequence: Synthetic polynucleotide
  source 1..258: mol_type = other DNA
agtaaaatttttattattttttyggtgtttattagttygtttttttaggtttttgggattattttatttaaaagtagttttttttagyggggtttagatygtttttgagatttygttgagaaatttttagygggttagygtttgggygttgggygtygagttygatatggttttttggatgtygttgatttgttygtyggttgtttagtttttgttttatttyggggygtagaaaggggaygggtaggggttygattt

SEQ ID NO: 4401 - DNA, 224 bp, synthetic construct
  misc_feature 1..224: note = Description of Artificial Sequence: Synthetic polynucleotide
  source 1..224: mol_type = other DNA
agtttttagggatatttgaggtattatttttgttattgtygggtattygyggygttgttaayggtttggttatatgtttttyggagagttaygggagggygttgggtaatttttattygagtygyggtygygaggaggagggaaaaggygagtaaaaaggaagagtgggaggaggaggggaagyggygaaggaggaagaggaggaggaggaagaggggagtata

SEQ ID NO: 4402 - DNA, 256 bp, synthetic construct
  misc_feature 1..256: note = Description of Artificial Sequence: Synthetic polynucleotide
  source 1..256: mol_type = other DNA
ggtygtgtagttygtttygttttttttttygaagagagatttggtgttggtatgggtatttygyggttatyggagtggtttttyggatgagtttggtttyggygttgaygttttggttttgggggttgtttggttggtgttaggtagyggaagaygtttggagagttattygtttttttttttattygtttttatygttgttygtgttaggaygygtagtttgtagttgtagtttaggtattggygygggatggyg

SEQ ID NO: 4403 - DNA, 310 bp, synthetic construct
  misc_feature 1..310: note = Description of Artificial Sequence: Synthetic polynucleotide
  source 1..310: mol_type = other DNA
tttygtygtttyggaggttggyggtgagggtattygggyggtaggggttygtygaggggtygtggtataygggtaagggggttaattyggaatggttttygagtagttttaygttttgttaaggayggtaggtgtaagggtygggggattttttgayggggtygttttttygggtayggggaggtttttatygagttttaattttgaayggggtagggggtagagtttttggtaggtaaggttttyggaggagggaayggttggggagtggyggagtttyggagtggtggttttgttaaygttttttttc

SEQ ID NO: 4404 - DNA, 410 bp, synthetic construct
  misc_feature 1..410: note = Description of Artificial Sequence: Synthetic polynucleotide
  source 1..410: mol_type = other DNA
aaggatttatttagaygtaygttygygyggagaygtaygttggtataygygtttatataygygagtatatataygygtatattattyggttygtgygygygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyggtggttttagttttattagtaattgtygttggtaggagtattataygttttaggagtttttygggtattaagtatgggtttagttygttttagttatttt

SEQ ID NO: 4405 - DNA, 274 bp, synthetic construct
  misc_feature 1..274: note = Description of Artificial Sequence: Synthetic polynucleotide
  source 1..274: mol_type = other DNA
agatygagggaaygttgtttatgyggtgagagttagygygggaggyggygagggygyggggagatyggggagggggtgggtttygyggygttygtygttygtttttaygygygttgtyggtatttgttygttttgttgtaatttgttgtagtgtttgaaagagtagtaggagygtatggaggtggggtyggggaaagattaggyggagtggttgtggggtgagygyggagtgggtggggaggyggyggyggtggggaggggggattggttttag

SEQ ID NO: 4406 - DNA, 201 bp, synthetic construct
  misc_feature 1..201: note = Description of Artificial Sequence: Synthetic polynucleotide
  source 1..201: mol_type = other DNA
gtygtygtygtygttgygtygttttttatttagagttyggyggygtygttttttttttttttygygtggtggyggggtatggtattattaygggtatygygagggggtygttagygtttgyggygggggtagyggttttatgtgygtyggygggttttaaggaggaagtyggyggtygayggggygttygttagttagaga

SEQ ID NO: 4407 - DNA, 265 bp, synthetic construct
  misc_feature 1..265: note = Description of Artificial Sequence: Synthetic polynucleotide
  source 1..265: mol_type = other DNA
ggtygggaggygyggagttagtygtttayggagtttaattgtttgtatyggggatyggygggyggggygygttygagtggtttygtygggaaagggyggygggygttggagaaggygtttggygygaagttgggyggygtttygagggyggaggataggtggtygygygatygtagttaggtagygaayggttygggggttgygtagygyggttttaaagtttagttyggtttygggtttagttygttgtygtttgttaygggag

SEQ ID NO: 4408 - DNA, 201 bp, synthetic construct
  misc_feature 1..201: note = Description of Artificial Sequence: Synthetic polynucleotide
  source 1..201: mol_type = other DNA
gygtagggggtagttgygtataaygygtttttggtagygyggyggttgygggyggggygygttttaygtgtttgaaggyggaygtttttttyggggggayggagagtagagggaagtygygtagggttttagagtagggtaggttaggyggyggyggyggyggygggtttttagygagtaggtatttgggatggtggtggt

SEQ ID NO: 4409 - DNA, 362 bp, synthetic construct
  misc_feature 1..362: note = Description of Artificial Sequence: Synthetic polynucleotide
  source 1..362: mol_type = other DNA
ttttaaatygagttttygggtgtgtagattygtagyggagtygygggagygaggtgggaaattttggtygyggygtygggtttygttygtyggggggygyggggyggygggygtatgygygtgygyggtgyggttttagttttggttgtygtygtttgtygtygtygtygygatgtttattttagttaaagyggttgygggtttggggattyggttygggtagyggagttttyggattygtygattygtygaggagygygygtygggttttygtygagtagttgagttygtgtgtttygygtttygygtttygaagttgtygtttygaattttggtyggygttgtttaggtttttygttagg

SEQ ID NO: 4410 - DNA, 298 bp, synthetic construct
  misc_feature 1..298: note = Description of Artificial Sequence: Synthetic polynucleotide
  source 1..298: mol_type = other DNA
tagyggagayggttaagtgtttttttattaatttttttttttyggagtttaggggtgttgtatgggyggygtttggattygygttttggagttattaggyggagtaaagttagygygtttygyggttyggaatttagttggttygttatttttttatttttgygattttattttygatygygttttagggtagaagygtttgagttttygttagtgggtatttaaagtttatgttyggygggygtgttgaygttattygggggttgyggagygggagggggyggtggggggyggggat

SEQ ID NO: 4411 - DNA, 295 bp, synthetic construct
  misc_feature 1..295: note = Description of Artificial Sequence: Synthetic polynucleotide
  source 1..295: mol_type = other DNA
gaaggataygtaaatttgtygagggttygggggtttygggttgttgttgttgttagygttttgggaagtgataggtattaggatttgttggtgyggyggyggyggyggyggtagttttagtygygttygttatatatatttttattygttyggtgtataygtygygtygygggtagtgtygtttgyggaggygygttyggggttygtaggggtagtagyggtagtttggtagygtygtygygttttygggtatttggttygygaagtttygtttttgtygtttttygygtygttc

SEQ ID NO: 4412 - DNA, 203 bp, synthetic construct
  misc_feature 1..203: note = Description of Artificial Sequence: Synthetic polynucleotide
  source 1..203: mol_type = other DNA
ggatgyggtygygtaggygttygttttttggttttttggtygggtagygggygttyggttatyggagtttagtttaagggtttagtygaggttttttygygygaggyggttgygttaggtgagygggtatygyggtygygttttttttgttatttatttagyggttagaggtattttgygtttgggagttttaagtgttttyg

SEQ ID NO: 4413 - DNA, 215 bp, synthetic construct
  misc_feature 1..215: note = Description of Artificial Sequence: Synthetic polynucleotide
  source 1..215: mol_type = other DNA
agttttaaattttaygttataaagtttygaagaggygggttgggggygggggtyggggyggatttttaggggygtggttgygygtttgygatttyggatygtgttaatttygtygtygttttaaaatttgtgggaaattttagttttgttatttattttttttggaggaygtagataggatttgttttgtaggagtttaggtyggtygattygyg

SEQ ID NO: 4414 - DNA, 201 bp, synthetic construct
  misc_feature 1..201: note = Description of Artificial Sequence: Synthetic polynucleotide
  source 1..201: mol_type = other DNA
gggyggyggygygygggggatttatttygtttttatttgatttygggtgattgtttattgttatggtttgygatttygygtggggatygtttagggtttyggggttttggatgtttygggtggygtygtygtaattttygtgtttttygygtygtttttatttygtttttattygggtygattygagyggttgtagttttt

SEQ ID NO: 4415 - DNA, 340 bp, synthetic construct
  misc_feature 1..340: note = Description of Artificial Sequence: Synthetic polynucleotide
  source 1..340: mol_type = other DNA
tttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtt

SEQ ID NO: 4416 - DNA, 201 bp, synthetic construct
  misc_feature 1..201: note = Description of Artificial Sequence: Synthetic polynucleotide
  source 1..201: mol_type = other DNA
ggyggagggatagagttggattyggaagtygygggtgggagttgtttttygygagttygaggttgttggtattttgtygygggtagttygygttagtttygggagtttttgggtttygggagagygagtyggggtygtttggttataaagatgttygygygttygttttgygtaygggattygttttgygttttgagtttt

SEQ ID NO: 4417 - DNA, 236 bp, synthetic construct
  misc_feature 1..236: note = Description of Artificial Sequence: Synthetic polynucleotide
  source 1..236: mol_type = other DNA
aaygttyggttaggttttagagttttygyggagagyggggygtttgttgggggyggtygggagggtygggttaggggygygggagatttygyggggaygygaggtgttgygggttttgtgyggttggttgggaaygaggagaatgtgttattaatagtgtttaatygattgattattttgggtgttgtgtttttttttttatttttttttatttttgggaaaatgtattgtttagg

SEQ ID NO: 4418 - DNA, 251 bp, synthetic construct
  misc_feature 1..251: note = Description of Artificial Sequence: Synthetic polynucleotide
  source 1..251: mol_type = other DNA
gtgtttgaatttttygggatatttagayggttggagtttttygattttaaggygggygayggtaaagttaaaygttagygygttgyggttttygggtatygaggygttttygttttygttatttatatagggygttaagtgtttygattygygagtgaygaggaygtataggttagtgataygattygtagttagtattgagygggaygayggggttygagygtaggagggtgygyggggagttgaggagc

SEQ ID NO: 4419 - DNA, 201 bp, synthetic construct
  misc_feature 1..201: note = Description of Artificial Sequence: Synthetic polynucleotide
  source 1..201: mol_type = other DNA
tgagtagtttaggtagtygyggtggtygtgaayggggygggagtggggggtgtttaggttattagaggyggtttygyggtttgtatyggttggagtgggygatttagagtttgagtggagggggyggggggyggygatagyggggggttttggtagygatggtttgaatttgygttggtgggggatggggygggggygggg

SEQ ID NO: 4420 - DNA, 206 bp, synthetic construct
  misc_feature 1..206: note = Description of Artificial Sequence: Synthetic polynucleotide
  source 1..206: mol_type = other DNA
gygttggggaagggatttttyggaggtayggggtagygtgygggttgyggtagygatttygattygggttttygggttttgtygggttgagtttgygttygtttygtygtygttaagtttttttaattttgttygttgygttyggatygygygttaggtttgggggygtagtaggggttgggggygtaygttgygtattyggggac

SEQ ID NO: 4421 - DNA, 201 bp, synthetic construct
  misc_feature 1..201: note = Description of Artificial Sequence: Synthetic polynucleotide
  source 1..201: mol_type = other DNA
gtttyggtttygggygtygattaggtttttttggttttygtygygygttttttaatttgttgttgtygtygtygygttttttaggttttgttagttattygygttttgagttyggggttagatttttatggaagygtygygatgttygtttttyggttgttggatttttagaagaygaaataygygaggtgagyggyggtc

SEQ ID NO: 4422 - DNA, 203 bp, synthetic construct
  misc_feature 1..203: note = Description of Artificial Sequence: Synthetic polynucleotide
  source 1..203: mol_type = other DNA
tgggattttttttttaaaaaygtaggygttttttygggtygtagtygtagtygggagattgagggttagggygyggtygyggggttttttgggtyggggygyggtttaygttttaggtttttgyggttttgattagaagtygttgygtttttggtygttttttattygtttygttttygtaattttaggtttagggttatagc

SEQ ID NO: 4423 - DNA, 216 bp, synthetic construct
  misc_feature 1..216: note = Description of Artificial Sequence: Synthetic polynucleotide
  source 1..216: mol_type = other DNA
taggggagaygaatygattggttgttyggtygtyggaayggtaggtttygtygtttttttygtttttygtattttyggttyggtttttttttattatygygtttygttttaattygtagttagtattttttttttatttttttttygttttygttgttatttttttttttggatgttggaagygtagttggtattttygtttttttaattttttaa

SEQ ID NO: 4424 - DNA, 335 bp, synthetic construct
  misc_feature 1..335: note = Description of Artificial Sequence: Synthetic polynucleotide
  source 1..335: mol_type = other DNA
gtttattygttttttaggtgattyggygttttygtygygttygttggaagtttgtaaatttttttygggggtttygtygttaygttgggaagttggggaygyggggggaggtttttggttygtygttttygttgtygtttgatygtatttttggagggtttygtattttgttaggtttttggaggtaaatatatattttygatttataattggttttygygttaggggattygygygtttttatataygtaygtaygtygggyggattyggygtyggttttaygttagtatttttttaggygygyggygyggyggttatygagygtttyggtatt

SEQ ID NO: 4425 - DNA, 230 bp, synthetic construct
  misc_feature 1..230: note = Description of Artificial Sequence: Synthetic polynucleotide
  source 1..230: mol_type = other DNA
tygggygttgatagaygattttttttatttgttagttttttygtttgttagtagagttgttggtaagtgagagaaaatagaggggygygaaggtaggygyggttagggagtgagyggggygttgggygyggggyggagtygggtgygyggygttygggttaggttttatygttygygtyggttttygttttgtttagtygtygtttttttttttttttttattttttttt

SEQ ID NO: 4426 - DNA, 224 bp, synthetic construct
  misc_feature 1..224: note = Description of Artificial Sequence: Synthetic polynucleotide
  source 1..224: mol_type = other DNA
agygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattg

SEQ ID NO: 4427 - DNA, 211 bp, synthetic construct
  misc_feature 1..211: note = Description of Artificial Sequence: Synthetic polynucleotide
  source 1..211: mol_type = other DNA
gggataygtagggggataygtagggattgttygygygaatggtttygaaygtatgygttttattttatattttatagtygttatgaygatygggaggttygttygttaayggttagttaayggttgyggggataagttygttgaggttgttaggygagttaggtttttttggatttygtttgattyggatgggttgtgtttgaaattgatt

SEQ ID NO: 4428 - DNA, 205 bp, synthetic construct
  misc_feature 1..205: note = Description of Artificial Sequence: Synthetic polynucleotide
  source 1..205: mol_type = other DNA
ggyggtgttaggtyggggyggggggtttttttatttagtayggggtattaggtygggatgggatttttttttagaaagtygattggatgttaggagaggygtayggttgggggttttttttttttttttttttttttttttygyggttgaattaaattagaattgttatttagggtttgtgagttagaagggatyggattatayg

SEQ ID NO: 4429 - DNA, 398 bp, synthetic construct
  misc_feature 1..398: note = Description of Artificial Sequence: Synthetic polynucleotide
  source 1..398: mol_type = other DNA
ggygygggtttyggygygtttagtagttyggttagygttagygygttygttagtaggttgagaayggttagygtttttagygtggtygtttgttttagtygtagygtgtagtygyggaatagygtttttagttttgggtaagygaatttttygtygtaygttyggagttygygtyggyggtttgtttyggtygttygttyggygttttygggttygttygygtygttttygtygtygttttygtygygyggygttttygttattttagygttatgtagyggtygyggtygygggygygtttttygtyggttyggggygtyggggygygggyggyggygtyggggygggygggyggygggyggygaggygtyggggygyggggygyggggygggyggag

SEQ ID NO: 4430 - DNA, 290 bp, synthetic construct
  misc_feature 1..290: note = Description of Artificial Sequence: Synthetic polynucleotide
  source 1..290: mol_type = other DNA
tatygygtygyggtttygtaygggatgyggyggtyggygttgtgttygygggtygggtagttyggttyggtygyggygttgygggattygygygtaattygtgggggygyggygygggygataygtgygggtygttaggagggggagggggaygygygtygtygggttygttattttgtattyggggtygttggtyggtyggggtatttttaygttygtttygttggygagattggagggattygggatatygtaaagtattttttttagtgtttgggagygttygttgt

SEQ ID NO: 4431 - DNA, 307 bp, synthetic construct
  misc_feature 1..307: note = Description of Artificial Sequence: Synthetic polynucleotide
  source 1..307: mol_type = other DNA
ttatygtagtyggtttyggtyggatttaaatagttttttttttattttygggatatttattttaygtatttattattttttagtttttagatgtttygtygttttttttatggattttttagtatttgtaggttataggataatagaagttatagtagagttatygaggaattttaggaayggaggagatggaatagtggagaygygaattaggattagagttyggaagttaggagataaaggtttygttatattgaagaggtygtttttttttttgtagttgygtatttgattggatagttttayg

SEQ ID NO: 4432 - DNA, 212 bp, synthetic construct
  misc_feature 1..212: note = Description of Artificial Sequence: Synthetic polynucleotide
  source 1..212: mol_type = other DNA
gggggtggttgtgggttygaagtggaggaygagtatggtttgggagataaggaatygttttgagatagagaaggttttygggagyggatagagagtgggygaaatyggtgygtagtaatygyggygttagttttagygyggtttttggggygtagttttatttygttttagtagttgyggagttttttgaygagttttygtttggtagtatt

SEQ ID NO: 4433 - DNA, 375 bp, synthetic construct
  misc_feature 1..375: note = Description of Artificial Sequence: Synthetic polynucleotide
  source 1..375: mol_type = other DNA
tagggygttttygtttggattataggagaaagtttgggaggtaggtttaattttttaatttggyggggaattttttttttttttatatagtttgtagygygggggyggyggggtgatagttttygtgtatgaattagttattttttaggtttygtttyggygggggtyggtyggaygttygtttygtataaagygggtattygggtygtttggagtagaaagtygygtattttttttygttaggygttttttyggaygttttgtttagygggtygttygattttttgtattatggatttygttygttttttggggttgtygattttgttgttttttttgayggaggttgtattgggygatgttgtttaggagtta

SEQ ID NO: 4434 - DNA, 201 bp, synthetic construct
  misc_feature 1..201: note = Description of Artificial Sequence: Synthetic polynucleotide
  source 1..201: mol_type = other DNA
ggyggtatggagygtagtggttgggttyggtagattttttttttagygttgttgttgggggygaygttgagggygygygyggyggttggttattattttygtttttygttttttttttttttgtgtatttattayggggagttggaaggggatggggagtagggygaggtgtttatttttttgtatattgygggtaatttt

SEQ ID NO: 4435 - DNA, 356 bp, synthetic construct
  misc_feature 1..356: note = Description of Artificial Sequence: Synthetic polynucleotide
  source 1..356: mol_type = other DNA
gggyggggyggygygygggggygggggagyggtygggataygtgtggyggyggygggggggaygyggygttyggggttttaagaaggtgtggagyggggygggygtttttttaggtttggtygaggggygtygygtagaggyggyggyggygtayggaggyggtagaygaygygttttyggygttygtagtttyggtttygygttttygyggtttaaagtaattttgggagtygtygtttttygyggaatttttyggygggggttygtttttaggttygttttygagttygtttygttttygttygtttttttttygtttttttttygygtggttttttygtttyggygtttttaa

SEQ ID NO: 4436 - DNA, 265 bp, synthetic construct
  misc_feature 1..265: note = Description of Artificial Sequence: Synthetic polynucleotide
  source 1..265: mol_type = other DNA
atttttaggtattattygagtttgttaattttattttygtttaattttattttaaaattttttatagatgaggttttgtygttgtygygaggggtygggyggtygyggygggagggatagggggtttgggtgggaagggagygygagggtttttagyggttygyggtttygggyggatttttagaaygagtgygggtygttyggattggtagattgygagtttygaggggygygggaygtagtyggtttagataaagaaatyggc

SEQ ID NO: 4437 - DNA, 697 bp, synthetic construct
  misc_feature 1..697: note = Description of Artificial Sequence: Synthetic polynucleotide
  source 1..697: mol_type = other DNA
gyggggaggyggygggggygggagygggygaggggtygyggtyggtyggygttygggtttygattttygggtyggttaggggygygtygagtagtaggtygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggygggtygtggygygaggygtagtagtatygtttgtgtayggtgtaggtttygtggyggttgaagyggatgttgtaggtttygtatagygtgyggttggggtc

SEQ ID NO: 4438 - DNA, 226 bp, synthetic construct
  misc_feature 1..226: note = Description of Artificial Sequence: Synthetic polynucleotide
  source 1..226: mol_type = other DNA
gtagaggygygtagaaaaygygygggtggygygygyggttatttagtgggtttygttygygtygtyggygtygtygtygtygtygtaygtgygtygtygtgagygygaagggygttyggattygygttttgttygttygtttgttygtyggggttattgtggatttttaggtaatagttaagtgagaagttttttttattatygaaaggtgtttgygtttttttta

SEQ ID NO: 4439 - DNA, 201 bp, synthetic construct
  misc_feature 1..201: note = Description of Artificial Sequence: Synthetic polynucleotide
  source 1..201: mol_type = other DNA
tttagggaggatgggggtygygggggaagtygggygtttyggggttttygatatttatattttygtayggygtaygttttgtttygagtttgygtttttygagttagtayggygagtttgggattttygtgttttttttttgtggttttygagaaaygtyggagtttygtgttttgttgggggttggggggatggagaaaa

SEQ ID NO: 4440 - DNA, 201 bp, synthetic construct
  misc_feature 1..201: note = Description of Artificial Sequence: Synthetic polynucleotide
  source 1..201: mol_type = other DNA
tttggagatgtgattttttaaaagtttagtyggygaatgggagattgaagggtgaygggaagggggtaggygygttyggygttttgattgggygtgyggyggtaggattttaaagygttttgtttyggatygtttgttttgggtgatttttyggatttgttttggtggaattyggatttgtttygtygagatgaygaggta

SEQ ID NO: 4441 - DNA, 215 bp, synthetic construct
  misc_feature 1..215: note = Description of Artificial Sequence: Synthetic polynucleotide
  source 1..215: mol_type = other DNA
agaggaggaaggaaggaggaaagaggaagaygggyggtyggaggygyggggttgygyggygtyggtyggygyggygttggaaggygtyggygttaatttygygaggtaggygayggagggggagyggygttaatatataagagtattgtattaygttaatttttttttagaatagtatgygttagtagtatatttaygttttgattgaaggataa

SEQ ID NO: 4442 - DNA, 252 bp, synthetic construct
  misc_feature 1..252: note = Description of Artificial Sequence: Synthetic polynucleotide
  source 1..252: mol_type = other DNA
tygtygttgttygggtttyggggttgggtggaggaaaggggtgttyggaatygatttttatttttygatttttttgttggatattaygtttattttggaygtygtaagagaagttgttaagtttygtaggttttgattyggygtttttygygtttttyggttgttttyggtttttttgtgtttyggtggagtatttgygttyggggttggggttggaggaggtagttataygygygtataygtataygttta

SEQ ID NO: 4443 - DNA, 203 bp, synthetic construct
  misc_feature 1..203: note = Description of Artificial Sequence: Synthetic polynucleotide
  source 1..203: mol_type = other DNA
ggygggggagtgagyggagttttttataatgtttyggtgyggtgtagtygyggatggatgttgygggaaggggttgttatttgttgtttttgttagyggygygyggatttgttygygtttttgtagtygtygtygtygtygtygttagttygttyggtttttgtagyggygtygtttgygtttttttygyggtygtyggagyg

SEQ ID NO: 4444 - DNA, 201 bp, synthetic construct
  misc_feature 1..201: note = Description of Artificial Sequence: Synthetic polynucleotide
  source 1..201: mol_type = other DNA
ggtyggttttatgyggggygtttygtygygtygygttygygtttttgtatyggggtgyggggtttagttygaygygtattyggygtttygygygttttgygggttttttaggtyggtttygggtgggttaggatygyggygttggtaggtyggggttgagttyggtttttygygttggagtttttgygtygggtgtygtyg

SEQ ID NO: 4445 - DNA, 201 bp, synthetic construct
  misc_feature 1..201: note = Description of Artificial Sequence: Synthetic polynucleotide
  source 1..201: mol_type = other DNA
tgaattttagagggttgggttttgatttgagtgtygattygttaatgaggaygggaggataaggttgtygaygtagyggaaggtaggggggaagygattygaggatttgaygattatttttaggtaggggttttttaagtaggtayggaaattaattttattaaatygyggagtggggattgggttygggyggtgtttagt

SEQ ID NO: 4446 - DNA, 201 bp, synthetic construct
  misc_feature 1..201: note = Description of Artificial Sequence: Synthetic polynucleotide
  source 1..201: mol_type = other DNA
ataattttyggaaggagggggttaaatgyggtagyggygggtttgaaaagggttaggagygtygtaggaattggggtgtataggttttygygtgtttagygtttygttttttttygttttaggtttgttaggggygygygtggygygggtagagtttggtgggtgggttggygyggatagaagttttgtyggggagygggg

SEQ ID NO: 4447 - DNA, 213 bp, synthetic construct
  misc_feature 1..213: note = Description of Artificial Sequence: Synthetic polynucleotide
  source 1..213: mol_type = other DNA
tygatygygttttttgygttygttygygttttttttgtygtttygyggtttaggggtgtgagttattyggygatagtttygttaggttatttyggggygygtaggtggataygtataggaagatygttatttttaagatttttatattgtttatygtggggygaaattttataattttttgtataaaatgtataaataatattaaatgagttg

SEQ ID NO: 4448 - DNA, 385 bp, synthetic construct
  misc_feature 1..385: note = Description of Artificial Sequence: Synthetic polynucleotide
  source 1..385: mol_type = other DNA
tttgtaygtatgagtaggtatttaatattttttggtttagttatatgtgatatgaggttatttaygttttttttaattaatttttatgataattatgtgygttatggagaaaattaatggaggaaaaattatagagttattygaaatagttgygttgtttattattyggtgtttgagtttgttttttttgtaattagattatatgtgaggtagttttagttaattgtttgtgttatttatyggggaattttagttttatttgtgaatatttaggttttttygtygtaggatagatgttgggtgaggtttgttttttaygtaaatatttgttttgttgtttygagttagttaygagagttagtyggtttagataagtaggggatga

SEQ ID NO: 4449 - DNA, 278 bp, synthetic construct
  misc_feature 1..278: note = Description of Artificial Sequence: Synthetic polynucleotide
  source 1..278: mol_type = other DNA
agggtattaagaaaagaggggtatgygagtttggaagttggagagagttyggggttttttagagygggtgggaygtygygtttttaggatttygygttaygygtattttttttatttygatatttattgttatttttatagyggagygaggggtttygtygagggygagygtatttygtgyggttgagatgttyggaaygttttttygygtttyggtttttttagaaggggttatagtyggttygygagttttygggygggggttgagtygtagtgtt

SEQ ID NO: 4450 - DNA, 248 bp, synthetic construct
  misc_feature 1..248: note = Description of Artificial Sequence: Synthetic polynucleotide
  source 1..248: mol_type = other DNA
tyggygtaggygagtttggtttaagggttyggatygggtttgggaaaagtttgtttttygagggggagagygagyggtygygttgaggygttygygttgygygggggygtttttygttgtttgtagggagygyggygyggaygyggygggyggttyggttatttggaaygggygttygttttggttttyggggttgtttttgtygtttygggaagtygtygatgggttttatygttggyggttygygt

SEQ ID NO: 4451 - DNA, 216 bp, synthetic construct
  misc_feature 1..216: note = Description of Artificial Sequence: Synthetic polynucleotide
  source 1..216: mol_type = other DNA
tygtygtygttggtgggtggyggyggttygggtgttttttggattgygtagtaaagaggtattttgggagatggggttaaggttttagggggtgttattygygaayggtttattygttagattaggggggttttttggttgtgygtttggttagaattggttttgaygatggaagtttttggaattaaagygttgtttttttttttttgtgttata

SEQ ID NO: 4452 - DNA, 201 bp, synthetic construct
  misc_feature 1..201: note = Description of Artificial Sequence: Synthetic polynucleotide
  source 1..201: mol_type = other DNA
gtatttattagggygtttygtaaaaaatttygttttygtttgtttttgggaattataggtaagttttgggttttygaggtgtagttttaggtagagtttygtgttgggaggtgggaagggggtttgattttggggatttaggtagtttggggatagttttattaggggtyggtgtttagaattggtgagggaggtatttta

SEQ ID NO: 4453 - DNA, 208 bp, synthetic construct
  misc_feature 1..208: note = Description of Artificial Sequence: Synthetic polynucleotide
  source 1..208: mol_type = other DNA
ygagayggataggaatygaggagatttttttgtagygttttttatttttyggatagaaattttgtagattaygtttatttttttatttygtgtatygttygtggttygtgggtagtagttgtttttttgggatttttttygtttgttygygagttttygtayggtygygtttttgttgttggggtygttygttggttttggttgttyg

SEQ ID NO: 4454 - DNA, 201 bp, synthetic construct
  misc_feature 1..201: note = Description of Artificial Sequence: Synthetic polynucleotide
  source 1..201: mol_type = other DNA
atttggtttaatygtygttagttttaagttayggtttyggttttttttttttaattgtgtgggatttygtygtttggtttyggtygggyggaggggtgaygttagtygtttatatagtgttttttggtygttggagttygggaaatttgtgygttygaatttggtttygttaagaagttgggtaaggattygggtttttga

SEQ ID NO: 4455 - DNA, 364 bp, synthetic construct
  misc_feature 1..364: note = Description of Artificial Sequence: Synthetic polynucleotide
  source 1..364: mol_type = other DNA
ggyggttagtagggttttygttttyggggagaagtgtttaygatttaagggttgtttgttttaggaattttttaaagaattatagatattgagagtattyggggtttggtaggaagtgtagtgtattttttagttttagggtaattaggatagtatgaattttttattttgtggtagaataaayggttagygtttygatgtggygygttygatttttttttatagagtttaaaagttaygtttaattaaattgtagygttttygttttagttgggtatyggtttggaagyggtttggaattagattggattygaggaggtaagatttyggtagygygaggttaattataggttttattygyggt

SEQ ID NO: 4456 - DNA, 213 bp, synthetic construct
  misc_feature 1..213: note = Description of Artificial Sequence: Synthetic polynucleotide
  source 1..213: mol_type = other DNA
ttttttaggtttttggygttttyggygyggttgttttygyggttgttttygtttatggtyggyggyggtgygtagygyggygttgttygtygtgttgagygttgattygygygttygttgttgttyggttttyggyggygagaatggaaagttgtygttttygttaatttygaggagagatagaagattttatatgttggggagaggttgggc

SEQ ID NO: 4457 - DNA, 201 bp, synthetic construct
  misc_feature 1..201: note = Description of Artificial Sequence: Synthetic polynucleotide
  source 1..201: mol_type = other DNA
ggtttgtttttggaagaatyggttttttagtttttygtygtygtagttgtgatataagtaagtgtagtygygttgttyggggttygttagggtttttygygttygttttttatygtggttygyggyggtygygttttygtttygtttygttyggtygtttygtyggtttttgtttttagttgggttgtygtgaygaggaga

SEQ ID NO: 4458 - DNA, 201 bp, synthetic construct
  misc_feature 1..201: note = Description of Artificial Sequence: Synthetic polynucleotide
  source 1..201: mol_type = other DNA
tttatttatygygtttaattattttgtatagttggtttttttttttttttaagtatagtttaagaaggtaaagggagataggaaagggtggtagtttgaygatttagygatgtattttagaatygtttttatttttttagtgtgaagttttttgggagaggtgagttaaatyggayggtyggtttttgtagtygtttagag

SEQ ID NO: 4459 - DNA, 296 bp, synthetic construct
  misc_feature 1..296: note = Description of Artificial Sequence: Synthetic polynucleotide
  source 1..296: mol_type = other DNA
tattagtygggttggttgggyggttygggagttygagyggtggyggagyggygagtagygagtagygtttgygggagyggtyggtyggtygggttttygygtttygtaygttygtaygtttagyggggttygtattgagtatgggygyggyggtygtgygttggtatttgtgygtgttgttggttttgggtataygygggyggttggtygggggtagygggtttttaggtaagttttygatygaggtggggggyggygggygyggggggttygggyggtygaggygyggtttygga

SEQ ID NO: 4460 - DNA, 201 bp, synthetic construct
  misc_feature 1..201: note = Description of Artificial Sequence: Synthetic polynucleotide
  source 1..201: mol_type = other DNA
gtttttagtaggtttttattttatttttttygtygttygtygagttgggttttattaagggtatgygaagtygtaaggaaggtaagatgtagygggygtygygygatagtgaygygggtygggagggttaggaattatagtygyggttttaggaygaatttygggtttagtagtttygggygtaggagtygttaggtaggg

SEQ ID NO: 4461 - DNA, 297 bp, synthetic construct
  misc_feature 1..297: note = Description of Artificial Sequence: Synthetic polynucleotide
  source 1..297: mol_type = other DNA
tgtattttygatayggagttggtgtttygggaaggttgttttttgaagttttttttgttttgttgtggttttgttttttygyggatttttttttygtgtygaggtttagtttttggttttaaggaataaattygttggtttgaaagggagttayggtagaagtttaggggtagagyggygggagygygygattygygyggttggagtttygggggtatttggagagtagygygtttaagyggggttattggtttygyggttgygtttttttttttttygygtygygttttttttttc

SEQ ID NO: 4462 - DNA, 268 bp, synthetic construct
  misc_feature 1..268: note = Description of Artificial Sequence: Synthetic polynucleotide
  source 1..268: mol_type = other DNA
gtgtagyggggtttggygtyggtttttttttattaygygttyggtttagggtygtttagtygtygttatygtygtygttttttgggtygatggagtyggygyggaaggttygygygttttgygtygtygtygtttagtgtygtygttagtatttttttygttttttygtttttygggtttatttygygggggyggygttattttttygttgtttaggttygggtatygygggygtttygygggyggtagtygtttttttygagygyga

SEQ ID NO: 4463 - DNA, 201 bp, synthetic construct
  misc_feature 1..201: note = Description of Artificial Sequence: Synthetic polynucleotide
  source 1..201: mol_type = other DNA
aaggagygggattgttttttyggttggaygatagygtyggggattygtagygtgygygggtyggaattaaaaaagtagttygggagygygagggttgagyggggtaagtatgggttgtttttygtagttttttttttgttygaggttygggttggtygtttgtttgtttatgattgtttagttgttttttygattgtttag

SEQ ID NO: 4464 - DNA, 201 bp, synthetic construct
  misc_feature 1..201: note = Description of Artificial Sequence: Synthetic polynucleotide
  source 1..201: mol_type = other DNA
ttaattygttygtagttgttygttttggattaagtygtttygyggttygtgttaggtagtgggttygtttttttttttttttttttttttaaattgggaygtgygaaggygtagttgttttttyggggttttttttattttttatatattttgttttygttttttgttttttaggttygtggyggagagatgttgatygyg

SEQ ID NO: 4465 - DNA, 201 bp, synthetic construct
  misc_feature 1..201: note = Description of Artificial Sequence: Synthetic polynucleotide
  source 1..201: mol_type = other DNA
gttttggagtttagtagagttggagygtatattttygttttttttttttygttttygagtattaggyggatatattygtatttygaatgttttagtgggygtagagtttattagaaatggatagtyggatttttyggygtttgttgggggtatygttgttaggtgtttggggttygttttttyggttttgttygtataggg

SEQ ID NO: 4466 - DNA, 201 bp, synthetic construct
  misc_feature 1..201: note = Description of Artificial Sequence: Synthetic polynucleotide
  source 1..201: mol_type = other DNA
ggtygtygggygttgtagtgggaygygygyggttgtgagtttgygggatatgtttttygygtyggttttttgttggyggttatgaagaggtagaaygtgyggattttgttttttatygtttgtatttttatttatttgttggtgggygtygtygtgttygaygttttygagtyggattaygagatgygygaggaggagaaa

SEQ ID NO: 4467 - DNA, 302 bp, synthetic construct
  misc_feature 1..302: note = Description of Artificial Sequence: Synthetic polynucleotide
  source 1..302: mol_type = other DNA
ygttyggaygtyggagggtttygattttygygyggtttatgygttygygttygtttygttgtttygygaggttygygggatttttttygtygtygtygtygygttygtygttttyggaggagygggttggtygatygttatygygtygtttttyggtygttttygaagtygttttatygyggtttttgtygttttggggtygygtttygttttygygttttgggggttgagtygagtaaatttygygtatyggtygaygttyggyggggatttygttgygtattygygygttygggtgggyg

SEQ ID NO: 4468 - DNA, 201 bp, synthetic construct
  misc_feature 1..201: note = Description of Artificial Sequence: Synthetic polynucleotide
  source 1..201: mol_type = other DNA
tttttttggggttttttatgttaggtttygyggttgtgttygtaagygtagatggtttygggattygggttattttgaygtygtagatttagtaygttgyggatygggtaygttggatttygggataagtgyggagggtygggggttggaagggattygagagtagagttygygtttttattttayggaygyggttatyga

SEQ ID NO: 4469 - DNA, 220 bp, synthetic construct
  misc_feature 1..220: note = Description of Artificial Sequence: Synthetic polynucleotide
  source 1..220: mol_type = other DNA
yggttygtygtttygtatttgygttygtagtygygygttygttygttygtygtygttaggtttygyggttygggygtttatgtygygttttgygttygtygtygtygtygttgagagtygyggagygtagttygagggagygtygggygggggagtygagygatygggggyggggyggggggygagagttggttyggggttyggtagtygttygtttygc

SEQ ID NO: 4470 - DNA, 347 bp, synthetic construct
  misc_feature 1..347: note = Description of Artificial Sequence: Synthetic polynucleotide
  source 1..347: mol_type = other DNA
ggyggtatatyggtagggyggtyggttttgttgggttttttgggygtyggtttygggggttygggyggtttttttyggttttyggtttggattygygaaygygygggygygaggggttgggaygygggagttttttgagtgyggagygyggagttttggtgtttyggygtattgtagttatattttygggtygygygttttygtygttttttattygygtygtagggtttttttttttgaggygtygttygygtatygtygggggggagggggtagygttaataaattggggagttyggttygtygygtttaggttttygtttggagtygtygtattygggayggtg

SEQ ID NO: 4471 - DNA, 201 bp, synthetic construct
  misc_feature 1..201: note = Description of Artificial Sequence: Synthetic polynucleotide
  source 1..201: mol_type = other DNA
ygtgtaygtttygtttttattggtttygtttygtgattaygttttygtaattttgatagattttattttygaggattttttttaggagtatagtgatttygtttttatagggttygtttygttatattgattttttygtgtygttygygggattttatttttgttygtttgtttyggtgtttatggggaagtttggtgtta

SEQ ID NO: 4472 - DNA, 201 bp, synthetic construct
  misc_feature 1..201: note = Description of Artificial Sequence: Synthetic polynucleotide
  source 1..201: mol_type = other DNA
tagattygggggaattaggaaaygygttyggygattttygggtagtagtatygggttaggtttgttttyggaatygttgaygttattygtygtttttttygtttgggtttttygygggtygtaggggtggaagttygatttgggttagggttyggatttttttttttyggtttttgygtygtygttttyggtgttaggayg

SEQ ID NO: 4473 - DNA, 225 bp, synthetic construct
  misc_feature 1..225: note = Description of Artificial Sequence: Synthetic polynucleotide
  source 1..225: mol_type = other DNA
ttgtagtttgggtaatygagygagattttatttaaaaaaaaaaaaaaaaaaaaaaattaaggttgaattygggttttygtaygttygtatttatttgygyggttattaygygttgtttttyggygattaggttgtattttttgtattggtagtygygttatatgtagaagygtttgtggtttttgagyggygaggygtagtygtggtttttgtagygtgygtatt

SEQ ID NO: 4474 - DNA, 318 bp, synthetic construct
  misc_feature 1..318: note = Description of Artificial Sequence: Synthetic polynucleotide
  source 1..318: mol_type = other DNA
ggttttggtagagygygtagygagtyggggatgaggttttttaagttttygttggtttgttgtyggygtagygttatttgygtagttatgattygttgtygttygatgatgaggatgtatttttygtaggtgtagtttttgaagyggtagtaaygtttgtggtttttgagttaggataggaygttatggttgyggtagygygygtatttgggygtgygttgtaggggygttygtggyggttgygatatygggtygtttatgtataggtagggggagtygtagtygtttatgtttygggttttygaatgagttggtagt

SEQ ID NO: 4475 - DNA, 265 bp, synthetic construct
  misc_feature 1..265: note = Description of Artificial Sequence: Synthetic polynucleotide
  source 1..265: mol_type = other DNA
gtggagggaaggagggaggaagttagttaagtttttagygatttagtttagtatatttygaattttgtaaagttttgttyggttttttgtagtttygggygttttattttgttgaggtygttttyggttttttttgatttaggttgggygggaaaggtygggtygttttygtttggtttagatygttggtttattyggygggygygygtagttgtatttagygtagygttattggttttagtttgtagattgygttttttttttt

SEQ ID NO: 4476 - DNA, 259 bp, synthetic construct
  misc_feature 1..259: note = Description of Artificial Sequence: Synthetic polynucleotide
  source 1..259: mol_type = other DNA
gggtygyggggtygggggyggtygtygtttggttgggggatyggggtygtgttgggygtygyggagtygggatagtagtagtggyggyggggatagygtygyggttggggtttygygttttttggagygttttttgtttagataygaygatttygttyggaggtatatyggttttggggataaagattagagagagatgttgtagattttggggttggyggtaaggatttttattyggtttttygyggtttttttttyg

SEQ ID NO: 4477 - DNA, 201 bp, synthetic construct
  misc_feature 1..201: note = Description of Artificial Sequence: Synthetic polynucleotide
  source 1..201: mol_type = other DNA
gagygtagattaggtttttagggygygggagtttgttgtttttttttgtaggggtygttttyggaygttttattygtygttaygtggtttygggatgtgygggttgyggtagagagtgggtagtaatgtttttggttttgygttttygttttagtygyggggatttygaggygagtygttaattggtatyggtgtttygtt

SEQ ID NO: 4478 - DNA, 323 bp, synthetic construct
  misc_feature 1..323: note = Description of Artificial Sequence: Synthetic polynucleotide
  source 1..323: mol_type = other DNA
aygygtttgtyggggaagggttygtyggygtygygttttygaggtttttgyggygaatygygttaygygygatttttggtygggggygggaggyggyggyggyggtaggagaagtttaaggttygagyggttygtagtttttaygtttgtatttttttattttygttagttygatggttygtttygyggygtgtattggagtaagtaggtttygtttygagygygygygttttgggaagtgttgtaagtttggagatttggagtgagtttygggygttgttggttygattgttygyggtgttttttyggtgaggtygyggggg

SEQ ID NO: 4479 - DNA, 201 bp, synthetic construct
  misc_feature 1..201: note = Description of Artificial Sequence: Synthetic polynucleotide
  source 1..201: mol_type = other DNA
tagyggyggyggtygagtttagttygtagggtgggaattgagataggygttttaygttgtttatygyggttgtygyggtygtygtygtygtygtygttayggtygtygttttttgtattttgtyggggtgagayggttgttgaggttgygattgttggggyggttgttgygggggttgtgaygggaggtgyggaggyggtt

SEQ ID NO: 4480 - DNA, 355 bp, synthetic construct
  misc_feature 1..355: note = Description of Artificial Sequence: Synthetic polynucleotide
  source 1..355: mol_type = other DNA
tagygtygtatagaagtygtagagtagyggygtgaagtygyggttyggygygtatygggtygtygygaagtatagtgttattattttgttttgtagygtygtttyggtttttatygtygygtttttataggttattaggtgtygttygtttagaatgttaattatggygtagataygtagttatttgagattygaggatatttgtaggaggatgattatttgyggggaggyggyggygagygtygyggtgtttygtttttgttygtattatygggygttggattttttaagatttgttttagatgygtttatattttggttaggtttygtttgtggttggagtaattgtgttygc

SEQ ID NO: 4481 - DNA, 201 bp, synthetic construct
  misc_feature 1..201: note = Description of Artificial Sequence: Synthetic polynucleotide
  source 1..201: mol_type = other DNA
tgtatttgygtygtttttggtttttttaggaatgygttgaagtttgtaattagttttgtgaagttattgagtgtayggttgagtgaaatttttaaagttygaggaaaaygggtyggttgaatgggagttagtatggggtttttttttaagttttygygttgttaaattttagtagagttttttataatygtttygygyggg

SEQ ID NO: 4482 - DNA, 290 bp, synthetic construct
  misc_feature 1..290: note = Description of Artificial Sequence: Synthetic polynucleotide
  source 1..290: mol_type = other DNA
ttgttatgygyggtagttygygtyggggtyggtattagtagygttygggyggatgtagygagtttayggaggggtatgtttttaygtattaagtataatygttttaggaatgattyggtgatatyggtygatgattttttttatagtttgtyggtgagyggyggyggaggtaaggtttyggyggygygygygatttyggyggyggttttttatttggtgttyggygaggygttgygtaaggygttygaygatgggttyggtagtttgggttatttgttttataaggtgtt

SEQ ID NO: 4483 - DNA, 201 bp, synthetic construct
  misc_feature 1..201: note = Description of Artificial Sequence: Synthetic polynucleotide
  source 1..201: mol_type = other DNA
ttattyggyggaaattygygagtyggttttttygygtttaagaagtttattttttaagtttttttattatgattttgaatgyggataattggggttaaaygaggaaggatatagatttaaaagttagatttaggttttagygygtttttgggttttaatttgggagattygtatttagttyggyggaagttatagttttta

SEQ ID NO: 4484 - DNA, 201 bp, synthetic construct
  misc_feature 1..201: note = Description of Artificial Sequence: Synthetic polynucleotide
  source 1..201: mol_type = other DNA
ttttagygtttaggtygattgygttttgatygggagttattgygtttagygtagttygagggygttgagttyggaggatgyggygyggggygggggtttygggagtaatagagattgggattygagggttyggttygygttgttgtttaygtagygtttttattttggaaagagtgtttttygygyggygggtyggttttt

SEQ ID NO: 4485 - DNA, 288 bp, synthetic construct
  misc_feature 1..288: note = Description of Artificial Sequence: Synthetic polynucleotide
  source 1..288: mol_type = other DNA
gtttaggagaattygtaagttagyggygtttgygttygagttgtagtygttttttgtygtttaygygagttygagagyggttttyggagttygggttagygtygagttgtaggygygygtttaatygttttgttgggtttaygyggtttgagaggtyggagygtttaattgttggtaygygagtaayggtttagttaagtttattyggtttgagaggtyggaggttgygagtgtygttgttgaaggttgtggtggatygggttggatygyggattttgagttatatyg

SEQ ID NO: 4486 - DNA, 212 bp, synthetic construct
  misc_feature 1..212: note = Description of Artificial Sequence: Synthetic polynucleotide
  source 1..212: mol_type = other DNA
ttttgygtggtagatatttagggataggttaattattatttttaattattygtttttgagaggtttaggatttgtttttatttgatggatagtggtgtayggattaaagaygaygtaggataggtaatttttttttttaatttttygggattagggtagttttgaagatttttagaggtagttaagtagttttttttygtagyggggagtga

SEQ ID NO: 4487 - DNA, 201 bp, synthetic construct
  misc_feature 1..201: note = Description of Artificial Sequence: Synthetic polynucleotide
  source 1..201: mol_type = other DNA
gaggtagggaggygggggtgygggaggtttygyggttgygygggygygtgttggtggtttyggyggaggtttagtttyggttygygttygyggygttttygttgyggttygagyggtttggttgygggatttgtgygtayggatggygyggtygtttyggtagtattygggggtttgggygtygttgtttttgttgttatt

SEQ ID NO: 4488 - DNA, 246 bp, synthetic construct
  misc_feature 1..246: note = Description of Artificial Sequence: Synthetic polynucleotide
  source 1..246: mol_type = other DNA
ygtttagtttygygtaygtttttttgygagttyggtygtttagygttttttttygttygagtygtygtttgygtttyggggtagtygttttgtttttagygygatgtggtttygtttggttttttgttgttggggtttggygttygtttygggttgggygattttttagtagatgttttygtygygtaattttagttttygtttttttttygagatygygttyggggttttygggagtattttygc

SEQ ID NO: 4489 - DNA, 201 bp, synthetic construct
  misc_feature 1..201: note = Description of Artificial Sequence: Synthetic polynucleotide
  source 1..201: mol_type = other DNA
ttttttagggatggagtagttaygtttttygagtgtgtttattttatygatggagtaaagtgaggtttttagttygttyggatgtttttgygtygttygyggggtagttttygtatagataygttygtaagttttygattygttygttattygygtttagatattygygagtttttggggtygtagggayggtgtagygtt

SEQ ID NO: 4490 - DNA, 201 bp, synthetic construct
  misc_feature 1..201: note = Description of Artificial Sequence: Synthetic polynucleotide
  source 1..201: mol_type = other DNA
attttagatatataggtagtygggattttygttyggtgygtttgtttatttatttttttgygttaggttgggaygygtttygtttgtaaaaggtttaaaygtatttttygtygyggggygggatttaggggtttaggtttyggggtttagaggygggtaattttgttaattttttttagyggyggggaaygtygygtaatc

SEQ ID NO: 4491 - DNA, 358 bp, synthetic construct
  misc_feature 1..358: note = Description of Artificial Sequence: Synthetic polynucleotide
  source 1..358: mol_type = other DNA
ttaaygggttyggtgtatygttatygyggtttyggtttygttygagttyggttgagtttttaggtygggtttygggtttygggygttygyggggtaggaygtttttygtygaggygtaggggtagttatattgyggggygtttgggygayggygttaaagttagggttataagggtaygggataagyggggyggggggagtaggagattaggatagaggtyggygttygtygygggygtttttaygtygygggtatygttygttyggttttagygttyggggygtaaagtaagggygtaaattttgttygaggyggygayggttgyggtyggggtttattttgaagtygttaggtgtt

SEQ ID NO: 4492 - DNA, 201 bp, synthetic construct
  misc_feature 1..201: note = Description of Artificial Sequence: Synthetic polynucleotide
  source 1..201: mol_type = other DNA
gttgygtgttygtygtttatagtygtagttaaagagaygtaggyggttttaygyggtttggtttatygtygtttgtagtgttygyggygyggggygtttygaggttgggtttatygtttttttygygtttttgaagatttttygggttttttygaaggagtattgtttttttttgtattttttttttagggagttyggtyg

SEQ ID NO: 4493 - DNA, 201 bp, synthetic construct
  misc_feature 1..201: note = Description of Artificial Sequence: Synthetic polynucleotide
  source 1..201: mol_type = other DNA
ygttttttygttttyggttygagyggtygttatygygggygggyggygttgygttygggtgyggtttttygtyggyggyggyggygyggtygagaggtgygggtttygygygggygggaygyggggygttgttygtaggagygattaggtgggygtygggtygatygtagtygtygtygygttttttttygygtttygggt

SEQ ID NO: 4494 - DNA, 201 bp, synthetic construct
  misc_feature 1..201: note = Description of Artificial Sequence: Synthetic polynucleotide
  source 1..201: mol_type = other DNA
gtygaggtttagagtyggtttttgttygtaggyggygaayggtattttgtttygttaggtttttgygggtgtgattygtgattygtagattttttygggygtttttggtttatgaygygggggttgttygttttaygtaggyggtttygggatgttttttygtttagattttagyggtagaaatagtttyggatttttttt

SEQ ID NO: 4495 - DNA, 277 bp, synthetic construct
  misc_feature 1..277: note = Description of Artificial Sequence: Synthetic polynucleotide
  source 1..277: mol_type = other DNA
aggggagtaaaayggagttttygggggtaygtaggtttygtttttgggtgttggttttgtttttggtttttttagtyggtgtagtgattyggaatagygyggtygttttttygaygttygyggttttttattgygtygaggygagygttayggttaaagtttaagtttyggygttygttgygtttgtyggagttttgtttgttygagtaggtagyggggtttaggtayggyggygaygtygaagggttagtyggtagatagggttgggtttttgygg

SEQ ID NO: 4496 - DNA, 201 bp, synthetic construct
  misc_feature 1..201: note = Description of Artificial Sequence: Synthetic polynucleotide
  source 1..201: mol_type = other DNA
tattttgtttttagttygattttttttgygttyggagtttgggttyggygygtaggagattgygtgtattttggygttttygatttttgttagggygtayggggattttagagyggattttttaygagttttaataggaggttagggagtygggatattagagataaattttttygaagttttttttyggttttattgatt

SEQ ID NO: 4497 - DNA, 247 bp, synthetic construct
  misc_feature 1..247: note = Description of Artificial Sequence: Synthetic polynucleotide
  source 1..247: mol_type = other DNA
gtygttatagtygtttygagttygygygtagttttagttgttaygyggattttttgtttagattgygttgttgaagtyggygtttygttttataygggtygygttaattyggtygttgtgtayggtygggtgygaaattttttygygggtttayggggttgtygaggyggggtygtagyggtygtyggggttggggttggtttyggtttgagatagttttatggaaggttaggttttyggtttttgc

SEQ ID NO: 4498 - DNA, 201 bp, synthetic construct
  misc_feature 1..201: note = Description of Artificial Sequence: Synthetic polynucleotide
  source 1..201: mol_type = other DNA
ygtygtttygygygtttyggttatygtygtgtttttttygggygttagggaaggtggttaggtggtttttgttygtygygttttgygtttygygtygttygttttgygttttgttttgttyggttgygttttttygggttttttygtygttatygggaagygtygttyggttttgagygttgygygggttgygygyggggg

SEQ ID NO: 4499 - DNA, 201 bp, synthetic construct
  misc_feature 1..201: note = Description of Artificial Sequence: Synthetic polynucleotide
  source 1..201: mol_type = other DNA
tttgaagtyggyggtgtttaggagygygtygtttttygygtagggtygtttgygggtataygttagygttttttagttygygtygggygttttygyggaygygygtagttttyggttygttaggttyggttygygtagygtagttygyggttatygygatttatygggygggygggyggtygggygggggygggtttggyg

SEQ ID NO: 4500 - DNA, 201 bp, synthetic construct
  misc_feature 1..201: note = Description of Artificial Sequence: Synthetic polynucleotide
  source 1..201: mol_type = other DNA
taggtttggttttagaatygtygggttaaggagaagaggttgaagaaggaygtyggtyggtagygttgggggtagtattttygtaatatgaagygttttygyggyggttttaagtyggataaggatagygtttaggaggggtaggatagygaygttgaggttttttttttyggtaggyggagggatygyggagttyggggg

SEQ ID NO: 4501 - DNA, 356 bp, synthetic construct
  misc_feature 1..356: note = Description of Artificial Sequence: Synthetic polynucleotide
  source 1..356: mol_type = other DNA
ttgatygtgatgataagaaggttggggaggttaagagaaaagggaagagagagtgtagttgtaaattttttttygggttygagaagtatygtttttttgygtgtttaattggtatttgttattaatatgtttgtttttatttaaatggtttagagtaaggttttgattaaattagtatttttaygttaatatttagtagygtttttggtttttggtagattttttttttagttgttaaagtaaaattatagaagygttttggttttatttaaggtttgttggggttttttgttttttttyggagattygaatagttygtagatgtgyggtatttgtttatgttygtgtttygtgtt

SEQ ID NO: 4502 - DNA, 201 bp, synthetic construct
  misc_feature 1..201: note = Description of Artificial Sequence: Synthetic polynucleotide
  source 1..201: mol_type = other DNA
agtygataygygygatgygygagaaagygyggtgtatygggtygttgtygyggtaaaattgtagtaygtggyggtataygttgtttaygyggtygtataygtagygygttttgtgggygttttagttttygyggyggtataggygygagtagtagtaggtgtagtagttgtggtaggatttgaagtagaggtaggygttga

SEQ ID NO: 4503 - DNA, 281 bp, synthetic construct
  misc_feature 1..281: note = Description of Artificial Sequence: Synthetic polynucleotide
  source 1..281: mol_type = other DNA
gggttttatyggggygtagggttggggaatyggagtttygttygtygattyggagtatygtttaygtagattygtttygggygagggaggggtygggygygtattygyggggagggyggygagyggggattagtygaagtygggagaggggygtttttayggggygggaaattggygygygattttgggggaagtgtaggatggggggataggggygttttygygggggtggatgggggattatagyggggttggyggggtaggggtyggygtaygaggtt

SEQ ID NO: 4504 - DNA, 222 bp, synthetic construct
  misc_feature 1..222: note = Description of Artificial Sequence: Synthetic polynucleotide
  source 1..222: mol_type = other DNA
tatygatttttygtgtagyggtttygtttygtyggattttaattattgttttaaggattgggattataatggtttttttgtgtttattattaaygttatyggttaggtgaggyggttaggygggtygygggtttgggggygggtagagagyggygagggyggggttttaygttygttgtattttttttatatttttagtgggatttggtgtgtgatttgggt

SEQ ID NO: 4505 - DNA, 237 bp, synthetic construct
  misc_feature 1..237: note = Description of Artificial Sequence: Synthetic polynucleotide
  source 1..237: mol_type = other DNA
gyggttyggaggyggttatgattatgtatatgaaggggyggtyggtgygtyggttygtggggtagatggtggtgggygtgaagygtttgttggtttygaygaattygtaaagttgttygtagaygygygggaattygtggygtaggaagaygtygygtagtygtagttygygttggatgtggatgaaggttatttygygygygygtyggttygtttygtygttttgatttaggttyg

SEQ ID NO: 4506 - DNA, 201 bp, synthetic construct
  misc_feature 1..201: note = Description of Artificial Sequence: Synthetic polynucleotide
  source 1..201: mol_type = other DNA
ggtttggaatagagattttagttgatttataaggayggggtttgagatttggggttttttgttatagtggtataatttagtttgtattgattaatatagttttttgtgaatttyggttttaatatttaaattaaggtattyggttgttttattaagttgttataygtttatttaaaagtattgttagattgaggaattagg

SEQ ID NO: 4507 - DNA, 364 bp, synthetic construct
  misc_feature 1..364: note = Description of Artificial Sequence: Synthetic polynucleotide
  source 1..364: mol_type = other DNA
gygttygggttttgtagttttttgttgttgttygygttygggtaygygtgtttygygggttgygtttgtatygattygtatatygtggattgtygygatygygggttgtttagygtgttagattttttttttttggaygtgygtaagttgttggtggtyggtaatygtatttagyggattttygaggatttttttattttttayggygatttggtttatttggattttaggaataattygttgygttygttggaggagggtaygtttagyggttyggttaagttygtgtttttygattttagttataataatttgatttagttgggygtyggygtttttygttyggtygggaggttggtgaagt

SEQ ID NO: 4508 - DNA, 201 bp, synthetic construct
  misc_feature 1..201: note = Description of Artificial Sequence: Synthetic polynucleotide
  source 1..201: mol_type = other DNA
tygggataygttttagggaaatygtttttgggtttggtagttgaatttagaygtygagtgtagttygttyggtgygygyggygttttattgttagatttyggaaattagttgttagggtggggtygygttttggygayggttattyggttatttttgtygttttygttttttttaagagatttttttagygggttaatttt

SEQ ID NO: 4509 - DNA, 201 bp, synthetic construct
  misc_feature 1..201: note = Description of Artificial Sequence: Synthetic polynucleotide
  source 1..201: mol_type = other DNA
gttttagaggggagtyggggtggatttttatggaagggagaygtttgygttagtttaggagtggagttygtgttttatyggttttttaaattgygagtaygaaatttttagaggggagttgagttggtgtttygygtgttttttattttttattttttattygtaggttagatttgygttgtttattttaggagggagygt

SEQ ID NO: 4510 - DNA, 201 bp, synthetic construct
  misc_feature 1..201: note = Description of Artificial Sequence: Synthetic polynucleotide
  source 1..201: mol_type = other DNA
tygttttatygatgyggagygygagttgtttattgttttttattatgtttaggattttggtttgggggygagagaggtgataaagagttgtatgatgygyggggggygygyggtygggtattttyggttttatttgttgtgtttttygyggttyggtttygttygygtttygatttttaggtatyggtagygtyggttttt

SEQ ID NO: 4511 - DNA, 222 bp, synthetic construct
  misc_feature 1..222: note = Description of Artificial Sequence: Synthetic polynucleotide
  source 1..222: mol_type = other DNA
agygtatatatatagatataggtttatatagatagattyggttttaaaaataygtattygtagaggtaaaggttagygtataagtaygtatagatatatygataggyggttttyggatatygygttttttgtygtatttayggtttaygtaagggtttatatayggttttayggaggatagttataaaatatttagatataygttatataygtaygygygta

SEQ ID NO: 4512 - DNA, 201 bp, synthetic construct
  misc_feature 1..201: note = Description of Artificial Sequence: Synthetic polynucleotide
  source 1..201: mol_type = other DNA
gtttatatatattagtgaaayggttaaatggtagtattaggtgttaagtgatygtataggygtgtttttgttagttgtgagtaagataaggtagtttatygtttttagggagtttagtttttatgggggtgtattygtttgttagggttgttgtatttaagtattattaattyggtggygttaataatagattttattgtt

SEQ ID NO: 4513 - DNA, 265 bp, synthetic construct
  misc_feature 1..265: note = Description of Artificial Sequence: Synthetic polynucleotide
  source 1..265: mol_type = other DNA
ggygggygtyggyggggyggttttttagtaagatgtgygyggygtygyggggygttttttatttgtagyggygttygggagtygggyggttgggttaggyggygttttyggggttgttgygygttygygtttagagttgtygttttagggagttygttayggtygygtttygggtaygttyggyggygtttaaygatgatygttttttggyggygttttyggagtttggtttgggaatattgggtygggtttttygtgtgygttt

SEQ ID NO: 4514 - DNA, 242 bp, synthetic construct
  misc_feature 1..242: note = Description of Artificial Sequence: Synthetic polynucleotide
  source 1..242: mol_type = other DNA
gttttygtyggyggygttgtattattattattattatatattgttyggtttagtgtagtgatttygygggtygggttttygtyggygygttgtagggygygggygygtagttygttygygyggtttggattttttttgttyggttgttttggattttataaaaaaaaaaaaaagtttagaaattttygaataaaattaaatattyggaygatttttttyggtgagyggygaagatagttygg

SEQ ID NO: 4515 - DNA, 201 bp, synthetic construct
  misc_feature 1..201: note = Description of Artificial Sequence: Synthetic polynucleotide
  source 1..201: mol_type = other DNA
ttttttttygttttttttttgtttttttttttgttttgtggtttttttttttttttttagagatatttgggagttgtttttaagttttggggygtttygyggggttttgttaagggtgygtgtgagagagggyggyggagtyggygtygggtgttaggggtygagggtgggagygggagttygtggttttgygttttggag

SEQ ID NO: 4516 - DNA, 261 bp, synthetic construct
  misc_feature 1..261: note = Description of Artificial Sequence: Synthetic polynucleotide
  source 1..261: mol_type = other DNA
ygggttgtaygygtaggyggtttattyggggggyggyggyggyggtttggtygggatgttggyggygggyggtggyggygyggggtygggtttgtattaygygttgtaygaggatggttaygaggygtagttggagtygtygtygtygtygtatttgggygtttayggataygtatayggatatgtataygygggyggtttgtaygyggyggyggygtatttgtattygggygygggyggyggyggtttatyggtgggyga

SEQ ID NO: 4517 - DNA, 201 bp, synthetic construct
  misc_feature 1..201: note = Description of Artificial Sequence: Synthetic polynucleotide
  source 1..201: mol_type = other DNA
ggggattygygtaggttagygtgtyggttttttttagtttatygttgtygtygtyggggttgttttaagggagttaagyggagtgggagygggtttgygygtttttgttttgygygtaggggygggggggtttaggayggggygtttttttttatttatatgttgatttaggatttttaagyggttyggtttaggatatyg

SEQ ID NO: 4518 - DNA, 337 bp, synthetic construct
  misc_feature 1..337: note = Description of Artificial Sequence: Synthetic polynucleotide
  source 1..337: mol_type = other DNA
gtaagagyggtgtagtygagtyggygttttagaagtygagaggttatataagtttaygtagagaggygtatyggatayggtaattaggagtaatttataygttttygggygtayggaaattatttgttaggaaatttttaaygttttttttygtttatttttttttattttttttttggygygttttttttttttttagaggtaygtagtggagtttttggagtttygaatttttyggatattgtagaatgyggggtttttygggygygggttyggttaattagagygtygtttgttttttttggttaatggtaggygttatattgttgtttaattt

SEQ ID NO: 4519 - DNA, 201 bp, synthetic construct
  misc_feature 1..201: note = Description of Artificial Sequence: Synthetic polynucleotide
  source 1..201: mol_type = other DNA
aagttttgggtggygygtaaaggygtaggygagggtygtygtatagagtygtttaagttgtggtyggagygttagggygatttttgggaattttttaagyggaatttttygagataagyggtttttgttttttgatattttagtygaggtygagttgaygygtagttatttaattttttttgtttyggggaaataatttta

SEQ ID NO: 4520 - DNA, 201 bp, synthetic construct
  misc_feature 1..201: note = Description of Artificial Sequence: Synthetic polynucleotide
  source 1..201: mol_type = other DNA
atgagtygagagggttgagyggagagtgtggttttyggyggttggaggtaggagaatatgttgygttygttygtygyggygtgagaggttygaggtgggygygtyggggtaggggyggtygygggygtttgttygtttagtgggygttgttyggatttggygaggtggtggtttgtaatattgtgttygtattgtttattg

SEQ ID NO: 4521 - DNA, 201 bp, synthetic construct
  misc_feature 1..201: note = Description of Artificial Sequence: Synthetic polynucleotide
  source 1..201: mol_type = other DNA
gtagygtygyggyggttagtagygtygggtagtggattygyggtggygyggygtygggtygyggtgtttagggygggagtagtagtaygaggtttagggygagygtttaggatagygttagtatgttygtygtgtggygtttttggtatagygtttggtaggtggygggygttygggtgatgagtaggtagyggtttaggg

SEQ ID NO: 4522 - DNA, 201 bp, synthetic construct
  misc_feature 1..201: note = Description of Artificial Sequence: Synthetic polynucleotide
  source 1..201: mol_type = other DNA
gttttaggagggaaggaggygayggtgtttaaggaygtyggaagtyggggattttygtttttttygggtttyggttaggttattagtgttggttygyggygygggtgtttagttgygtttgggatattgygggtayggttgtggyggtaayggtagyggtygtygygtygtygaygttyggtaggattgagygtayggagc

SEQ ID NO: 4523 - DNA, 386 bp, synthetic construct
  misc_feature 1..386: note = Description of Artificial Sequence: Synthetic polynucleotide
  source 1..386: mol_type = other DNA
ggtggtatgtaygttttatttaaaaagtagatttttttttgtaattgttagtaagtggaaggatagtaaattttatattatttygagatttgtgygtttygagyggttttaatttygtttygtttgttgttgttgttgttggtgttgtttyggttgtagttgttgtygttttaygatttyggggygttgaggtaatagggttttttttttttattttttatttttttyggtttttttatagaagygtygtttttagtaatttttygtgtattttttatttttgtygtygtttattttattttttttttttttgttttttttttaaatygtttttaagtatatttttygtygttggaagtgattataatgttgttttttaataagta

SEQ ID NO: 4524 - DNA, 201 bp, synthetic construct
  misc_feature 1..201: note = Description of Artificial Sequence: Synthetic polynucleotide
  source 1..201: mol_type = other DNA
tttttygtttttygyggygygygtygttttygggggtttygygttttygygtttaggttttttttttttggygggygtttataggyggygygggtagygygagtttyggagtttyggaggtttgtgygttttgagtyggtatggatttygagtattgygygttttttygygtggggtttgtattyggtttttatgtggttt

SEQ ID NO: 4525 - DNA, 201 bp, synthetic construct
  misc_feature 1..201: note = Description of Artificial Sequence: Synthetic polynucleotide
  source 1..201: mol_type = other DNA
ggggygattyggagttgygygtyggygtaygygatttygttygttttttattttttgttttattattagttttaatttggttttygttygtygygygttyggggtttaggggagyggygyggggatttaggttttayggyggagagagygygygggattgygaagattggggtygagtgtygttttttttgygttttggta

SEQ ID NO: 4526 - DNA, 309 bp, synthetic construct
  misc_feature 1..309: note = Description of Artificial Sequence: Synthetic polynucleotide
  source 1..309: mol_type = other DNA
aggygtagaygttggagttggagyggygttttyggtagtagyggtatttgtttgygttygagygygagtagttggygagtttgtttygttttaygtttaygtaggttaagatttggttttagaattatygttataagttgaagygygttygygttttaggggyggyggagtygtttgatttggtagtattygtygagttgtaygtygygttyggtttgttgygtygygtggtggtgtyggtgtttgttygygaygggtagtygtgyggyggyggyggyggtggygaggtgggaatygtygyggtttagg

SEQ ID NO: 4527 - DNA, 203 bp, synthetic construct
  misc_feature 1..203: note = Description of Artificial Sequence: Synthetic polynucleotide
  source 1..203: mol_type = other DNA
agygtatattgtygttagttagttagtygtygtygtattggtttagtttygaaaatttttaggyggygtagaggtgtttaattttggttattayggygtygygtygtyggtaygtygygtgggttttagatagygttagtygttygggtaygaagaatatttggtttggggattatagygggttatygatygagggtagggtg

SEQ ID NO: 4528 - DNA, 388 bp, synthetic construct
  misc_feature 1..388: note = Description of Artificial Sequence: Synthetic polynucleotide
  source 1..388: mol_type = other DNA
ggttyggttygyggagttagygtttttttygygtygatttygggtttygggyggtygtyggggggygtygggygtatttttygttgttaatttttygttygtgttttygttygygtttgggtttygtygtattttagtagaagttattatagagaataaattatttttttgttttygagatgggttttyggggaggaaggtaaattgtttgtttygtgtataataagttaggygtggagagtagygyggaggaggtygyggtagttatygagygggtagagtttttygtttttattygtygttygygtttgtygagttttttgtygagygggyggygygtaggttyggagaattttaaaaggtttggaatatygggttgtttttyggt

SEQ ID NO: 4529 - DNA, 241 bp, synthetic construct
  misc_feature 1..241: note = Description of Artificial Sequence: Synthetic polynucleotide
  source 1..241: mol_type = other DNA
agttttttatttagatygygttagtgygtttygggttttattagtttttattaggygttgtttttttygtttttatttagtttttttttttygttttttygygagtgtatttaagygttttygttttatttatttttagygtttttttaagtttggaggagygtttagagtagtagaaatagtaggtattttatatygttyggygtggggatttygyggagygtygttgygygtygttttt

SEQ ID NO: 4530 - DNA, 232 bp, synthetic construct
  misc_feature 1..232: note = Description of Artificial Sequence: Synthetic polynucleotide
  source 1..232: mol_type = other DNA
ygtttttttttttagygtttaggttgggggyggygtyggtgttagtttagtttagggygaagtttttagggtyggttygggtygggttgygggattygtygtggagygtaaagtgtttgaagttttygygygtattyggttttgtttttaaaggttttttagaaatgtaagaggttaggygtagaaatatatayggayggtagttttatgagaaaatgtagataaagagttc

SEQ ID NO: 4531 - DNA, 214 bp, synthetic construct
  misc_feature 1..214: note = Description of Artificial Sequence: Synthetic polynucleotide
  source 1..214: mol_type = other DNA
gtttttttgttttygygttttttggattagttttggtggggagttggaaggtatygagtgygtttyggttaagaagggyggatagttttgtgygagtagygttyggttggygyggygyggggtgttttttatgttaaaggaaaggatggattttttgtttgtttagggtttttattttttaaaatttttttaattgyggtattggaagggattt

SEQ ID NO: 4532 - DNA, 250 bp, synthetic construct
  misc_feature 1..250: note = Description of Artificial Sequence: Synthetic polynucleotide
  source 1..250: mol_type = other DNA
ygtagyggggtygttttattgtygtatttttatttygygttttgygygtttatttgtttaygaagttttygagtatygagtttttgtyggygttttggtygtttattayggygatttgyggtagttttagtaggtagttttgttttagygtygaaaaygygttttgtagayggtttattagygggattagtttttttatttttyggttttttattttgttygaggggtyggygattagttggtttttgtt

SEQ ID NO: 4533 - DNA, 201 bp, synthetic construct
  misc_feature 1..201: note = Description of Artificial Sequence: Synthetic polynucleotide
  source 1..201: mol_type = other DNA
tggtyggtgaagttttaggattygttygtttggggttaaggtaaggggtgyggtaygaggagygtagggagtttygagttttaggygtagatttagttgyggattygtygtatagttttggtgttgtaagygtggatygtgggygtaaggtttyggygggaggtattyggttyggtygyggtygggtttgtagggttttgg

SEQ ID NO: 4534 - DNA, 467 bp, synthetic construct
  misc_feature 1..467: note = Description of Artificial Sequence: Synthetic polynucleotide
  source 1..467: mol_type = other DNA
tygggtatyggygggagaggggggagaagyggygtggagaggatttggtaagggtttgtttttaaatttagattatgatttaatattttggaygygaagygaagatgggaaayggtygtttgttgagagggggtatttgtagtttttttagaaaaggttggggtaggagagygtgyggttagaggggtgggggtatyggagggggggttttattttttgttttatagtygggtttttttygygaggygttgggaagtatgaggtatgtagtatttaaaatgttttttgaaaaagayggatttgaagtttttttttataaataygttattgtatttattttttatttagagaygggttgygygtttygagttgtaygggtaggtatttttttyggttttgttttataaggtggggagagyggggttggaygygggagggggygggggggggagygtgagaagaaayga

SEQ ID NO: 4535 - DNA, 201 bp, synthetic construct
  misc_feature 1..201: note = Description of Artificial Sequence: Synthetic polynucleotide
  source 1..201: mol_type = other DNA
ygtatagttagygaagygattygagggttagygaataagygttggattttygtaggtttyggygattttagattyggtttttyggygaagataggaaaaygtgtgtygagagtygttggagggaatygttygtaaatygaagaagaaattaaattagtagygaatatttgtaaattagtgttaagttgtgagtttttygag

SEQ ID NO: 4536 - DNA, 232 bp, synthetic construct
  misc_feature 1..232: note = Description of Artificial Sequence: Synthetic polynucleotide
  source 1..232: mol_type = other DNA
tygggygygggggaggygtgggtgttggggygggygagtttagatttttygtgggttggtttgtgggtgttttttyggaaataaatgaggttgtaggagyggtgatyggtttgattgtttttgggggtttygaattygtgggtggagagggtaaggyggaggtygtggttagtatttttttagtgataatgtygtyggggatttttttttttattttttgggagtattttag

SEQ ID NO: 4537 - DNA, 222 bp, synthetic construct
  misc_feature 1..222: note = Description of Artificial Sequence: Synthetic polynucleotide
  source 1..222: mol_type = other DNA
taygattttaggttygttgatgatygttgtggtatgaatgaggttatygtattyggagaggtggatgtttagatgtggatttaggaaatggttttatttygaaagtttygggttagtgggygtgttttttggttagtgtttttaygttygygttagaagggtagtaggttttygtagggttyggygttttatttattygtgttttttttgttgtttttagtt

SEQ ID NO: 4538 - DNA, 239 bp, synthetic construct
  misc_feature 1..239: note = Description of Artificial Sequence: Synthetic polynucleotide
  source 1..239: mol_type = other DNA
tagygtygygttttaygttygttatygtygtygtygttttagtatatygtaggygtgagtttygtygygatygggagagtttttttagttgtgygttttygaggtatttggtygggyggggaggygtygggtyggggygtataggggttaggygggggygttgttgtttatttttygtttttygggygtgygtttygtttyggagttygtatttygygttygygtttygtttggaagtt

SEQ ID NO: 4539 - DNA, 209 bp, synthetic construct
  misc_feature 1..209: note = Description of Artificial Sequence: Synthetic polynucleotide
  source 1..209: mol_type = other DNA
gtttattygtygtagtagtttatttttgttygttagggagtttagggtagtttttgaagttgttagatttttttaygtaggyggyggygttttgtattgyggagtygygttttgggggagtagtatttttagtttyggygtttygtagttagatagttttttttagggtggtagtatttttyggttagggtgtagggattttyggggyg

SEQ ID NO: 4540 - DNA, 380 bp, synthetic construct
  misc_feature 1..380: note = Description of Artificial Sequence: Synthetic polynucleotide
  source 1..380: mol_type = other DNA
gtttagatagataaaattattttattaaagtgtaatgggagagaggaagaggagtaatgagaaggtatgtgagyggggagaaagaaaaagttygggaggygaaaaygaaatttatttttttgygtttatttttgttagaggtttgtaggaygtgttttaatttggtatttygagtttagaataaaagttaygggggttgyggtatgggtagggggaaggygygyggtggttgaygyggggtaggggttttggygagygygggaggggyggttagtagtygttygyggggttggattgggagtttygtgygatttygggtttggygtttgggtygggggtggttttygggtttttttygggggtygtygaggttyggtttc

SEQ ID NO: 4541 - DNA, 394 bp, synthetic construct
  misc_feature 1..394: note = Description of Artificial Sequence: Synthetic polynucleotide
  source 1..394: mol_type = other DNA
ggtttttttttatgagggtttygagtagatgaggtttaaaagtygttttaaggagttttttttaagtttgattygagtgggygygaatttttatagtagygttaagtagtaggattatagygttagygtttggtttyggaggaaagataagttggagtaygtaagggygattygttttygggggtttyggttaggtatttgtygtatgtatttttttygtggtggtggtatgagygygygyggggygyggggggtaggygaggggattttggtaggygtygaygttttaggtyggattygggggtttttttgtttgtagttttttgttttaatgatygggttgyggggaggggagggtaggtttttttttaggtttttggtttttgtygattyg

SEQ ID NO: 4542 - DNA, 201 bp, synthetic construct
  misc_feature 1..201: note = Description of Artificial Sequence: Synthetic polynucleotide
  source 1..201: mol_type = other DNA
ttyggtttttttatttyggttttttatggggttttygggtttgttygttgtgagtagttttattttggggtgttggygggatggttgtttygtgtagggygttygggagtttagatttygtggaaatgtttggggtttttttttgtttagaggggatagtgagtagttaygttgygatatgtttgagggattyggaygaag

SEQ ID NO: 4543 - DNA, 557 bp, synthetic construct
  misc_feature 1..557: note = Description of Artificial Sequence: Synthetic polynucleotide
  source 1..557: mol_type = other DNA
ygggggaaaggtyggygttttagggyggggaggatttgggagtggagttyggagataaaatyggggttaggtagaggagttagagggaaagttagtaaaygygagttygggtgagagttatyggaatgygggaaygtagtttagtygggaatagggttttygataggggtygttygtggttaggaygyggtygttgaatagaggtygygyggyggtttttgttygagggatttygtgggygggggttatayggaggtygygtayggttttyggggttggygggggtaggtgggaggatttttttygggttygygaatttgatttggtagyggttaggtgtttggaagygtttttaaatgatagggttataaagatatgttggttaggtttgtagttagygtagtaaygtggtttgtaggagygtagaaygaggttagatagggttattyggaygtygtgttgttagtgggtgggggtygggagtaagyggtattggtttggagatttygyggtaggtgattttttttatttgggtagygaggttgaaygatggygat

SEQ ID NO: 4544 - DNA, 212 bp, synthetic construct
  misc_feature 1..212: note = Description of Artificial Sequence: Synthetic polynucleotide
  source 1..212: mol_type = other DNA
ttggagggagttgggggattttggagggtgggaagtggttgattttyggtggtyggatatttatttagagtttgattygtattygtgtttttttggaagygttataattgyggggaaggagtttttagaaatygtgttagttttaatatggygggttaaggtggtttttaaaaattgaaaataaaggttttgaggtgggaaaaaatttagtt

SEQ ID NO: 4545 - DNA, 201 bp, synthetic construct
  misc_feature 1..201: note = Description of Artificial Sequence: Synthetic polynucleotide
  source 1..201: mol_type = other DNA
aatagtttttttyggtttttttagttttgtttaaggggtttggaaatgttygtagttttaagaaaggttttatttaagtataggatggggtggggygggyggggttaagattgttttggggattgaatttattttygtttttagygattttyggyggataaagygtaagtttgtgtatayggtygattgagttattggaaa

SEQ ID NO: 4546 - DNA, 201 bp, synthetic construct
  misc_feature 1..201: note = Description of Artificial Sequence: Synthetic polynucleotide
  source 1..201: mol_type = other DNA
gggggagttaggggtttttygtttggggattttygtgttgggtatttygtaygttttggaygygygtagttttatygggagygaattttgtttygtttgygggtgttayggagaggggttgggaagtygagttagttttggyggygattgggggygtttttggttttttgggggggygggggygygtattgttgtttagga

SEQ ID NO: 4547 - DNA, 294 bp, synthetic construct
  misc_feature 1..294: note = Description of Artificial Sequence: Synthetic polynucleotide
  source 1..294: mol_type = other DNA
tttgaaagtttttgaagyggttttttttttttttttttttttttygtaggtagagttgtggtgtggttgggtggtttgygtgggygttygggggattygygggtattygggaygaggygagggygtagaaaatttggagtttaattagtayggagttgagttttygygttttaatttttaggtgatttygtgyggyggyggyggtagtagtagtggtagyggygatyggagttygtagtagtttygagygttttygggaggataggyggygagttyggygaatygttatttgtt

SEQ ID NO: 4548 - DNA, 244 bp, synthetic construct
  misc_feature 1..244: note = Description of Artificial Sequence: Synthetic polynucleotide
  source 1..244: mol_type = other DNA
ggygggygtgagyggyggaggagtygggygyggygataygyggttatggagygggagtyggyggggatygaggagttygggttttygggayggyggaggygtygagagggtaggaygygtayggtgygttttaatttgttgtygttttygggygtygaggattttgyggttggygyggttaagggygagyggygayggyggygygggtgtgtttagtatttggtygataatyggtttaagatta

SEQ ID NO: 4549 - DNA, 303 bp, synthetic construct
  misc_feature 1..303: note = Description of Artificial Sequence: Synthetic polynucleotide
  source 1..303: mol_type = other DNA
yggggtagtyggggtygggagagygggygtagygyggyggggatyggagtygygggygtygggaaaggttttygttaggaggggagggaatttygggagygygagttagggggaggygygtyggaaagygagagtgataagtagtttataagtygaaaagtttttygygggaggygygygtygygtgggtttygatttagtygttgygygtygtygtggtatataggttgaaaagtttgygaagttatagaagttaggttyggygtttagggggttttgattttgtttttatggttttagatt

SEQ ID NO: 4550 - DNA, 286 bp, synthetic construct
  misc_feature 1..286: note = Description of Artificial Sequence: Synthetic polynucleotide
  source 1..286: mol_type = other DNA
ygyggaggttggttttggtagtggttagggagtggagaaagtaaattagagtyggttyggttatygattttgygaagttttttygattttagtttagygygggagggtggyggaaggtggtgtatygtagygtggttttygtygttgtygtygyggttttgtaaagtgttagygggggygaaagygagagtttaaaggaataggaggtttattgaattttttatyggagtttttaggggttttggttttttagtttgtttttgtttttttagttyggggatttgtt

SEQ ID NO: 4551 - DNA, 261 bp, synthetic construct
  misc_feature 1..261: note = Description of Artificial Sequence: Synthetic polynucleotide
  source 1..261: mol_type = other DNA
gggaatygagaagaggaagaagygaaygygagtaggagygtagygtttttyggatttttgaggttttttttgtaatttgttatattygtagtttttattygatattgaataataatygyggggaggagaggttatttgtagtygaggttygtaaattgtyggttttattygggtagygttaattyggtgttygyggayggtgattttygagttttagygatgygttttattgggtttaaaatagatttaattttatagtta

SEQ ID NO: 4552 - DNA, 201 bp, synthetic construct
  misc_feature 1..201: note = Description of Artificial Sequence: Synthetic polynucleotide
  source 1..201: mol_type = other DNA
tattgaaaggtagaaatggggagtaggtatttagttygyggtgggtagggttttaggaggtagttttygttyggygatagttttyggggygtaatttttygtaggaygygtatttgttaggatagttattaagaggatgyggaggttgggggttttttyggggataaaattagggtattttaaggaattttttgygygttt

SEQ ID NO: 4553 - DNA, 201 bp, synthetic construct
  misc_feature 1..201: note = Description of Artificial Sequence: Synthetic polynucleotide
  source 1..201: mol_type = other DNA
gttggattgggtgyggttgtatttgtggagtgggtggttyggtgattgttattygggttagtgttgttagtagatgtgtatattttgggygggggttggyggtygagtgttattagtaggggyggyggttaggtagttattygtygttttttaagttyggygttgygygtagggtttggagtattyggtgttgagaygyga

SEQ ID NO: 4554 - DNA, 201 bp, synthetic construct
  misc_feature 1..201: note = Description of Artificial Sequence: Synthetic polynucleotide
  source 1..201: mol_type = other DNA
taagttgttttttgttttgggtttttgatatttttatagtttttgaaagggttttyggagattttagagagaggygggtgtygaggggttaygagttygyggttgatattygygttgyggaagagaatggtattgattgagggttttggggatttgggttttggygttttggattttaggattatgtatttttyggggygc

SEQ ID NO: 4555 - DNA, 201 bp, synthetic construct
  misc_feature 1..201: note = Description of Artificial Sequence: Synthetic polynucleotide
  source 1..201: mol_type = other DNA
ygttyggttygygggttttaattttatygtygtyggtygaattttgttygttygyggygygtatagtyggygttygygtataygygygtataaattttaygtaattygyggtygtttygtttygtygtygtygtagttygtttgtygygygtttatagttyggttygagtygyggggttygagygatagygayggygtygg

SEQ ID NO: 4556 - DNA, 201 bp, synthetic construct
  misc_feature 1..201: note = Description of Artificial Sequence: Synthetic polynucleotide
  source 1..201: mol_type = other DNA
ygttyggygtagagtygyggtttttttgtttgygttygtagtttgygtygttygatatagtgggggtggaggtagttygtttagttgggygttttggtgyggtgtygygtttaaagttttatttttgygtygagggtttgtgatttgtagagagygatygtttgattttaagttggttgtagagygaggttagtygggata

SEQ ID NO: 4557 - DNA, 201 bp, synthetic construct
  misc_feature 1..201: note = Description of Artificial Sequence: Synthetic polynucleotide
  source 1..201: mol_type = other DNA
tttygaggtgagtygtygttgygtttatttgttttygtagttggattgtggagtygygttyggaggagygttggatayggatatttttaatttttttttygatttygttttttggttttttgtatatatattttygttaggaggggaggggaaggtttagtaattgtttggtttggttttgatttatyggttttttygtag

SEQ ID NO: 4558 - DNA, 201 bp, synthetic construct
  misc_feature 1..201: note = Description of Artificial Sequence: Synthetic polynucleotide
  source 1..201: mol_type = other DNA
gygtygtttaygttattygttatttygggtygyggtttyggttygggtttagtggttgygtygtttttygttagtaaygttygygyggaatgagygygtygygttgttygygtttttattygtagggttyggygtttttttttygttygtygtttttatagtygygygtttattggttyggttagtttayggggagtygyg

SEQ ID NO: 4559 - DNA, 201 bp, synthetic construct
  misc_feature 1..201: note = Description of Artificial Sequence: Synthetic polynucleotide
  source 1..201: mol_type = other DNA
gyggaatttygyggtygagagtyggtyggtttagttgggyggggatayggyggtttygggtttgtgttttagttttagtygggttttttygygtygttgyggttgttgygyggtgyggtygtgataagttatagtaaatttgtttttygygtygttttaagttattaggaagygtaatyggtgtttttggggatyggygaa

SEQ ID NO: 4560 - DNA, 344 bp, synthetic construct
  misc_feature 1..344: note = Description of Artificial Sequence: Synthetic polynucleotide
  source 1..344: mol_type = other DNA
ttttgattagatgaayggagtggtyggaggtaagtygygtgttttygtaggttyggatttgygyggttyggaggtggtggatggggtgtagtgggtgtgygggaatygtaggagaggattggggttttaggtggayggtgttgattgtattggttttgaagattggaagtgggtgtaggaggaatttgygatagttgagattagggygygygggtagatgygttaggtygttagtaaatyggygtgygtgygtttyggygygtttagtttygggygagygtagggatgggggtggaagaggygttttttygggtttygaggtttgygtaggttttttggtyggt

SEQ ID NO: 4561 - DNA, 201 bp, synthetic construct
  misc_feature 1..201: note = Description of Artificial Sequence: Synthetic polynucleotide
  source 1..201: mol_type = other DNA
ggygtttgttygaggygggagtygttgggttatgtttttgtttattaggtttttygaatttttggtagggtagygtttgttygtgttttygatttttttygtaggtaattygygygaatttggggttygtagagagygagygttygyggatatyggttgaatagtttggaggttgygygagggggygtygyggggagggat

SEQ ID NO: 4562 - DNA, 218 bp, synthetic construct
  misc_feature 1..218: note = Description of Artificial Sequence: Synthetic polynucleotide
  source 1..218: mol_type = other DNA
ygggtgtygtggtgyggggtggggatagttaatttagyggggayggaggaagttgggggtagttgggtgygtgttttgtatygtttatttgtyggggttyggtttttggyggtgggygagagggagtatattygtttatattttaggaatttgttggggagatgagttygtggggttagaaagaagggaaaaattttttgggtaagggagagaataat

SEQ ID NO: 4563 - DNA, 234 bp, synthetic construct
  misc_feature 1..234: note = Description of Artificial Sequence: Synthetic polynucleotide
  source 1..234: mol_type = other DNA
ygttgttgttygttatygtygtygtygttyggttatygtatygtatatattaattatttatygttygtttttagtttttygggygaagttaattataggyggaggtttygttaatggggtygtygtygtygtygtygaggaggtagttagtygygygttygggygtaagygatagttttttagggayggggatgggtygggggygygyggggggygggggygtayggggygygt

SEQ ID NO: 4564 - DNA, 201 bp, synthetic construct
  misc_feature 1..201: note = Description of Artificial Sequence: Synthetic polynucleotide
  source 1..201: mol_type = other DNA
tgaggyggagagaggtygtttygygtttggggttttygaaagyggttagttgtttttttgttttttttgagyggggagygttgygttttttgygggttgygggagatttttttagattttygggtgggaaaattatattgagygtttygggaggttgttagatataatattgtatttggtatttttgttygggtgttttyg

SEQ ID NO: 4565 - DNA, 201 bp, synthetic construct
  misc_feature 1..201: note = Description of Artificial Sequence: Synthetic polynucleotide
  source 1..201: mol_type = other DNA
agttagggtygggggygtaygtyggaatatttgggtygtygggtatygagygtyggggggttgygyggygygtatttggagagggygtagttatgygggyggyggyggygggggggggygtgyggayggtygygttggygttgttgttgggggygttgtattgggygtyggygygttgygaggagtaygattattatggtt

SEQ ID NO: 4566 - DNA, 235 bp, synthetic construct
  misc_feature 1..235: note = Description of Artificial Sequence: Synthetic polynucleotide
  source 1..235: mol_type = other DNA
gtaggggtgttttgttygtaygtatttaygatagtgagtagtatgttgtttagtagtagygttaggaataygatgaataggatgagttttygygagyggyggtttttttgtagttagyggattagygttagttygtttagggttatggtttyggggtttygttgygggygyggtgygyggtgaggatttaaggyggtygtggattttttattttttygttttttaggtygyggaa

SEQ ID NO: 4567 - DNA, 201 bp, synthetic construct
  misc_feature 1..201: note = Description of Artificial Sequence: Synthetic polynucleotide
  source 1..201: mol_type = other DNA
ttttttaatagggygygttggttygygagtyggaggaattttygtttaggttttgttaagygtttattyggagtaggtygggggtagtgaaggatgyggygggagyggygygttgtagtttygygaygtggtaygtattttggaagygatgatttagatatyggtagyggtggatgagttaggggtagaaggtggayggat

SEQ ID NO: 4568 - DNA, 241 bp, synthetic construct
  misc_feature 1..241: note = Description of Artificial Sequence: Synthetic polynucleotide
  source 1..241: mol_type = other DNA
agttttyggttygaggttgygttaattyggygtyggatgttaatgatgaaattaaaatgttatttaagttaaatgyggggagtatayggygattgggygygtataatggtaaatgggattaggtaggygaaggtttagtygagtttyggtttygtagtygttttygttatygtttttttttygttttttttyggattttggygttttggtttygggttataagagttygttygttattggt

SEQ ID NO: 4569 - DNA, 201 bp, synthetic construct
  misc_feature 1..201: note = Description of Artificial Sequence: Synthetic polynucleotide
  source 1..201: mol_type = other DNA
gaygatttgggtgatttgggtggaaggtggtgtagtaggtaggtagtggggaggggyggggaggaaatttagggggagggggygtygaggttggtgaggygtttttttygygttagggatatgtaggtatyggatggttgygtaggggtttttgttygtttggttttgggtgygttygtttagtttyggtgtaaatgtttt

SEQ ID NO: 4570 - DNA, 201 bp, synthetic construct
  misc_feature 1..201: note = Description of Artificial Sequence: Synthetic polynucleotide
  source 1..201: mol_type = other DNA
tygtttygatttattaggygygtagggttygttttygaaattygygygggttttygtagtyggtygygyggtttttagtygygaagagagygtygygtayggtggygtygttatagtygtgggtygtygygtttaggtagygttttagttgttygtaaagtttttgtagygtygtttygtyggggtttaygygygtyggtt

SEQ ID NO: 4571 - DNA, 217 bp, synthetic construct
  misc_feature 1..217: note = Description of Artificial Sequence: Synthetic polynucleotide
  source 1..217: mol_type = other DNA
ttaaggttggtttgtgttagaayggygygygygygygtaygtaygtatatatayggggggaaatttttttaaaaatgaaaggttagaagagtttagyggyggygygggygttgygygagggtttyggagttgattygtygaggtaggaaattttttyggtygygaygttyggtttyggttyggygttygygtgggatggtgtagygttygtygtygg

SEQ ID NO: 4572 - DNA, 201 bp, synthetic construct
  misc_feature 1..201: note = Description of Artificial Sequence: Synthetic polynucleotide
  source 1..201: mol_type = other DNA
ttatattgygtaagagatygtaatgaagttygtagatttttaggttggagtygtagagygaggtggygaggtggagaaygyggggttgggtttggatagyggttttggggtygtttggagttttygtttttttaattyggaaggtagyggattgatatttgygtygaagtygygygtattttayggagggtygggattttg

SEQ ID NO: 4573 - DNA, 201 bp, synthetic construct
  misc_feature 1..201: note = Description of Artificial Sequence: Synthetic polynucleotide
  source 1..201: mol_type = other DNA
gaggggtggttttgttttatttagggggtgtygtgggtaaaggttttggggttatttgtttggtgttttggagggygtagggtaggagtygtygaggttygygggttattgtggggygyggaattttagattaggtattygyggtttaattttygggttaggggattygygggggttttaygaatttgtttggtttatttg

SEQ ID NO: 4574 - DNA, 201 bp, synthetic construct
  misc_feature 1..201: note = Description of Artificial Sequence: Synthetic polynucleotide
  source 1..201: mol_type = other DNA
attyggggtyggaggtaggygygtaattatggggatyggggygggygatggyggygggygggtttttgtygtagggtggggatggtttttttagtygggyggtygtygttatattgtagagygtatttaaagagatatttygtttygygttygttttttagtattagattttygttygaaaaygtygtygggyggattgta

SEQ ID NO: 4575 - DNA, 317 bp, synthetic construct
  misc_feature 1..317: note = Description of Artificial Sequence: Synthetic polynucleotide
  source 1..317: mol_type = other DNA
tatygttygggttttygtttggttatagtattaggttatagtgygttggtttttgattatttttttggttyggtggtygtttttygtttttttttagttygygtygttgttttgttttaggtttyggtgyggttttaagttttagtttagggtttttaggtttttttaggyggyggtggyggtatttatttgggtygyggagtyggggtttggtayggtttygtaggtggtaaatgaaattttggtagttgtygtgttttagggttttaygggtatagagttyggttagtagttgtagygtttggtgatagagygyg

SEQ ID NO: 4576 - DNA, 221 bp, synthetic construct
  misc_feature 1..221: note = Description of Artificial Sequence: Synthetic polynucleotide
  source 1..221: mol_type = other DNA
atttatagygaygggtaattaygygggaggagtaggttaattttygatagtggaggtgaagatgygtgygtttygygtattttgtttttygygygaygtygttygygtygttygyggttyggtygggagyggtagttygtgtttyggtttyggtttyggtttyggttggygtttgtatttgygattatygtgagtagttatggygtattttatagtgtaga

SEQ ID NO: 4577 - DNA, 201 bp, synthetic construct
  misc_feature 1..201: note = Description of Artificial Sequence: Synthetic polynucleotide
  source 1..201: mol_type = other DNA
gtgggyggttattatttttttagagtatttggtatatygggttggggttygtattygtagggtattgyggggyggygttyggtgattgggtggggtygtygttgttttttttttygttgggggyggtagttttttgtttgygyggaggygatttagaaggtaygttygttagtaggagggygggygtygtagggttttygg

SEQ ID NO: 4578 - DNA, 201 bp, synthetic construct
  misc_feature 1..201: note = Description of Artificial Sequence: Synthetic polynucleotide
  source 1..201: mol_type = other DNA
gttttttygaaayggagatttgttatttttttagagggyggggaagtttatattattttttgttttatagtgttygtttygtttygtttgttggtttttygtttattygagatattttaggtayggttygtattggagagggtygygttgttgttgygatygtayggygttyggggtaggaatatgttygtttttttttgc

SEQ ID NO: 4579 - DNA, 201 bp, synthetic construct
  misc_feature 1..201: note = Description of Artificial Sequence: Synthetic polynucleotide
  source 1..201: mol_type = other DNA
atygaagttaggtggaagtaaatgagtttggattttgaggygygtttggtttggagtygttaaatttgttagygggyggygggggaggtggttyggtagygtygggtgttgygttygtatatgygttygggaaggtagtttyggtygtttygtttttagttygttttttatygttggygyggyggyggyggygtggggttc

SEQ ID NO: 4580 - DNA, 201 bp, synthetic construct
  misc_feature 1..201: note = Description of Artificial Sequence: Synthetic polynucleotide
  source 1..201: mol_type = other DNA
tgygttttttttttgttatttygatgttgggagtggygttttggttttggygttttttgggtaagtattagtyggyggtatttgyggaggtggttggtaygttgttattttttgaaatgagtgaggagggaggtttagatttaggyggttttaygygttygttttggtattagtagattgggaattgtygtggttatgttc

SEQ ID NO: 4581 - DNA, 230 bp, synthetic construct
  misc_feature 1..230: note = Description of Artificial Sequence: Synthetic polynucleotide
  source 1..230: mol_type = other DNA
tttttyggttgtagaaygtttttygttgtyggagaaggggtttagtaaaattgatttttttttatttgtttttatttataattgatggggagatgagaaygtaatatattttagtatygagtttttgtygtttggyggagattttgtttaagaygttttygtaaagtatttttagtyggggaataaagtayggaaagttgttgggtagagyggtygggaggagatatygg

SEQ ID NO: 4582 - DNA, 201 bp, synthetic construct
  misc_feature 1..201: note = Description of Artificial Sequence: Synthetic polynucleotide
  source 1..201: mol_type = other DNA
gatagtggtagaggygatygtttttttttttattatttatattttagttttagatttttttttttttttttyggtgatattaagttttagatyggyggtygtatttggttttatagtgtaaaatgtgtttggygaggaagtygaggyggygttgtagtagttgagygtgggggtttgtaagggyggttagttyggggaagc

SEQ ID NO: 4583 - DNA, 201 bp, synthetic construct
  misc_feature 1..201: note = Description of Artificial Sequence: Synthetic polynucleotide
  source 1..201: mol_type = other DNA
ygaaggttatyggttgygttttgaagygagattggygyggtygtygtagtyggtttyggtttttgggtagtttggygggtygtaygggttgygggaattygtyggttaggtataygaagtgyggtattatygtttggtaattggagtagatgtttattagttygtygggtttggyggttatggygttttyggygtttgygg

SEQ ID NO: 4584 - DNA, 201 bp, synthetic construct
  misc_feature 1..201: note = Description of Artificial Sequence: Synthetic polynucleotide
  source 1..201: mol_type = other DNA
tgttgttgttgttgttgttggygttggyggygygygyggayggtttggagttyggyggyggtttygggtagtgggttygttaygygygttgggygggygyggygagtagyggygagtttagttttagtttgygtattaaygttaygygygygttgttgttttatttggaygayggyggygattgygattttttggagttgt

SEQ ID NO: 4585 - DNA, 201 bp, synthetic construct
  misc_feature 1..201: note = Description of Artificial Sequence: Synthetic polynucleotide
  source 1..201: mol_type = other DNA
agtttygagtygttagtttttaggtttgggggtygtygttttyggagttgttggygtttattygtttygygttggagatgtttaatygyggtygggttgyggggaygygggtygtgttgggttttgtgygyggtygygttygtygggtgaggaygygtygggggygggggygttaggttygggtttaagggataggagttt

SEQ ID NO: 4586 - DNA, 201 bp, synthetic construct
  misc_feature 1..201: note = Description of Artificial Sequence: Synthetic polynucleotide
  source 1..201: mol_type = other DNA
ttttgaygyggggttggggaygtagatatttttggtttyggtagtttagygtaatttttgaggtygggygtygtttttygtttttagaaattygggtttygagygtygaattttagygttttygttygtgggtatagggygygyggtgtagttatagggggttygagataygygtttyggtttggtttaggttggggaatc

SEQ ID NO: 4587 - DNA, 201 bp, synthetic construct
  misc_feature 1..201: note = Description of Artificial Sequence: Synthetic polynucleotide
  source 1..201: mol_type = other DNA
yggygattatttgttgggtattaagyggttgyggyggttttattgtaaygtgggtatyggtttttatttttaggygtttttygayggtygtatyggyggygygtaygyggatattygygatagtgagtggygyggttaggygygaaggggygggggyggggggtaayggtygtygggttaattygtttagttatattttga

SEQ ID NO: 4588 - DNA, 201 bp, synthetic construct
  misc_feature 1..201: note = Description of Artificial Sequence: Synthetic polynucleotide
  source 1..201: mol_type = other DNA
gttgtattaagttataattttatttatatggtgtgagaattttttgggttttttttttttagtaagatttggtattttttgatatttattagtttaatgygtgggaaatggtgtttttttttaatttgtattttttttgatttatagaaagttgtttttagtttyggtttatygattatttagttttttattttttgaatg

SEQ ID NO: 4589 - DNA, 201 bp, synthetic construct
  misc_feature 1..201: note = Description of Artificial Sequence: Synthetic polynucleotide
  source 1..201: mol_type = other DNA
gttttttyggtattygtagtttygatagtttagttttttttatttgaaagttttatttgaggttttttttaattttgtttttttgtatttttggygtygyggggagttaggggttaaatttygtggttygygtggtttttttttttttygtagttttttygtttttattyggygtygygtttggagygttygtttyggaga

SEQ ID NO: 4590 - DNA, 201 bp, synthetic construct
  misc_feature 1..201: note = Description of Artificial Sequence: Synthetic polynucleotide
  source 1..201: mol_type = other DNA
tttygggggtgtygagtyggyggggggtgaggtggttgygtyggyggtygggttaggaggtgygggtattgggggygygggaggggaygtggtaggtttygygggggttayggygattttaggggttaggaaggtttygttgygggtaygtaatttgttttygtttttttttayggagtygtttygggtaggyggyggygg

SEQ ID NO: 4591 - DNA, 268 bp, synthetic construct
  misc_feature 1..268: note = Description of Artificial Sequence: Synthetic polynucleotide
  source 1..268: mol_type = other DNA
agttggygttggataagtygggtaagtygaagyggaaggtgaattatygtaagtatttgtagaagtagattaagygttgtagyggttttatgggygtygygtttttyggttygtttttttygagygtygtygataygttagttaaayggtygttggtygtttttagygtttygatagtygyggtttyggtttayggtaaggttgtttttyggygggaggygtygtaggtygtygyggtygttagtttgtaaagtygaagtttggtygc

SEQ ID NO: 4592 - DNA, 614 bp, synthetic construct
  misc_feature 1..614: note = Description of Artificial Sequence: Synthetic polynucleotide
  source 1..614: mol_type = other DNA
atyggtyggggttgttgtygtygggggtttgggttttttagttagttgtggattaaayggtttttttttatttaaattaattgygttaygygtaggyggygtaygggttgggtttgggaatggggatygygaggttttagtatttygatgttttgaaagttttttygtttyggggatttgtttttgtgttgtagttggtaggggtygtttgaagtgggagtagygtttggagaaggygggaggagttyggttygggggaygggyggygggatagygggatttyggyggygyggtgygttttagggygtagyggyggtygtagatygagtttygggygyggtaagaggyggygggagtyggtggyggttyggtattatgygtygagggygtttgttggagatygttttgggatttatygtgtttttagygttttataygagttatggggyggaygttaatttggaggttgggaaygtgaaggaaattagagttagtygggttaagagaagaggyggtggaggataygaygygtttaaagggtaaaggaatyggtttttttttttggtgtgggttttttaagttttaagatttagaataaygggtaggatgatttt

SEQ ID NO: 4593 - DNA, 201 bp, synthetic construct
  misc_feature 1..201: note = Description of Artificial Sequence: Synthetic polynucleotide
  source 1..201: mol_type = other DNA
agatgtattttagtttagygatttttattggyggaattttygygtttatygygygtygygttaagatggtttaggttatttttattgttttttygttagygttttttagttttttatatttgttttgtatatatattggtttgtagaggggattygtttygaatygttygggagtggggtttgagttyggagttggtgttt

SEQ ID NO: 4594 - DNA, 201 bp, synthetic construct
  misc_feature 1..201: note = Description of Artificial Sequence: Synthetic polynucleotide
  source 1..201: mol_type = other DNA
gttttgttttttttataagaggttaagtygatattaygygagtgtgtaygygttggggattgagttttygaagygaagttttgtyggaggagttttaggygggagtgggaayggttgggygtggggttagtaayggygttattyggtagggtggggggagttaggtttgttagagttagagygygttatygtygtygygag

SEQ ID NO: 4595 - DNA, 201 bp, synthetic construct
  misc_feature 1..201: note = Description of Artificial Sequence: Synthetic polynucleotide
  source 1..201: mol_type = other DNA
gtattgyggagtagygaggtagygygtaagtaagttagggtaggggtygggggtaggggygggggttggagttatggttaggggtggttgtttaggtygygtgagttgttttttttattygtatttggtygttaggttattyggttattagaagtttttatttatattttgttttttatttggatygtyggttggttgtaa

SEQ ID NO: 4596 - DNA, 201 bp, synthetic construct
  misc_feature 1..201: note = Description of Artificial Sequence: Synthetic polynucleotide
  source 1..201: mol_type = other DNA
ggggatyggtygtagggyggggttttttttggyggtgagtgagygagatygttaggttgaagtatygggagattgttttggtagtttttggtygttattygygtygtaataaaagtttttygyggtttttygtttagttagtttygtattgattggtygtygtgggagggattygagttggttggaggyggyggtygagyg

SEQ ID NO: 4597 - DNA, 201 bp, synthetic construct
  misc_feature 1..201: note = Description of Artificial Sequence: Synthetic polynucleotide
  source 1..201: mol_type = other DNA
aagtttyggygygyggygttygttgggyggtgygttttttttyggttttttatttatygtagtygagtygggtattgtggggtgggtgtgygtgtttgtyggggggtgtgtgtttgtgtyggggaggggtgttgttggggaattgttgtttttygtattayggyggtagygatagtatygttyggtagttygtagtattyg

SEQ ID NO: 4598 - DNA, 261 bp, synthetic construct
  misc_feature 1..261: note = Description of Artificial Sequence: Synthetic polynucleotide
  source 1..261: mol_type = other DNA
gygttyggtttaagtayggtgygagygtttyggggaggyggygagygagtyggtgyggagygtttygtgygttygggtggtttygygggtyggygggatygtgygtattttaagygygtgygggagtgtgygaggygttgtgygagttagyggygggygygttagggtgggaaaggtatttygaaygtattaggtgtagagatyggtatttatygagagyggtygggagygtayggygagtttyggtgttatygtyggttt

SEQ ID NO: 4599 - DNA, 201 bp, synthetic construct
  misc_feature 1..201: note = Description of Artificial Sequence: Synthetic polynucleotide
  source 1..201: mol_type = other DNA
gtttgggttttaggttatygtagaggaygtgttttygggygygtagatggygggagatgaggyggtygaatttygygtttttgygtggtggagtatataygttttaataagtttagygttatttgtttagttttttaatttttttttttttygtttyggggyggtttttttttttttttgttttggttgttgttttggtyg

SEQ ID NO: 4600 - DNA, 201 bp, synthetic construct
  misc_feature 1..201: note = Description of Artificial Sequence: Synthetic polynucleotide
  source 1..201: mol_type = other DNA
ggtttaygtattgttygtyggtttaygygggagtttygaggggygaggyggaggttgggygtagtttttgtagttagtagttattttygygygtttygtygyggtttagttaattatttgttgyggyggyggtygtgttttttagggtgtattagtattttygtygygggygttgttttygyggygtyggtatygatgttc

SEQ ID NO: 4601 - DNA, 201 bp, synthetic construct
  misc_feature 1..201: note = Description of Artificial Sequence: Synthetic polynucleotide
  source 1..201: mol_type = other DNA
taggtagtttygygtggyggyggtygggatagttgggygygttggtaggagagtaggtatagygttttttataggtaggatgaygygggtttygtagttygtttttttaygttgtttygtattattgtttyggttttgaygtgygtgygatagatttatygtaaatagtttttagygggagtaygaggtygggataggagg

SEQ ID NO: 4602 - DNA, 201 bp, synthetic construct
  misc_feature 1..201: note = Description of Artificial Sequence: Synthetic polynucleotide
  source 1..201: mol_type = other DNA
atatagttttaagggattgagyggttyggaygggatttgaaatttttggaggattagttaygttygtatagttygtttatgygygttggtattaggattygtaggttgttagyggygagttttygtygyggttttttagggtattttyggagaagggggyggttttgaggaattttttgtatttyggatgttttatttttt

SEQ ID NO: 4603 - DNA, 219 bp, synthetic construct
  misc_feature 1..219: note = Description of Artificial Sequence: Synthetic polynucleotide
  source 1..219: mol_type = other DNA
gtygtygttttttygggagtyggagtygtygtttttttagtgggtgtagtyggggtttygaygggggtygggyggttatyggggttggagttgyggttayggaggtttttgygtttgygtygygtygagggtagggatagggattggggtgaggggttgtttyggaaygtttatagttggygttggtttttttttgtttgatagttttttggttygggg

SEQ ID NO: 4604 - DNA, 268 bp, synthetic construct
  misc_feature 1..268: note = Description of Artificial Sequence: Synthetic polynucleotide
  source 1..268: mol_type = other DNA
ttagtygtyggygaggttattygggaggggygggagtygtttgttagttattyggtagtttttttggggtttttttygygygttygtttgtttttttttygttgygttttttygtttgttggygtttttgttttagygggattyggtagttaggggttttagggggyggtgtagtaaatttttagyggtttgygtttagtagattaggttggggagtyggtttggygttgtagggaggtagagagygggaggaagaggtagtggtagg

SEQ ID NO: 4605 - DNA, 201 bp, synthetic construct
  misc_feature 1..201: note = Description of Artificial Sequence: Synthetic polynucleotide
  source 1..201: mol_type = other DNA
ggttgttttygggygtattttgyggttygggtatttgtagggygggtagyggtyggttttttattatgttggtygtyggtatgggggtygtygtttttgygttttttttgagtttttygttagyggtttggttygygtttttttttggttgttttttattttyggtttygyggtatattttttaattttggggtygaagga

SEQ ID NO: 4606 - DNA, 517 bp, synthetic construct
  misc_feature 1..517: note = Description of Artificial Sequence: Synthetic polynucleotide
  source 1..517: mol_type = other DNA
tagygtttattgtyggggaagattyggaygaaaatygaggtaaattaattattaaaaagtgtatttaataagaatttttttatttaggtttttygttgtygagaygyggtagatttttagagyggtttatttatttatygaagyggattttgggyggtttygggttgattygygttgttagggygyggattttatttygggygtattgttaggagaaggggtttttyggggyggygygtttygattttgggttttyggtgttygtagagggyggagattygyggygttttaggttatttattygtattttttygagttaaatttttagygtttattyggattygayggtttaagtattgatttttaggtaagagtygttttttttggtttttagggaattgatattatygygggaygttttttttaggatagttagtaggttttaggagygtagtaygtaatagygtagagtagatttagatttttttyggggtgagattyggaggttygygttttg

SEQ ID NO: 4607 - DNA, 226 bp, synthetic construct
  misc_feature 1..226: note = Description of Artificial Sequence: Synthetic polynucleotide
  source 1..226: mol_type = other DNA
ygtyggggggttttgtttttygggaggagaaggaatyggtygttttygtttttttttttttttaggygttttygggagggggtygttgggyggyggaatygygttttygttyggggagttattaygyggttttttygyggaattttgaygttatttataygtgggggaaggggttgggagagtaagaggaagyggygggggagggggtygyggttgggagagygyg

SEQ ID NO: 4608 - DNA, 201 bp, synthetic construct
  misc_feature 1..201: note = Description of Artificial Sequence: Synthetic polynucleotide
  source 1..201: mol_type = other DNA
atttyggaggtagagatgagagygttttaaaattttttttttttattttaattttygaggagtaggtgggtgtatagtgtyggyggyggyggggaygygyggygyggagtttggttttgggaggtagtggtygttttagtagtygaatttttygyggttttagttttygygtttagtagttygyggttygtttttyggaaa

SEQ ID NO: 4609 - DNA, 212 bp, synthetic construct
  misc_feature 1..212: note = Description of Artificial Sequence: Synthetic polynucleotide
  source 1..212: mol_type = other DNA
tgygtagtggggyggaggaggtggygatggtygggggaggyggggggattgttgtttatttgtagttgggttaatttygyggygtaggyggyggyggagygyggggagttygyggygggtttagttgtygtagtattatgttygagttttttttygggtagaygtygygygtygtyggggtttyggtaggggaggatgttagaygttyggga

SEQ ID NO: 4610 - DNA, 388 bp, synthetic construct
  misc_feature 1..388: note = Description of Artificial Sequence: Synthetic polynucleotide
  source 1..388: mol_type = other DNA
ggtagtygtagttttttygygygttttttttttttttaygtttttygttttygttatggggttaaygtggggtttttaagagttgtyggtttttagyggygtaatttttagttaaagttatygygggyggattatggtttagggygttagaggggttagaggtaygggaagaggaaaagayggttaattgggaaaaaaagagaaaaygaaagaaaagttaaaygatgagtttttataaggaggayggagtgaatagtttgtgttagaaggttttgtatatygttatygagttgtgtttygtyggttaggtggagtgggagaagtgttygggtattttttttygggataggggtagttagggyggaagtagtataggtaatygggaggg

SEQ ID NO: 4611 - DNA, 201 bp, synthetic construct
  misc_feature 1..201: note = Description of Artificial Sequence: Synthetic polynucleotide
  source 1..201: mol_type = other DNA
tttttttttttttgttttttaagataygygttygaaatygaggggtgagagtaaagatygtttattaatttagtattttggatttagagtttttaatttygaaaggaggttggtattgttygggttatygagagagggagggagaagagttgaggttgtaayggtttttgggttttttagatygggtttggtatttaggag

SEQ ID NO: 4612 - DNA, 201 bp, synthetic construct
  misc_feature 1..201: note = Description of Artificial Sequence: Synthetic polynucleotide
  source 1..201: mol_type = other DNA
ttattttttttggaagtttattagttgtttaagtgataattaatatyggagagttagggttygtttaataggagtaygyggagatattttagaygatagygygttttttttatttttatttygtttttygggygttttaggttagygtttattagattttaygtttgggggattgtttgggttttagygagagtgttaygg

SEQ ID NO: 4613 - DNA, 212 bp, synthetic construct
  misc_feature 1..212: note = Description of Artificial Sequence: Synthetic polynucleotide
  source 1..212: mol_type = other DNA
aggtgtagagatagtggagatgaggttttgatgttyggttttggttttaygygggtagygttagttggtyggtgttayggagttttygygtttttygttygtttagttttygyggatttatttattggggttgtttygtagygygatttttttttatttygggggagggttaagggyggyggtggggggyggggtgggggggaagyggyggg

SEQ ID NO: 4614 - DNA, 250 bp, synthetic construct
  misc_feature 1..250: note = Description of Artificial Sequence: Synthetic polynucleotide
  source 1..250: mol_type = other DNA
tttttygtgtttttygtagggtaggttatagttttttagattttygtttaggtggtaaagaagatggagttgggggtygygtttyggyggygyggggttygaaggygaggtygtttagttygtattttattttaygtayggtataygtygtygyggtttttgttaygtatattttygygttgtttygtttaygtgggygtyggggaggaggttygagagatgggaagaaaggttggtatttatttttttg

SEQ ID NO: 4615 - DNA, 488 bp, synthetic construct
  misc_feature 1..488: note = Description of Artificial Sequence: Synthetic polynucleotide
  source 1..488: mol_type = other DNA
ttgtaaatattggaggaaagttgygttgttttaattaaataygtttttttaaaatayggagatgyggggagtgggggttygggaaagaaatttttaaagyggtagtgtttttttaagaaggggtaaaaaaatttgtttatggttatttttttttygttttattttttttttttttgatagtttyggttttggttgttygagtygggggtgtgttttyggttttttttagatttgggyggggggygggaggagtgagygatttgggaagtttygggggtggagagggggygtttyggggtttgggggygaygtggatattttttttggagtayggyggtgygtttgggatttgaaggaagggtygaaggaagyggggtgygggygggygagttgttygttaagttgtttggygggygyggygaggggagatgygtaagtttgtagatygggggttyggagttyggygtttaggttggyggggggygtgt

SEQ ID NO: 4616 - DNA, 201 bp, synthetic construct
  misc_feature 1..201: note = Description of Artificial Sequence: Synthetic polynucleotide
  source 1..201: mol_type = other DNA
gtagagttgtagtttttgyggttttttttttttygttgtttagtygagttttgggtttttagtttaagtttttygtatygtygttgttgttgtygttatygtygtygtygtygygygttgttagagtygttttttygtttttttttttttttttyggtygggtttttttttttttttgtttttttttttttttttttagtt

SEQ ID NO: 4617 - DNA, 364 bp, synthetic construct
  misc_feature 1..364: note = Description of Artificial Sequence: Synthetic polynucleotide
  source 1..364: mol_type = other DNA
attgygtatgtgggtttggggtttgygygtatyggaggttgtaggygttggggagggtgtggggggttgtgygtggggttgtttttatyggaagttgtaygttttgggaagygtagaggygggggtgttgttygygttggggagtaygtgaggggatatttagggattgttygygygaatggtttttaaygtatgygttttattttatattttatagtygttatgaygatygggaggttygtaayggttgyggggataagttygttgaggttgttaggygagttaggtttttttggatttygtttgattyggttgggttgtgtttgaaattgatttagttttattatattttttgattatgaga

SEQ ID NO: 4618 - DNA, 220 bp, synthetic construct
  misc_feature 1..220: note = Description of Artificial Sequence: Synthetic polynucleotide
  source 1..220: mol_type = other DNA
gtgtaattttttggttaaaatgttatagttaagattaaattygaagaaaagaatgaaattaygggaagttttttagatagtygtygtaaggttatgggtygaagtggtgtaggggyggygttyggggaagygattggtagagttgtgygtattgggggtgttgtaggygttggggagagtgtggagaggttgygtggagttgygygttyggggtgggggt

SEQ ID NO: 4619 - DNA, 201 bp, synthetic construct
  misc_feature 1..201: note = Description of Artificial Sequence: Synthetic polynucleotide
  source 1..201: mol_type = other DNA
gyggttgagttygyggagttgggtgagtgtttgyggttgatyggttygtgggagtagggagygtatagtyggttggtgttggagggttayggggatttayggggtatygygggagtygtygagygtagggaagttagtaggtatttgtagtgyggagtttgtaaggttgaggtaggagatygttygaggyggggagggygg

SEQ ID NO: 4620 - DNA, 201 bp, synthetic construct
  misc_feature 1..201: note = Description of Artificial Sequence: Synthetic polynucleotide
  source 1..201: mol_type = other DNA
tttgagggttygggtagttattygtattttttygttaygyggagaaagtygagtatataggtygtagggtgggggttygyggggagagggtggaagtagygggtttttygygtttggggtggtygttgttttatttaggttttygtttgttttttatttttttagattaatygttttttgtaggtgttaaygyggtgtttc

SEQ ID NO: 4621 - DNA, 201 bp, synthetic construct
  misc_feature 1..201: note = Description of Artificial Sequence: Synthetic polynucleotide
  source 1..201: mol_type = other DNA
gttttagtttttatttgtttaggtgttttyggygttttggygaattyggttattttagttttttaygtggtgagtatttagggtagygggtygatttttygaggttttatatttgggtttgaggggygyggttygtagyggygggtgtaggggygattgttagtttttatttygtttyggggtgygttyggaggtygatat

SEQ ID NO: 4622 - DNA, 358 bp, synthetic construct
  misc_feature 1..358: note = Description of Artificial Sequence: Synthetic polynucleotide
  source 1..358: mol_type = other DNA
atttagggttattgtagtttyggggtatttyggaggttaygattygygagtagatgtttyggaagaggttttttatgtaggttgttaggtagatggyggygtgttygtggatgygtagygttaygyggttgtttattatttagygatataygyggtttayggagaaggtgaggtygtagygggtygatttgtygyggtttaggyggtygtygtyggygttgtttatgttgtagagggatagtgyggttagygtagtygtygtatagtgygyggttaggttttaggatagtaygatttttatggygttttggatttygtatttggtgtatttggygaagygtaggtttaggygttgygt

SEQ ID NO: 4623 - DNA, 201 bp, synthetic construct
  misc_feature 1..201: note = Description of Artificial Sequence: Synthetic polynucleotide
  source 1..201: mol_type = other DNA
agygtttttttatggtygyggtagttaatygatgattgaatygaataaagagtagyggygagattaatttttaatatttatygatgggtagygggyggtygagtttyggygagtttyggtagtygtygttygtygttttagggygttygtttgttygttyggggatttttttaatgygtttagggygygttygggggtttt

SEQ ID NO: 4624 - DNA, 328 bp, synthetic construct
  misc_feature 1..328: note = Description of Artificial Sequence: Synthetic polynucleotide
  source 1..328: mol_type = other DNA
ttttttagtttygttggtttgggagtygggagtttyggaggagtttttygttaagtttttttggttaygagygygtttggttttggtttgggagtagatygtgygttygagtggggtatttgttygaggtyggggattgtgaatygaaagattttatttagttttgttgtttttttggtattgygatttgggggygggttattttatttttttgaatttygtttttygttttgtttatggaaggttgtaagtttttttggggttygggatttttttttatttttatttttygagtagagaaataggygatgttttttttttttttgyg

SEQ ID NO: 4625 - DNA, 201 bp, synthetic construct
  misc_feature 1..201: note = Description of Artificial Sequence: Synthetic polynucleotide
  source 1..201: mol_type = other DNA
gaggtgtgtgttggaggtgggtagtygtygyggaggttttagyggtaggtgygttttagtaggtagtagtagtygttattttgggtaagtagtaaatttygtataaatttyggagttattatgtttgttttttygttttatygtyggtttttttgttaggagtagtagaggatgtggtgaatgtatyggttttatygaayg

SEQ ID NO: 4626 - DNA, 319 bp, synthetic construct
  misc_feature 1..319: note = Description of Artificial Sequence: Synthetic polynucleotide
  source 1..319: mol_type = other DNA
gggygtatatataygtttatttagatatttygygygttttttygygtttttgtttgttygttygtygtygtttgtttttttttttttgttttygtyggtygttttttttttttttttttttttttttttttttttttttttttttttttttttttggtattatagagttgttttgaaaatagaagatagagggagtttyggagttygttatttttagygatttttatattgggaaaaaatatggagttagtttyggtagttttygatttygtygttagygagttaggtagtagyggygyggaygyggtygtyggtttta

SEQ ID NO: 4627 - DNA, 201 bp, synthetic construct
  misc_feature 1..201: note = Description of Artificial Sequence: Synthetic polynucleotide
  source 1..201: mol_type = other DNA
ttaagtttaattttaygtttttttyggtgttygattttgyggtygaatygtaattgygagtygtaggtaatggyggagtttttggtattgttagttgttygyggttgggggttygaggttgggagggtttygttttyggaatatygtttyggtttggtttttaattttgygaggagtttttttgygtttttttttygyggt

SEQ ID NO: 4628 - DNA, 370 bp, synthetic construct
  misc_feature 1..370: note = Description of Artificial Sequence: Synthetic polynucleotide
  source 1..370: mol_type = other DNA
ttggattttyggggtgygggtttttttttttgttttgttttttagtatttttggtaattgygtaaagttgtttgggttgtaatggtggggtgtagggggygttyggttgttgtatttgttagtgttgggtttaggttgagaggygatttttagtttttataataatgtttygggttttttggtttgggttttygtagygttygattgatygttagygataygaygagaaygaggatttgtyggaygtggaggagatygttagygttygyggttttagtttggaggagaagtttygtagttagttgtattagggggatttygtgtaygttatggagggtaaaggtgaggygtttttatttygggtygtttt

SEQ ID NO: 4629 - DNA, 201 bp, synthetic construct
  misc_feature 1..201: note = Description of Artificial Sequence: Synthetic polynucleotide
  source 1..201: mol_type = other DNA
ttttttygttttaggygtygttaagttttagtattatgygtttttttagatgttygaaagygtttttttagggtagtttatgtttttttgtgtttttttygygaygggtygggtttattattttatatttttygggtttttttatgtttattatygtgtgtttttttagtatttttttttttttttaagttttaatatagt

SEQ ID NO: 4630 - DNA, 201 bp, synthetic construct
  misc_feature 1..201: note = Description of Artificial Sequence: Synthetic polynucleotide
  source 1..201: mol_type = other DNA
gttgggygtaggggtygtygttygaggattatgggtgggttagygtttygtygggttgttagttggyggggatygtyggygtttgtgtygggtygygttygaggttgygtygttygtgtygtagyggttaatgyggtagtattygygaaygttatygyggygggtttygttggttygggttgyggygtgggggygggggat

SEQ ID NO: 4631 - DNA, 201 bp, synthetic construct
  misc_feature 1..201: note = Description of Artificial Sequence: Synthetic polynucleotide
  source 1..201: mol_type = other DNA
gtgtagygaygtttagttttygtgyggttagygygtygygtyggyggattttgtagtttagagagtttagggagtttagggaggggagyggggygygggyggggtagtgtygtataatygtaggygygtttygygtygttttygtttygggtttattttttttygtygygttttttttagtttatttayggaygagyggat

SEQ ID NO: 4632 - DNA, 263 bp, synthetic construct
  misc_feature 1..263: note = Description of Artificial Sequence: Synthetic polynucleotide
  source 1..263: mol_type = other DNA
gygyggtttygyggggattttgygggygggygggyggtygggygygygyggggygggggyggygygygygyggggagygtgtgggtygggygggygyggyggggaaagttgggygygygagtygaggttgttgtttatttgtagtygygtygtttatttgtygyggagtgygygtttygygttttttyggttygtttyggagttyggtygttttttttttgttatagygggtaattgygtygatatgygataygagtagttta

SEQ ID NO: 4633 - DNA, 201 bp, synthetic construct
  misc_feature 1..201: note = Description of Artificial Sequence: Synthetic polynucleotide
  source 1..201: mol_type = other DNA
ggygggagaggagtttyggtygygtggattttagtttgygyggtaattatygygttttgattttaggttyggttgtttagggaaggatagtttagggygygtttagygagttttagggggtayggaagtggttagggtagattttagggtgaataattaatattttatttattaattygttaaaaataaagaaaataaaat

SEQ ID NO: 4634 - DNA, 201 bp, synthetic construct
  misc_feature 1..201: note = Description of Artificial Sequence: Synthetic polynucleotide
  source 1..201: mol_type = other DNA
tgtyggggtygygttttygggttygygtygttagtatttttttaygygygttyggtttygggttattygttttygtyggttttygttttttttygtagtygtagggaagygagtttgggaggaagaagagggtaggtggggaggyggatgaggggtgggggattttttgaygttattagaaggaggtgtyggggtaggaag

SEQ ID NO: 4635 - DNA, 201 bp, synthetic construct
  misc_feature 1..201: note = Description of Artificial Sequence: Synthetic polynucleotide
  source 1..201: mol_type = other DNA
aggggttaggagyggygggatagygygggaagagtaggtaaggggagatagtyggattgygttttagtttttygtgttaagaatatygtygyggaggygyggttagttttttttggatyggatttttygtttttagggttaggyggyggagttttagttttgttttttttttagtttygggyggtttttagagttgagtaa

SEQ ID NO: 4636 - DNA, 201 bp, synthetic construct
  misc_feature 1..201: note = Description of Artificial Sequence: Synthetic polynucleotide
  source 1..201: mol_type = other DNA
ygggygtyggygtgaattygygtttttyggagtttagygtygtgtttttaggtttyggttttgattttagggygtttaggtggaatggtttygtagttgygygttgttttygygttttygttttgtttygyggaaatygttttygatagttaattygatygggygygyggygttttyggtyggttttygttygatttygyg

SEQ ID NO: 4637 - DNA, 215 bp, synthetic construct
  misc_feature 1..215: note = Description of Artificial Sequence: Synthetic polynucleotide
  source 1..215: mol_type = other DNA
gattttttygygtataygtatatgtataygttgygygtttttaygygtatatataygttttttttgtygygttygtygtygyggttattatygyggagtygagttttgyggagygggaatygaggtyggagyggggatyggaggtagtygagtygggggatgtyggttyggagyggagtygygygyggayggygygttygggayggtgagtgtgg

SEQ ID NO: 4638 - DNA, 201 bp, synthetic construct
  misc_feature 1..201: note = Description of Artificial Sequence: Synthetic polynucleotide
  source 1..201: mol_type = other DNA
tygygtaatttttgaagtggtyggttagggygyggttggtttagtygtygtaggygttttgtaggygttggggtaggttttagtggtatagggtgattaygggttgtaygtttagttttygtagtygttttagtaggygtyggtagtagygtagtttttygyggttggggaygttygygttgttattggggagtattygyg

SEQ ID NO: 4639 - DNA, 201 bp, synthetic construct
  misc_feature 1..201: note = Description of Artificial Sequence: Synthetic polynucleotide
  source 1..201: mol_type = other DNA
ggaygggagttgyggggagggyggtygggggatttygtagagttygtttygttygtagtygyggggygtygagggtagggygggygtttagtttggtttygtygtttygttygtagtttttygaaaggyggtygttttgttttggttagtttggttygattygggggygttgygtgygggyggtttyggggttgttggtat

SEQ ID NO: 4640 - DNA, 201 bp, synthetic construct
  misc_feature 1..201: note = Description of Artificial Sequence: Synthetic polynucleotide
  source 1..201: mol_type = other DNA
aatttaatatttttttttttttttttggagttattttttttttyggaatatgtaagttttgggtggtttagttttgtygttagatttagtttttaagtgygggggaaggagatgggygtttttagtygygattttttgggaaggtggttatttatttgygttttgaaatagaagaatagggygaygttgtagataatttgg

SEQ ID NO: 4641 - DNA, 217 bp, synthetic construct
  misc_feature 1..217: note = Description of Artificial Sequence: Synthetic polynucleotide
  source 1..217: mol_type = other DNA
attggttgaagtttttttagygatttgtatgaatygagagggagtgttttttgtygttttttttttaagagygttttgattgtagttttttagggaatgygyggtygagggaatgygygtagtttataggttttgggagtgagttggtgttyggygatttggtattygygtttggatatggggygtttatatygttttaggagtagtattagttata

SEQ ID NO: 4642 - DNA, 317 bp, synthetic construct
  misc_feature 1..317: note = Description of Artificial Sequence: Synthetic polynucleotide
  source 1..317: mol_type = other DNA
agtaaaagtttttatttgtagtatygggtatgttgttygtttaaygygtttyggggatttgttggttygtgtttttaatttaggggtggttataygtttygygtttttgtttttgggtagatttttttatttgtgtattttggtttttttatttagtaaagagatgtgygaagtgtgygtttggagaygagtygtttyggtgatttttattygttygtagyggtggttttggtttttyggattygygttygygttttgygggtttttygygtygtttttgttygtyggattattygggtttagagggtygttygttt

SEQ ID NO: 4643 - DNA, 201 bp, synthetic construct
  misc_feature 1..201: note = Description of Artificial Sequence: Synthetic polynucleotide
  source 1..201: mol_type = other DNA
gaggggaggtayggagygggaggagggggaygyggagaagattgtttggtttygtyggtttygttaaygtgayggttagtttygtygagygttygtattygtttatatttatgattattygtatattygttttaataygtgttaaggygygatygyggggtttttggtagttttygttgtatttttttttttataggggta

SEQ ID NO: 4644 - DNA, 201 bp, synthetic construct
  misc_feature 1..201: note = Description of Artificial Sequence: Synthetic polynucleotide
  source 1..201: mol_type = other DNA
tygtttaatayggagaygyggagttttatagyggtggtagaaagtgagtattaatttagtaatagggggaaggaaggggaygtygggyggttagtgggaygtgyggtagtygagggttgtagtttgtttttgtagygygttygygtttatttgygattttttggtaggggatgttygttaggttgaattttttggtatygt

SEQ ID NO: 4645 - DNA, 201 bp, synthetic construct
  misc_feature 1..201: note = Description of Artificial Sequence: Synthetic polynucleotide
  source 1..201: mol_type = other DNA
tagtygggtygagygygttgtttgagttgagtygtygtaggtgaggggttygygttttygttygttttgggygtygygtttggtattgattttgtyggtygtttattgtygtygtygtygtygttygygggtattatgatagttttgagygttggggttataggttggttatygtygtyggtgttygggaggttgyggygc

SEQ ID NO: 4646 - DNA, 201 bp, synthetic construct
  misc_feature 1..201: note = Description of Artificial Sequence: Synthetic polynucleotide
  source 1..201: mol_type = other DNA
agtgtgattgatgtatttattatttaataatttyggggtgaaatttgaggtgaayggttttatttttttatatttaggaatggaattagttttyggtatygtgtatagtttgattttaygttygtaygttgggttttyggttttttggtagtgtatttaagtgtatttygygtgtgttyggyggattttygtgtatatygt

SEQ ID NO: 4647 - DNA, 201 bp, synthetic construct
  misc_feature 1..201: note = Description of Artificial Sequence: Synthetic polynucleotide
  source 1..201: mol_type = other DNA
gygtagttttatttyggatggtttttgttttttygygggttygagggygttggaaatttagyggyggygaagyggagaggagtttygygygttttygttygtayggttttaggtttggggtttgygttggagtygygyggggagaggtygtttttgygatygtygygttygttttygatygttygggttygyggttagttc

SEQ ID NO: 4648 - DNA, 221 bp, synthetic construct
  misc_feature 1..221: note = Description of Artificial Sequence: Synthetic polynucleotide
  source 1..221: mol_type = other DNA
agtttaggtttgygtttataygygyggygtttataygygyggygtttatttggttgtagtttyggttagggttagygygtygyggttgaagggggygttyggatttttttggggyggygygtagtygggatagtttygtatgaygttygygttttagyggtttygggaygyggttttatttttaatttttggyggttttagtttyggtttttgtgtttygg

SEQ ID NO: 4649 - DNA, 311 bp, synthetic construct
  misc_feature 1..311: note = Description of Artificial Sequence: Synthetic polynucleotide
  source 1..311: mol_type = other DNA
gtttygtttygtattygtatatatttttttygtygttgttttgagygtagygataagggtttttatattttygyggttygtaatgtttyggggttaagtygaggtagggaggygttttygtagtttttgattttataattygygygygtgtgtatygagtygygggtatatygygaatatatatatatatatatatattygtgygttttygtttttygttyggttygggtttttygaatttattttygaggygtttygggygtagggttygtttttttttgygggtttttagyggttgttyggtagtggtt

SEQ ID NO: 4650 - DNA, 308 bp, synthetic construct
  misc_feature 1..308: note = Description of Artificial Sequence: Synthetic polynucleotide
  source 1..308: mol_type = other DNA
ggtggygggtagtgtggtgatggtttttgaggaggtttgttyggagygtatygatttgatttataaaaattatyggaaattttgtaatttgttgatygaygtggaggagtggggttaggtggttattattagtatgtttattygttaygttygtaygtagtttttgagttttatttagaaygtaagtgggtttagtttaggtagagygggtygaagtgtgtttyggggaggygtttatagattygtyggttttttygtttaggaatttttattagaggagaaygyggaaaaagttttttayggtttag

SEQ ID NO: 4651 - DNA, 201 bp, synthetic construct
  misc_feature 1..201: note = Description of Artificial Sequence: Synthetic polynucleotide
  source 1..201: mol_type = other DNA
ygagaattttgygggtttagaaygttygygyggaygttttttttayggygtyggaagtyggygtygagtttgttatygggtatttttttgttgttttgaygayggygggygttgtaagagtggagaagttgtaggtgttgaggygyggtgaaagaaattttgggagttaagagtaygaggagttggtgtttgtgttatatt

SEQ ID NO: 4652 - DNA, 201 bp, synthetic construct
  misc_feature 1..201: note = Description of Artificial Sequence: Synthetic polynucleotide
  source 1..201: mol_type = other DNA
aggtgatttyggttttggygaggygygattyggttatgygtgtgtgtgttttttttyggagaggatttyggtygtygagggtaygyggggtttagttatygttygttttttaattagttgttggttygtttygatggtgtaaattgtttttttttgttttttattaaatagtaatagtttggttaygtttaagtggaataa

SEQ ID NO: 4653 - DNA, 201 bp, synthetic construct
  misc_feature 1..201: note = Description of Artificial Sequence: Synthetic polynucleotide
  source 1..201: mol_type = other DNA
gggatttggtgattttagtattattttttttttttttttttttttttttgtttttttatygtttgttgtaattttgtaaagtttyggagtyggagagygygtttygtttttagagttttyggattyggygagttagygatygtygagtyggttattatgttyggtagatygygttattaggygtttttygyggtttttatt

SEQ ID NO: 4654 - DNA, 630 bp, synthetic construct
  misc_feature 1..630: note = Description of Artificial Sequence: Synthetic polynucleotide
  source 1..630: mol_type = other DNA
agtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatygg

SEQ ID NO: 4655 - DNA, 201 bp, synthetic construct
  misc_feature 1..201: note = Description of Artificial Sequence: Synthetic polynucleotide
  source 1..201: mol_type = other DNA
gagggyggggygggyggyggtygygtttttaatttyggygttgygtgtgggagyggtyggattagggaattagygttgtaatttyggattagtaaygttygttaaatgagtgtttaatttygattttttatgttttttagygtygyggttgagttttaggaggttttttggttaggtttttttygygttttggttttattt

SEQ ID NO: 4656 - DNA, 239 bp, synthetic construct
  misc_feature 1..239: note = Description of Artificial Sequence: Synthetic polynucleotide
  source 1..239: mol_type = other DNA
ttygtgaatttygttyggggatattttatagtagtygygtttttatttttttttttttaaatygtttygggtttttgtygtygttattttttgttaaatygtttttatttttttagyggagttatagyggggygyggygtatataaagggggtyggagggtggagagtatagaaggagggagagatttygttagggttygtggtaygggtttgggagtagttatttattygattttttt

SEQ ID NO: 4657 - DNA, 201 bp, synthetic construct
  misc_feature 1..201: note = Description of Artificial Sequence: Synthetic polynucleotide
  source 1..201: mol_type = other DNA
gaygttagtygygygggtttttygagttygygtygygtttagggatttggttygttttttgygtttttatttttttattttttttagaaatatagtaygygggttttttttatgtaggttattttttayggagttttaggttagttttggggyggtgaaaygaaggtgttaaggtatagtattttttygggaggttggata

SEQ ID NO: 4658 - DNA, 221 bp, synthetic construct
  misc_feature 1..221: note = Description of Artificial Sequence: Synthetic polynucleotide
  source 1..221: mol_type = other DNA
tagttgttaatttygygygyggagtttttyggyggtgtagtttygtttyggyggygygggyggtatgaagattagtygtygyggtygagygtttttggtygtggttttgaatttgttggygttgttgttygttattatygttttttttattaygtattggtgttagggtaygtagygggtttttaagtygggttgyggttagggygggygygttaattgtt

SEQ ID NO: 4659 - DNA, 201 bp, synthetic construct
  misc_feature 1..201: note = Description of Artificial Sequence: Synthetic polynucleotide
  source 1..201: mol_type = other DNA
gyggggaggggatggggtggygggagaattgtttttttttttagttataaatttattaggtttttaaattttttttggattttttttttygygttttygygagttygggatttaggggatggagaattyggggyggaggagygtygagttaggygggagggaggtygagtygtgggygggaggyggatyggygtggggttg

SEQ ID NO: 4660 - DNA, 246 bp, synthetic construct
  misc_feature 1..246: note = Description of Artificial Sequence: Synthetic polynucleotide
  source 1..246: mol_type = other DNA
gtttygggggtttttagttaagtatygtttggtgttttyggtttagggtygtgtgagtyggaggttgagtttaygtaaggtttttatttgtatagattaygagttggagaattatagtatgtattgygtgtaatgtaagatgttygtgtgttattagtgtttggaggagggtaaatattttagttaygaagttaaggttttgggggttatgtggaaattatataaggtgagttttaagaaaattta

SEQ ID NO: 4661 - DNA, 223 bp, synthetic construct
  misc_feature 1..223: note = Description of Artificial Sequence: Synthetic polynucleotide
  source 1..223: mol_type = other DNA
tygattatgattatttggatttggataagatgagtttatatagygaggyggatagyggttatggtttttayggggggttygttagygtttttattatttygtgttagaagttttttaayggygttygygtgtttttttyggttatgtygttatyggttatttatttgttatyggttttggtttyggtgtttygtaatttttgtattatttgtttttagtgtta

SEQ ID NO: 4662 - DNA, 201 bp, synthetic construct
  misc_feature 1..201: note = Description of Artificial Sequence: Synthetic polynucleotide
  source 1..201: mol_type = other DNA
ttagggtayggygttagyggatttayggagaaggagaaaagttttattgtygtgtagaagtttaggttygggtgagaygtttgygaaggttgttagtagyggaagagaaggggygtttttygtgttgygtagtattygttygyggtaggtgggygyggagtttagagttgggagttaaaygtaaaygttggygagaagttt

SEQ ID NO: 4663 - DNA, 244 bp, synthetic construct
  misc_feature 1..244: note = Description of Artificial Sequence: Synthetic polynucleotide
  source 1..244: mol_type = other DNA
gtttygttgttttagyggtygttgttttagaaaagttaaygagaattagatgtggtggttattgtygaatttttttagagtyggtgattggtttttagtygagggttttagttaattagtttgttgggtgggtttggagtttygtttygtttaggygttygyggagatttaggttygaggttggygyggygyggagagtgggttggaggtyggggygggaygygttgtgtagygggtaagygta

SEQ ID NO: 4664 - DNA, 201 bp, synthetic construct
  misc_feature 1..201: note = Description of Artificial Sequence: Synthetic polynucleotide
  source 1..201: mol_type = other DNA
tttgttyggttygttgaaggttggttttgggtttgggggtagtgttygygaagggttgygatggtaggtttygttgttatayggtatygagggttttttygtttyggygttaggygtaygtttttttgttatatttttygyggggygygtygttagggttatttgtttttttaagtttygttaggtagttaagggtgagga

SEQ ID NO: 4665 - DNA, 457 bp, synthetic construct
  misc_feature 1..457: note = Description of Artificial Sequence: Synthetic polynucleotide
  source 1..457: mol_type = other DNA
ttgagggaggggtygggttttygggtttgtagattygttatygygygtgygtatgygtyggtygygagttttygggtgtaggtttgggyggtttyggttygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttygggggaggtatgggttygggtaggtttaggaggaagttgtatagttygaggttygggygggagtggygggtygygggtaagggaaygtatatttggaaggg

SEQ ID NO: 4666 - DNA, 244 bp, synthetic construct
  misc_feature 1..244: note = Description of Artificial Sequence: Synthetic polynucleotide
  source 1..244: mol_type = other DNA
gygttttttttgygygyggygaggtygagaygtttttygyggtgatagygtgtaaggyggagattyggygygtttttagtttagggaaagtttaggygaygygatygtaagttygagtttaggtttttyggagtygttagggygygtygggttgtttgtttttttgtttttttttgtaggaatttttygtygttygyggtygggatttygggtttttttygggygtagattttagttatygttt

SEQ ID NO: 4667 - DNA, 206 bp, synthetic construct
  misc_feature 1..206: note = Description of Artificial Sequence: Synthetic polynucleotide
  source 1..206: mol_type = other DNA
gagygtagyggyggggtatggaagaagagggttgggggygygygttatttgtaaaggttttygaggtttttttttagttttggtggtaatttygtttagygtygygtttttttttagatttaaatttttgttgggtttttygggtggyggyggyggygayggyggyggttgttggagttaagttttgtygttygtagygtyggggc

SEQ ID NO: 4668 - DNA, 203 bp, synthetic construct
  misc_feature 1..203: note = Description of Artificial Sequence: Synthetic polynucleotide
  source 1..203: mol_type = other DNA
agagagatagtatgagaaygygtagagttgtatttygygggggtygggygttagtagtatygygttgttttatttayggygygtttgtttttygygttgygygtttagyggggygtygagttttagaaattttagtatatggtyggttyggyggttayggtggtygtagttgttttgtttttygagygttttttattgttttt

SEQ ID NO: 4669 - DNA, 266 bp, synthetic construct
  misc_feature 1..266: note = Description of Artificial Sequence: Synthetic polynucleotide
  source 1..266: mol_type = other DNA
ygtgattatttttygttttattttyggggyggggttygttagaaattttaagygttygtaatygttttttttygtgggygggatggggaaattgaggttygaggtygtttygttggttggtgtaagaattagtttgtaatttaagttttgagttgttggygtttygtttygtgtagttgaatttaatttattyggggttgtgggtagygtttttttggggttgataygttatttygagtttgaggattaagatyggagtgatttgg

SEQ ID NO: 4670 - DNA, 242 bp, synthetic construct
  misc_feature 1..242: note = Description of Artificial Sequence: Synthetic polynucleotide
  source 1..242: mol_type = other DNA
ttygaatttttttaaatttggyggttyggggygygtgggggggaygtttygttatttgygyggttataaaggagagatttatggtgtygttgtagttagygttygagttttygttgttgtygttgtygttgygggttagtygtttgtatagttggyggggatygggttgagtagygagygttyggagatygtayggygtattyggttgtttttgggtttttggttttagatttttattaggc

SEQ ID NO: 4671 - DNA, 201 bp, synthetic construct
  misc_feature 1..201: note = Description of Artificial Sequence: Synthetic polynucleotide
  source 1..201: mol_type = other DNA
taaagtaaaataggataaaygatygyggygygtygaygtttggygggttayggttataaagygggttttagagttttttttaggyggyggtaaagggggygttygaggttatyggtaagagatagattattggygtttygggaaaatagagtggggaagggygagattgtgtgtttatttaygttygygygggtttgagtt

SEQ ID NO: 4672 - DNA, 201 bp, synthetic construct
  misc_feature 1..201: note = Description of Artificial Sequence: Synthetic polynucleotide
  source 1..201: mol_type = other DNA
aygttggygaatgattatggaaataatatttaatagtagtgttttttatgttaggtatataatygttttggygtgggttgataattatgtttattttatygygtggtattgagtygatygtatatttagggtttyggtttttagggttygtttattygtttattgygtgaagtatttattttygtaggagtyggagtagga

SEQ ID NO: 4673 - DNA, 312 bp, synthetic construct
  misc_feature 1..312: note = Description of Artificial Sequence: Synthetic polynucleotide
  source 1..312: mol_type = other DNA
tggtygtttttttygyggttaggygtattttgtagygtttagatygtygygtttttattygygtttttaatygygagygttygtttgggtygggtygggygttygagattygggagagattaggggttygtaaagtagaagagtagatttagaaagaaaaaaaaaaaagygagaagtgygagaaaaatatattgaatttagttaaatatayggtagatgaaaaaaatattttgtttagaagttaaaaaygagttttygagtygtgagatattgttgygttttygttaggygtgtaggtyggatgttaggggg

SEQ ID NO: 4674 - DNA, 203 bp, synthetic construct
  misc_feature 1..203: note = Description of Artificial Sequence: Synthetic polynucleotide
  source 1..203: mol_type = other DNA
gygttggtagggggaggtttyggtaaygtttgggggttttaggttagtttttttygggttggaaggtatygtataggggttttygttaatttyggttttygygyggtygggatayggttatatttgttygygggggtttgttttttaggtygtygtaggtttttyggagtttaagaggattttataagtagttaaagttagyg

SEQ ID NO: 4675 - DNA, 201 bp, synthetic construct
  misc_feature 1..201: note = Description of Artificial Sequence: Synthetic polynucleotide
  source 1..201: mol_type = other DNA
tttyggggygggyggygaggggygggagtttagagagtgtttygtttttgtttagtgttgggyggygygtggggggggtagggttttygtttttttaygyggtttygygtattttaaggattttaatttgttaggtgagtttttgtttyggggaggggygttgggggyggyggygaggatttagttgygygygygtatgyg

SEQ ID NO: 4676 - DNA, 283 bp, synthetic construct
  misc_feature 1..283: note = Description of Artificial Sequence: Synthetic polynucleotide
  source 1..283: mol_type = other DNA
gtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtt

SEQ ID NO: 4677 - DNA, 201 bp, synthetic construct
  misc_feature 1..201: note = Description of Artificial Sequence: Synthetic polynucleotide
  source 1..201: mol_type = other DNA
gaaygttttttagttyggtttggtattggygtyggtgttttttattttggttattayggtttttagggatttgtgggaggattatagtygttatygtttygattataagattaattatttgggttgtttggtttttagtaggtgagttgggygggygggygagygagygygyggtggygtagggtagggygtttygggaat

SEQ ID NO: 4678 - DNA, 247 bp, synthetic construct
  misc_feature 1..247: note = Description of Artificial Sequence: Synthetic polynucleotide
  source 1..247: mol_type = other DNA
aggygtagatttaygagttggagyggygttttyggtagtagyggtatttgtyggygttygagygygaatatttggttagttttattygttttaygtttaygtaggttaagatttggttttagaattatygttataagatgaagygygttygggtygagaaaggtatggaggtgaygtttttgttttygtygygtygggtggtygtgttygttttggttagggayggtaaattatgttaygygtttaa

SEQ ID NO: 4679 - DNA, 427 bp, synthetic construct
  misc_feature 1..427: note = Description of Artificial Sequence: Synthetic polynucleotide
  source 1..427: mol_type = other DNA
tagygygtttygggtttygygygtygttagtttttggttygttygtyggtttygtygygttygttagtttygtagyggagtttyggttyggtttygggtygtygttattaygtygygygtygtatttygygttaagaatggggyggttaagttgtttaagtygttygtygtygtygtygtygtygyggtygaggygttyggygtyggygygggtatggagygttygtagagtygttttagtttgttygtttttttygaggygttygttatttatttttygtgtatgaattttttygaygaygaggaygtaggtaagygygyggttygttttttagattttyggggtgtttygggatttaggttyggtagtttttttttygattygtgygtttttttttttatttttaattttttgggaaggygtttt

SEQ ID NO: 4680 - DNA, 246 bp, synthetic construct
  misc_feature 1..246: note = Description of Artificial Sequence: Synthetic polynucleotide
  source 1..246: mol_type = other DNA
ttygggggyggttgtaygtggtygtggttttgaattttttgygggggtttygaaattygtttgyggggaggttagggygatagaggattygggagttatygttggtgygtggyggygtggagygygtttgttayggttaaggtgygggttyggtttyggtttattttaaggggttatygggatgygaagttygggaygttygtygtygyggtgatttyggygggggygtatttyggttgtgggtyg

SEQ ID NO: 4681 - DNA, 384 bp, synthetic construct
  misc_feature 1..384: note = Description of Artificial Sequence: Synthetic polynucleotide
  source 1..384: mol_type = other DNA
tggtggyggaattttyggggyggtyggaggyggyggtyggggagtygagaagtaagtattagygttttaggatygygygygtygtttygygtygtttygygtygtttttyggtttagagtttttattttyggtttgtgagtttgyggygttggtggagttyggttttaggaagaggagtttattyggttttttttgattggatagtagygaggttttatygggygttttygyggtttaaaatygaagygggggygagggggaggtagagttygttttttgygygtygyggttgggagggagaggaggtgggagagaaggaagaggyggaggaggtagygggygtygaggttttgggattygtaggtaagttagatygaygygta

SEQ ID NO: 4682 - DNA, 415 bp, synthetic construct
  misc_feature 1..415: note = Description of Artificial Sequence: Synthetic polynucleotide
  source 1..415: mol_type = other DNA
yggggggggtaggggtttygggtygyggggtgygggggttgygttaaattttygyggggygtttygggygtayggagggttyggygtttattygttygayggygttttatttattggygtttayggttygtaggtaaagygtggaaggagttgaaygyggyggagaagyggtttttygtggaggaagtygaayggttgygygtgtagtatttgygygattattttaattataagtatyggtygygtygtaagaagtaggygygtaaggttyggyggttggagttyggttttttgttttygggattagygttttygtagttatygttygagttttttttygyggygtttggttyggttygygtttttygygagttgttttygttgggygtygagttygayggtttggggttgttta

SEQ ID NO: 4683 - DNA, 543 bp, synthetic construct
  misc_feature 1..543: note = Description of Artificial Sequence: Synthetic polynucleotide
  source 1..543: mol_type = other DNA
ygttggaagaaaaatttttygygygtyggtagaattgtagygtttttttttagtgatttygggagtttyggttgtagtyggttttgygygtttttttaaygaataatagaaattgttaattttaataatttagagtaggttaaygaggttttgttttttygattygaattaaaggtttttygtttygtgygttgttaygagyggtgttttttggggttttaatgtagygagttgtgttygaggggttyggaaggygtaagttgggtagygatatggggaaygyggagygggtttyggggtttyggagttttgggttagtatttaygttgttgttgttygtygyggygttattggtygtgtyggaygtattygggygttttttygaggaggaygaggagttagtggtgtyggagttggagygygtttygggataygggattaygygttttygtttgtaygtttttgattagtagttggatttggagttgyggttygatagtagttttttggygttyggttttaygttttagaaygtggggygta

SEQ ID NO: 4684 - DNA, 227 bp, synthetic construct
  misc_feature 1..227: note = Description of Artificial Sequence: Synthetic polynucleotide
  source 1..227: mol_type = other DNA
tttagggygtagattttttattgtttttygggtttttttygggttttttttttgatttttttttttttttttttygagtttttgtttatatttaggttgygtttyggtttggttgttaaatagaaygaygtttttgygtagagttgattaggggtggyggygggaggtaaggttttyggtatyggaaagtaaagtaaagaaaaaggtattgtagttatygtttttgg

SEQ ID NO: 4685 - DNA, 323 bp, synthetic construct
  misc_feature 1..323: note = Description of Artificial Sequence: Synthetic polynucleotide
  source 1..323: mol_type = other DNA
ttttgtttygygattggygggagtyggagtttttttgaattyggygtttatattatgggttgagttygtyggygtygagggagttagtgygattyggttyggygygtayggttaaggtaygygygttggtataygygggygyggataygygyggatatataygtgygggataygttttttttygayggyggygttaatttttyggtaagtttagygttttaygygatttgttyggtttttaygttggttatagyggttgyggggayggggaggaaggtagyggggtggttttaggggtttattttgtagggttttttygaygg

SEQ ID NO: 4686 - DNA, 279 bp, synthetic construct
  misc_feature 1..279: note = Description of Artificial Sequence: Synthetic polynucleotide
  source 1..279: mol_type = other DNA
ggygtagattatttggaaggggttgtggatgtygtgygtggtgtagagtatygggtatatgtagtgtaaagtgtaygattyggtgttggttttgagtatygaggtgtaggyggygygggygtttatygtgagygtygtgttgttggygttygttgygtttttygtgattttggygggygygtagtgtattatttgygtggtttygggttyggttaaggygygtgtggtttttaygggaggygtgttttatttgttttgygggttgttggygttygtgtt

SEQ ID NO: 4687 - DNA, 261 bp, synthetic construct
  misc_feature 1..261: note = Description of Artificial Sequence: Synthetic polynucleotide
  source 1..261: mol_type = other DNA
ttttygtyggtggaggtygyggttggyggagatygttaagttagaggaggggattygaggtttyggttgggygaaggttttggagggggagaagayggtygaggygtggaggggtagtygyggyggggygatttttatttgtttattgyggggtttgttygtggggtyggggtagatttygtaaaggaygygtagtttgtaagttygyggttygygyggygyggggatggggagygtgtgygtygaggagygygygtygag

SEQ ID NO: 4688 - DNA, 364 bp, synthetic construct
  misc_feature 1..364: note = Description of Artificial Sequence: Synthetic polynucleotide
  source 1..364: mol_type = other DNA
tgtaygygygygtggttygaygygaggttyggtyggttygggttyggggygagattgggggtttgtygttgtygttatygttygagygtaggaaatygtygttatttgatttygttattaagtttaaggtgttttggatttayggtaagtatagygtygttgtagttggtygtgygtttttattatygtygttaggtttygaggtygygtttagttttagtaagaggaaayggaygtttagygataaatyggygtatayggtygaatayggtagttttyggattygygatttaaygtygygtttttyggggttgttygaggaggygatagttttygttgygttttygtygtttagggttygagc

SEQ ID NO: 4689 - DNA, 242 bp, synthetic construct
  misc_feature 1..242: note = Description of Artificial Sequence: Synthetic polynucleotide
  source 1..242: mol_type = other DNA
tagggtggaggyggtgtttgattgtttttttgygtgtgttttgggaggtgggtttgttttggggatagaggtgttggaygtgtaggagtagatatgtygygygtttygaggaagygtyggaattattagaagtatagggaygygggtgtygagagtttttagtattgaaaayggggatttttttttttgtaagggattttttttttttgttttaatttatttttttagatttaagggaygtt

SEQ ID NO: 4690 - DNA, 285 bp, synthetic construct
  misc_feature 1..285: note = Description of Artificial Sequence: Synthetic polynucleotide
  source 1..285: mol_type = other DNA
tagtttygggtyggggtggttgttttattttygtggtttagggaggaggygttgggtgygtatgtttaggggtgtgttygttgttagggttgtagyggtygttatttttaattagttgtaagtygagttgtttatttgggatygggtyggttyggygggtttggttttyggygaaggyggyggygttggtgygyggyggttggggygygggaygtaggtagtgygtggygyggttggygttttygggygtygttatygagygagggtgyggtttygggyggtygt

SEQ ID NO: 4691 - DNA, 222 bp, synthetic construct
  misc_feature 1..222: note = Description of Artificial Sequence: Synthetic polynucleotide
  source 1..222: mol_type = other DNA
ygttatygttgtygtygttttttygyggagtgaygygttttgtagttaatyggggtagtygggggggaggttygggaggggttttgggyggagtygggtygtttttttattttaygggttyggggttgtttttttygaaaattttagttttaattgttttgggaatgttygaggtagagaaagggagygagggagtaagtaagaagttggaggattagtgtt

SEQ ID NO: 4692 - DNA, 201 bp, synthetic construct
  misc_feature 1..201: note = Description of Artificial Sequence: Synthetic polynucleotide
  source 1..201: mol_type = other DNA
gtagygttttttggtttygygygtygttygggggtygttggttyggtgygtgtggtygtttygtygtttggttggagtttgtttygyggygtagggttgygtttygagggttygttggttyggtggtttggggtttgttyggtttagyggtttatggttyggttttygygttttagttttygtygtygtygtygtygtygt

SEQ ID NO: 4693 - DNA, 298 bp, synthetic construct
  misc_feature 1..298: note = Description of Artificial Sequence: Synthetic polynucleotide
  source 1..298: mol_type = other DNA
tyggttttgggtggyggygtyggggtagygygttyggtygagtyggggagaggagygygggagattyggagyggagyggtaggagagygyggagygaagyggtaggagtagtttatagttaggagygttttttygtttttaaygtygygtttttttttttaaaayggtttaaaaaaatttattaattgtatggtygygtatttttaaaaaggtattygtygttatttggtttyggtgaattttaggaggyggaggaagggygyggggtgggtgyggtgatatygtgggaggtggtttt

SEQ ID NO: 4694 - DNA, 272 bp, synthetic construct
  misc_feature 1..272: note = Description of Artificial Sequence: Synthetic polynucleotide
  source 1..272: mol_type = other DNA
tatttatttygattygaggttgtttattyggtttggtatgtttyggygtttttggggtttttgtatttygttggtttttygttgtggtgtttygtagttygattatttttgtgtttttaggagtttattttgggyggtagggaggygttgygtggggtttaygagttttaygttgttatttttattagtttttattttttaggygtttgttttttygtattgttaggttttgttttygtagtatttggtagatttgagttyggtttttgtta

SEQ ID NO: 4695 - DNA, 201 bp, synthetic construct
  misc_feature 1..201: note = Description of Artificial Sequence: Synthetic polynucleotide
  source 1..201: mol_type = other DNA
tttagtaatatttgtagggttggtttttyggtygtttatttygttagtttgggtttttgtgtggagtgygtttttgtgtttttggttagtygtyggttaygtgtattttttgttaggggttggtaggttttttatttgtttaaattagaaatataaggtatagtggtttttagttgagggatggtatttttttttatgttt

SEQ ID NO: 4696 - DNA, 251 bp, synthetic construct
  misc_feature 1..251: note = Description of Artificial Sequence: Synthetic polynucleotide
  source 1..251: mol_type = other DNA
taygtttttygygttygttygygtttgttttaggtttttatygyggttttttttgttttyggggtygttttgttttttatagattttattttygggggtygtttttaggattttygttygtttttttttgattyggtttttgttygtttygtttttttttttygggttttttatttttttttygtyggtttygatttygggggygtttyggatttgtttttygaatatttttagtttygtttttagtttgc

SEQ ID NO: 4697 - DNA, 249 bp, synthetic construct
  misc_feature 1..249: note = Description of Artificial Sequence: Synthetic polynucleotide
  source 1..249: mol_type = other DNA
yggyggtttttatttggagtygtatttggggygtygagtttyggggtygyggaaagaatgygygtygttygtgygtttygtttgtygygtttggttattygtagtygtygygttygtatttgattatggagtgygtttttttgttygygtgtgttttttyggttgygggttygggttygtygaggggtttggygggattggggygygtggttaaggtaggtgtygtygagyggagtttygagagygggt

SEQ ID NO: 4698 - DNA, 249 bp, synthetic construct
  misc_feature 1..249: note = Description of Artificial Sequence: Synthetic polynucleotide
  source 1..249: mol_type = other DNA
tttttagagttaattttttagatttggaggtttttaaggttttygtaatttagtgagtttyggggtattaataaattttygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggat

SEQ ID NO: 4699 - DNA, 201 bp, synthetic construct
  misc_feature 1..201: note = Description of Artificial Sequence: Synthetic polynucleotide
  source 1..201: mol_type = other DNA
ggtygyggyggtyggggtyggtgtyggygtttttttgggyggtagyggygaggagatgggtttygtygtygtygtggtgttygtygtgatygtygyggtygtygygtagagyggygygggttygtattattattattattattattaygtygtyggttattattattattygayggtyggygygttyggygtygygggtag

SEQ ID NO: 4700 - DNA, 201 bp, synthetic construct
  misc_feature 1..201: note = Description of Artificial Sequence: Synthetic polynucleotide
  source 1..201: mol_type = other DNA
atggtttaggyggtygtttygygygttttagtttygtygygygtttgagttyggtgyggygttagaagatagygygtagtygtttttgagtygtggaggyggggattaagttggaaggagtagygattttyggatygagtygygagtgtgygtygttygtygttygtyggatttttyggatttttygatygtaagtgtygt

SEQ ID NO: 4701 - DNA, 251 bp, synthetic construct
  misc_feature 1..251: note = Description of Artificial Sequence: Synthetic polynucleotide
  source 1..251: mol_type = other DNA
atygygtagttygygttttattgtygatyggattttaygttgttgtttttagygttgygygttttgygyggattygygttgttggaygtygttatttygygtttggggtttaygygagtygygagtttttgtttgtttttgygttatttygatttygygttttgtattygtttygggttygygtttygygttygtaygtaayggtattyggttttgtataygyggttggttttaygygttgttyggygtyg

SEQ ID NO: 4702 - DNA, 201 bp, synthetic construct
  misc_feature 1..201: note = Description of Artificial Sequence: Synthetic polynucleotide
  source 1..201: mol_type = other DNA
ggggtttygttgagttgagttttgygattyggtttatgtgaygtgagttttattttaatttaagtgtgaggaagygaatagygttttgaaaygtagaaaygtgtttattygaattgttaaygygagygtagagtttattgataaagtaaaataagataaatygggagttagaaaatttagygatttataggatttatygtg

SEQ ID NO: 4703 - DNA, 201 bp, synthetic construct
  misc_feature 1..201: note = Description of Artificial Sequence: Synthetic polynucleotide
  source 1..201: mol_type = other DNA
ttttagaattygygggttattygggagtttttttygtagtattagtygaaagtttttagtgtygaggagggygggtagttgtttttttygatttygtttygttygygyggaygttttyggttttaygyggggattatttygggattttygtyggatttygygygttygyggttaatttgygtgtatttgygtttygygtta

SEQ ID NO: 4704 - DNA, 201 bp, synthetic construct
  misc_feature 1..201: note = Description of Artificial Sequence: Synthetic polynucleotide
  source 1..201: mol_type = other DNA
aggtygagttygtayggygttttygtgtagttagyggttagtgatygygyggttygggygtttttygygygttttagttttttagayggggttyggaygyggaygttttttttgtagttttgttttgatygttagggatgggttttgggtatttagyggttgagggtggggagyggttagygtttgatgtttagtttttta

SEQ ID NO: 4705 - DNA, 337 bp, synthetic construct
  misc_feature 1..337: note = Description of Artificial Sequence: Synthetic polynucleotide
  source 1..337: mol_type = other DNA
gtggtttygttttagggtygyggggaggygttttygtgyggggyggagttgttatygttttttttttaattttyggggattgtggtttttttttaagttygyggygtttttagttgttttttattygtttygttygttagtttttttttygygygatggtttyggygttgagttatgtttttaagtttaagtttttygtgattttgttygttatttygtttttgttgttgttattygttattttgatgttygttaaggttagttgtatttttaggtagtttttyggatattyggygttttgtgtttattaaygggtatygatttygggagttttgag

SEQ ID NO: 4706 - DNA, 201 bp, synthetic construct
  misc_feature 1..201: note = Description of Artificial Sequence: Synthetic polynucleotide
  source 1..201: mol_type = other DNA
tgttttyggygttttaygtgtggyggyggttagyggyggtttaggaggtagtyggtgagygtttgygagtagagtggygggggtygttgataggtttygygtagtttagtttagtttagttaygyggtttataggtggggtttaagagtagtttggagtaattyggygttayggagaggggtggayggttttgtaygggtt

SEQ ID NO: 4707 - DNA, 201 bp, synthetic construct
  misc_feature 1..201: note = Description of Artificial Sequence: Synthetic polynucleotide
  source 1..201: mol_type = other DNA
ttttttgyggygaggtygtttgatgaatttaagggtattagtgtttygygagaattttttgtgggttgtgaygagaattaagyggagygtaatttttatygtattyggataggatgygttgygtaatttgtygtagtttttttgttttatttygggtggttygaagttgtaattttgttaattttttattataygttatgt

SEQ ID NO: 4708 - DNA, 201 bp, synthetic construct
  misc_feature 1..201: note = Description of Artificial Sequence: Synthetic polynucleotide
  source 1..201: mol_type = other DNA
ttttgtagttttgtttagattyggaagtygtygaggaagggaggaaggygggggtggggagagygygattttaagygttggygggyggygaggaggggtygtagyggttygaggaagygtttggaggygttaggggygtygagtttttagggaggtygygttttygggaagttttttatyggttgttyggagtaggatygg

SEQ ID NO: 4709 - DNA, 1216 bp, synthetic construct
  misc_feature 1..1216: note = Description of Artificial Sequence: Synthetic polynucleotide
  source 1..1216: mol_type = other DNA
gaagcgaagaggggttttttgatttgtaatatagaggaaagcgtcgttttcgtttagtttggtatttacgcgtttatacgtattcggcgtcggtcgggtcgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcgcgggtggtggggggcgttgtgtttagtaggggcgatagcgtaggcggggttttttgtagtttttttttttattttcggtcgcgtttcggtttttattttg

SEQ ID NO: 4710 - DNA, 365 bp, synthetic construct
  misc_feature 1..365: note = Description of Artificial Sequence: Synthetic polynucleotide
  source 1..365: mol_type = other DNA
ggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtt

SEQ ID NO: 4711 - DNA, 201 bp, synthetic construct
  misc_feature 1..201: note = Description of Artificial Sequence: Synthetic polynucleotide
  source 1..201: mol_type = other DNA
gcggaaagtaaggcgcgtttatagtcgtttttttttttggaagttcgcgtttatttttgcgcggcggtcgtttcggaggcgtcgggttgggcgtgaggacgtcgtatttattattgggttcgcgagcgtcgttagtttagtcgttttttttcgtaggttcgggggtagcgtatttcgtaggttttataagtcgttacgtta

SEQ ID NO: 4712 - DNA, 201 bp, synthetic construct
  misc_feature 1..201: note = Description of Artificial Sequence: Synthetic polynucleotide
  source 1..201: mol_type = other DNA
gcgttggttgggtagtttttgggagatgaagcgacgtaggcgttttaggtattggttgtagagttcgatgtcgttgtgttcggcgttttttatttatagcggttttatcgttttggggtagcgttcgtagagcgttagttcgtgcgagaagtcgattatttcgtttttcgtgtcgtggatgatgagtacgggcgacgtgat

SEQ ID NO: 4713 - DNA, 201 bp, synthetic construct
  misc_feature 1..201: note = Description of Artificial Sequence: Synthetic polynucleotide
  source 1..201: mol_type = other DNA
tcgttttggtcgaagcgtagttcgagcgtcgcgacgcgttttacgcgtaggaagtcgtcggggtcgcggtcgtatatttcgaatatttcgcgtaggcggcgtacggagcgtagtagagtcgcgggggcgttcgattagttcgcgtcgttcgttattcgggtcggttcgtagtttagttcggatttttcgttcgtcgcgttc

SEQ ID NO: 4714 - DNA, 201 bp, synthetic construct
  misc_feature 1..201: note = Description of Artificial Sequence: Synthetic polynucleotide
  source 1..201: mol_type = other DNA
cgtttcgcgttatgtatatttattgtggtgatgagagttcgcgtttcgtgttcgttacggttattgtgcgtttaataaaaataaatattgtcgaggagtcgtcgcgatgcggggcggacgcgcggttcggaaaggggagggggttttaggaagagttatattcgcgagtcgggtttgggttaggggcgaggggagagcgtt

SEQ ID NO: 4715 - DNA, 201 bp, synthetic construct
  misc_feature 1..201: note = Description of Artificial Sequence: Synthetic polynucleotide
  source 1..201: mol_type = other DNA
gtggttttttggtttttttaggtagttaatattataattttttttgggagggggttcgtagaagggcgcgcgttgtttttttcgttttttaagttgtagcggggcgggtcgggagttagggttagggtttggagatttgggaggggatcggtgttagaagcgaagagttagggttagaaagttaggttaattaaggggggg

SEQ ID NO: 4716 - DNA, 201 bp, synthetic construct
  misc_feature 1..201: note = Description of Artificial Sequence: Synthetic polynucleotide
  source 1..201: mol_type = other DNA
ggagaagggggttcgtgtaaattttaggttgacgatcgcgtacgcgtttttcgggttattagttttgtcgtttttggtggggtatatcgaggagatcgtcgtggggaatcggggatcggattgtttgatagtcgagcgttgaagattattttttttgagtttagggaggtttggttgttttgagttttttatttttgggtt

SEQ ID NO: 4717 - DNA, 213 bp, synthetic construct
  misc_feature 1..213: note = Description of Artificial Sequence: Synthetic polynucleotide
  source 1..213: mol_type = other DNA
ttttgcggttggttaggaggagtttttcgtcgtttttattttagtcgcgtcgggcgttgggttcgatttttagtatttttggtattgatgtgtttggtgcgcgttgagacgcgaacgttttgtaagatgagtttttatttattcgtttttttttttttttatttgtttattttataaattgagtgtttggttattttggtttaggtaagaggt

SEQ ID NO: 4718 - DNA, 201 bp, synthetic construct
  misc_feature 1..201: note = Description of Artificial Sequence: Synthetic polynucleotide
  source 1..201: mol_type = other DNA
gtttagcggtttgtatcgagagttaggagaggtttagatcggatttcgatttttcgaggcgcgggagtttacggagcgcggtgggcgcggcgttcgggtcgcgtagttaggtggggagcggcgcgtagttttagattcgtaggtaggtagcggcggattgtatttgtttcgtttcgtagcgttttttgtttgtcgtttttc

SEQ ID NO: 4719 - DNA, 201 bp, synthetic construct
  misc_feature 1..201: note = Description of Artificial Sequence: Synthetic polynucleotide
  source 1..201: mol_type = other DNA
gcgttcgaggtcggcgcggtggggatcgcgggtttattattagttaagtttagttatttaattatttgtagagttgttgtaggtataggtttaggttttcgttttttattttttcgcgggtgatgcgttttgatagcggtcgcgggagcgggggtaaaggcggtagttggggcggcggcggcggtacggtcgagtgtttcg

SEQ ID NO: 4720 - DNA, 201 bp, synthetic construct
  misc_feature 1..201: note = Description of Artificial Sequence: Synthetic polynucleotide
  source 1..201: mol_type = other DNA
tcgtaaggggtattcggttttgtgcgcgggggcggcgggggttttgcgcggggtcgggttgggtcgggttgagttggttcgtttcggcgtcggggattacgcgcgattggttagattttgtcgtgatttttggaaaattgtgattattttatatgttttgtttagttcggattttttgcgttaacgagttaggtttttttt

SEQ ID NO: 4721 - DNA, 324 bp, synthetic construct
  misc_feature 1..324: note = Description of Artificial Sequence: Synthetic polynucleotide
  source 1..324: mol_type = other DNA
cggggttcgggttgggatcgcggggtgggcggtttcgagagcgtttcgtagtggttggagttttgggcgttgtaaagcgtgtttcgtcgggttttcgagcgtttcgcgttttcgtttcgttatgtttttgttgttggggttgtgtttggggttgtttttgtgtgtggggtcgtaggaagaggcgtagagttggggttatttttcggagtaggtaagtggagtcgaggggagtcgggtttcgggcgcggtcgttttttttttttcgtcggttcggtcgcggagtttttgttcgggtttttttcgatcgttttttaggtttttatt

SEQ ID NO: 4722 - DNA, 201 bp, synthetic construct
  misc_feature 1..201: note = Description of Artificial Sequence: Synthetic polynucleotide
  source 1..201: mol_type = other DNA
gagggggcggttggaggattcggatttttaagaatttggttttgggttttgattcgggcggtcggagagaaggcgaagaagaggtcgagtagataggcgcgcggcggacgcgagagaaggacgcgggcgaagcgtttaagacgttcgtttttagggtcgtcgagttttttttttttttcgtttggcgcggtagtatcgcgg

SEQ ID NO: 4723 - DNA, 330 bp, synthetic construct
  misc_feature 1..330: note = Description of Artificial Sequence: Synthetic polynucleotide
  source 1..330: mol_type = other DNA
agtttagtttagttaagtagtagagagaataggacggaggtttttattttttagggattgtagcgtttttaaatcgtttatttgcgacggtttcgcgagcgtgcgtagtttagtttttttcggacgttttcgttttcgttcgggtatatcgtgtttcgtatcgaggtagagaggggtacgcggattttagtttttgcgagtttttttgttcgtcgttattttatatttcgtattgttttagttgtcgttttagaagatgtatcgtttggcgcgtaaagcggtgtacggtttttagttcgcgcgtagtagtttggaggggcgttagagttt

SEQ ID NO: 4724 - DNA, 293 bp, synthetic construct
  misc_feature 1..293: note = Description of Artificial Sequence: Synthetic polynucleotide
  source 1..293: mol_type = other DNA
gcgttttagttcgtggcgttgtcggcgtagatttcgcgtggggatcggcgaggttaattttttttgcggttcggggtcggtagagtacgtaaggggtcgcgggtcgcgtgggtttgggcgcgtcgtggtgggtaagcggggttagcggagcgggaattcgtatatttttcgagcggagtcgaggataggttcgtgcgggtcgcggggtttttttggcgttaggaagcggcggtcgaaggagataacgagaacgtagtttcggtttagggaggtttaaaagttgagatgttgaa

SEQ ID NO: 4725 - DNA, 201 bp, synthetic construct
  misc_feature 1..201: note = Description of Artificial Sequence: Synthetic polynucleotide
  source 1..201: mol_type = other DNA
atcgtcggcgtcggtagttagagcgggatttagtttttatcgcgttttttattggagtttttttcggtttttcggcgagtgcggttcgtggggagtgggcgtcggcgcgaggaagtttttcggttcgggcgatttcggtttttgagcggtttttttttacgtcgtcgttcgttaggtcgacggaggatcggggcggggacg

SEQ ID NO: 4726 - DNA, 201 bp, synthetic construct
  misc_feature 1..201: note = Description of Artificial Sequence: Synthetic polynucleotide
  source 1..201: mol_type = other DNA
cggcgttttacgttttttttttggagtaaattcgtttcgttttttttttggagtaaattcgtcgtattttcgtttgtatcgaaattttgagcgtcgtttcgcgttatttttagttcgcgttcgcgttgttttttttttcgggtcgtaggttgagaggttgggtcgtattttggttacgttttgttcggttttagcgggata

SEQ ID NO: 4727 - DNA, 226 bp, synthetic construct
  misc_feature 1..226: note = Description of Artificial Sequence: Synthetic polynucleotide
  source 1..226: mol_type = other DNA
tcggggttgttagggcgtcgggttcgtgcgcggatattgggggcgtattcggttttcgggttaggcgcggttggagatttcgaggttggggttttgaagcgcgtaagtatttttttttttatcgcgtttttgtaagtagtttgaagttttaagtcgttgtttacggattttcgtttttaattttttaattgaaaaaatttgtcgaggagagtggaggtatcgttat

SEQ ID NO: 4728 - DNA, 363 bp, synthetic construct
  misc_feature 1..363: note = Description of Artificial Sequence: Synthetic polynucleotide
  source 1..363: mol_type = other DNA
tattcgggcgcgggagtacgggcgggtcgggggcgtttgggtcggtttgtcgtggttcgggggttcggggcggcgcgatttatttggcgttttcggggtcgcgatttttttcgggaggtgtttgcgaaggcggttttgtcgcggtgggggtggggaggttagggtttcggatcgttggagttggggtcgtagttagtttttggcgagtgttttttggttgttgtcgtaggggtttgttttttcggattttttttttaatttcgtcggatttttttttttttttttttacgttcgttaagtttatggtttttgtaatgcggtgggtgtggttatttagtaaattgtaattgtggttttttgtaa

SEQ ID NO: 4729 - DNA, 201 bp, synthetic construct
  misc_feature 1..201: note = Description of Artificial Sequence: Synthetic polynucleotide
  source 1..201: mol_type = other DNA
tttttcggagtgggggattgcgagggggtttcggttttacgaggtgcggaggaagagttcgaggtttggggcgaggcgcgcgggatagtggggttgacgcgtggtttcggcgtcgcgcggtttttcgaatttcgagtttcgcgttcggcgcggtcggggtttttaatcgttttttcgttcgtcgggatttttatcgggtcg

SEQ ID NO: 4730 - DNA, 201 bp, synthetic construct
  misc_feature 1..201: note = Description of Artificial Sequence: Synthetic polynucleotide
  source 1..201: mol_type = other DNA
ttcgttcggcgttgtattttttcgtggttcggttgtaaggatttgcggtggaggtttggcggaggcgggttcgcgttttagagagagcgttacgttattcgagaaggcgacgttgggggttgttgagttttttaattttttttggcgcgttttgtttagaagtcggggagtttttggtcggcggttggcggggaagcgcgg

SEQ ID NO: 4731 - DNA, 267 bp, synthetic construct
  misc_feature 1..267: note = Description of Artificial Sequence: Synthetic polynucleotide
  source 1..267: mol_type = other DNA
ggtgagttattgggatttcgttgttagggagtaagttggtaggtaggaagtagttaagatttgggggaattttttttagggaacgaatatagagaaggacgtatttgaaaatttcgtcgtagttattttttttttatgggaaagtttcgatttcggcgggtttagcgttattcggtttttcggggtgtggaatattgagcgaggtaggtgcggcgggagtatgcgcgcggggcgggtagggggcggttttcgcgtttttatttcgcg

SEQ ID NO: 4732 - DNA, 707 bp, synthetic construct
  misc_feature 1..707: note = Description of Artificial Sequence: Synthetic polynucleotide
  source 1..707: mol_type = other DNA
agggaatggggagggttacgtatattttgtgcggttcgagtggttcggatggtatagtttaggtgttcgggttaaagttggtatttttaaagtttagaacgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcgtcgttttgtttgcgttgtcgttttcgttcgtcggtcgggtttaattggtttttagcgtcgcggcgttagttcgtttttttgtagtcgtcgacgttatcgt

SEQ ID NO: 4733 - DNA, 201 bp, synthetic construct
  misc_feature 1..201: note = Description of Artificial Sequence: Synthetic polynucleotide
  source 1..201: mol_type = other DNA
tggtgttgagtgcgggtcgggtcgtttttcggcggcggtgggtgggcgcgcgagggcggagggggtcgggagttttggtttcgaggtagcgaggagagacgggtaaatagtagagcgttaagttaagtttttaaagtgttaatagttgtagaagttcgaattttagcggttttaggggcgcgggtatagggttttgggttt

SEQ ID NO: 4734 - DNA, 201 bp, synthetic construct
  misc_feature 1..201: note = Description of Artificial Sequence: Synthetic polynucleotide
  source 1..201: mol_type = other DNA
gttgttcggggttgttgtataagtcggtgatattgttttgcgggtttacggtttgtgagcgttgcgtggagttggggttcgcgcggttacgggcgcgggcgcgggcgcgggcgcgtgaacgtagtgttgagtcgtttgttggagaggtttttttcggtcgagtgttcgttgcgtaggttggagggttaggcgcggagtttg

SEQ ID NO: 4735 - DNA, 201 bp, synthetic construct
  misc_feature 1..201: note = Description of Artificial Sequence: Synthetic polynucleotide
  source 1..201: mol_type = other DNA
agttagcgcggttttcgggtttttgcgtttatggcgagggtcgcgggggaatagtttttggtaggtaatttgtcgggtatttatttgagtttttcgtatcgcggttcgaaaatttgggagcgttttaggataaagggttagttttttggaattagtcgtgtgtgattagtgtgtgttagttcgtatgtgggggttttagtg

SEQ ID NO: 4736 - DNA, 201 bp, synthetic construct
  misc_feature 1..201: note = Description of Artificial Sequence: Synthetic polynucleotide
  source 1..201: mol_type = other DNA
gttgcgtaggtatcgggtttcgttcgggcgtcggggtagggttgtcggggttagtaggtttttcgcgttttttttggcggggttttaggggttggattgcgggttttttttgtttttttttcggggtcgagtaagttcgcggggggtgtttttaggtagtaggagggtgaggtaggataatttttaggttttgtagttttt

SEQ ID NO: 4737 - DNA, 203 bp, synthetic construct
  misc_feature 1..203: note = Description of Artificial Sequence: Synthetic polynucleotide
  source 1..203: mol_type = other DNA
atttttaaagaatgataaaataaagaagcgtacgttaggtttttaaggagatatcgtttttttttttttattattttttatttttattagattttttatcgcggattaaagatgaatttgttattaattaagtttttgtttaagttattttatttttcgtagtttttttatttgtcggggcggtgttcggcgtattttaggtt

SEQ ID NO: 4738 - DNA, 201 bp, synthetic construct
  misc_feature 1..201: note = Description of Artificial Sequence: Synthetic polynucleotide
  source 1..201: mol_type = other DNA
tgatcgggcgtcgaaacgtcgggagtcgggggttaagggttcgagttaggaggtttcggagtagtagtcgttcgttttttacgtcgtcgtcgtcgttttcgcggttgtttggatacgggataatcgatttggggtttcgatcgtagtagagtcggaggggtgggtaggcgcgggttcgggagacgcgcggggaaacgcgcg

SEQ ID NO: 4739 - DNA, 201 bp, synthetic construct
  misc_feature 1..201: note = Description of Artificial Sequence: Synthetic polynucleotide
  source 1..201: mol_type = other DNA
ttattttaaagcggtagcgtatttttagagttggttttttttttcgtttcgggttttcggatcggttgtaggagttttttttttcgggtcgggcggcggcgtttggcgttttcgggttgggttattgttttatgtttttttttgggcgtttggcgcgtgttttatcgtcgttatcgcgtttaaaggttaggttggaagttc

SEQ ID NO: 4740 - DNA, 208 bp, synthetic construct
  misc_feature 1..208: note = Description of Artificial Sequence: Synthetic polynucleotide
  source 1..208: mol_type = other DNA
gggggcgttttattgattttttttggcgtttgtttttttttttaggttgcgttttttttatttattgcgagcgtgagttagcgttgaaggtttagagcgcgttgtacgagtagaagattttgttcggggtaagtggcgttcgtcgtggcgtaagcggtcgacgcgtcgatagggggcgatttcgggaggtcgggcggcggcgcggcgc

SEQ ID NO: 4741 - DNA, 201 bp, synthetic construct
  misc_feature 1..201: note = Description of Artificial Sequence: Synthetic polynucleotide
  source 1..201: mol_type = other DNA
tattgatgaatgcgcgttcggattttcgggcggattttttttaagtcggttcgtttttttagtttaaataaataaataaagttagatggaagaaaaaagcgtttattttattttcgtcgtcgtttcgttcgttatttttgtttttgtttcgttcgtttggcgttttaatagagtatagtttggtggataaagtttttttat

SEQ ID NO: 4742 - DNA, 201 bp, synthetic construct
  misc_feature 1..201: note = Description of Artificial Sequence: Synthetic polynucleotide
  source 1..201: mol_type = other DNA
gaaaggaaaaagcgatatttttgtttcgtatagagttaaatattggaagtacgagatagtcgacgtggattaggattattttggtttttcgtgcggcggcggcggcggcggttgcgcgcgggttttttgtggcgcggttttggggcgcgggcgcgggcggcggcggggttgcgggagtcgtcggggcgggaggcggagcgc

SEQ ID NO: 4743 - DNA, 595 bp, synthetic construct
  misc_feature 1..595: note = Description of Artificial Sequence: Synthetic polynucleotide
  source 1..595: mol_type = other DNA
tttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttggtttacgagtttaagatggatgcgtttattatttcggtgattatggaggtgtcgtgcgatagtcggggttaacgtatgtggtgggtttttttggtttttt

SEQ ID NO: 4744 - DNA, 201 bp, synthetic construct
  misc_feature 1..201: note = Description of Artificial Sequence: Synthetic polynucleotide
  source 1..201: mol_type = other DNA
tttttttttttcgtttttttttttttttggagaagagagttggtgttaagagttagggattttggttgtgtgtttgcggatttgtagtggcggcggcggcggcggcggcggggaggtagtaggcgcgggagcgggcgtaggagtaggcggcggcggtggcggcggcggttagatatgaacgtcgtttcggcgtcggcggtg

SEQ ID NO: 4745 - DNA, 269 bp, synthetic construct
  misc_feature 1..269: note = Description of Artificial Sequence: Synthetic polynucleotide
  source 1..269: mol_type = other DNA
tttatcgatcgtattatttgatcgcgggaaacgaaatttgagtttaggaatttgaattgttttacgtacgttcgttttcggataaattttttagaggatcgtgatttttttatttagagattatttagggagatgttttggatgggataagtagataaatggcggttcgaggaaaatgtaggaaattttatattgtagacgtttaagtattaattgtttgggtttcggggtagggaacgggagatattatttatcggaaatattatatt

SEQ ID NO: 4746 - DNA, 201 bp, synthetic construct
  misc_feature 1..201: note = Description of Artificial Sequence: Synthetic polynucleotide
  source 1..201: mol_type = other DNA
cgcggtcgcgaggcggggttggagggcgttgcgggttgcgcggaggttgcgggaagcgcggggagtacgcggagttcgattagtagggagatcgcgtcgcgtcgggtataggtacgggattcgcgttttaggagggcgtagcgagaggcgtattgcgtatttaggggttgcggtttcggtcgtcgtgcggtgataagttga

SEQ ID NO: 4747 - DNA, 267 bp, synthetic construct
  misc_feature 1..267: note = Description of Artificial Sequence: Synthetic polynucleotide
  source 1..267: mol_type = other DNA
tgaaatttagaggaaaataaaaatgtagcggtttttacggaggtttttggtttgtaggatatttgagggtggagataaggatgtcgcggagggaggattcgggagttcggtcgcgttttttagtttcggtattcgcgtttagcgcgtcgcgtttcgcgtttttcgcgcgtggtcgtttttcgcgggtcgggtcggggttgcgttgttatttagcggtcgcgcgtttagcgtcgcgttatcgtttttgtaggtcgtcggggtttttgt

SEQ ID NO: 4748 - DNA, 287 bp, synthetic construct
  misc_feature 1..287: note = Description of Artificial Sequence: Synthetic polynucleotide
  source 1..287: mol_type = other DNA
ggtttagatttcgcgagtttcgggtttcgtttattcggtcggcggttttttcggggcggagcgcggcgtttttggagtcggtatttcggatttcggcgtcgtttcgcgtatcgttttcgttttagtttttagtggcgcggcgttttttcgcgatattcgcgggtttttaggagcgagtcgattttcggttgggtttggagtcggggttaagtttattcggagggagtacggagtttatttagttgtttttgggggtaggaggtttaggttttattttgtatatcgtt

SEQ ID NO: 4749 - DNA, 201 bp, synthetic construct
  misc_feature 1..201: note = Description of Artificial Sequence: Synthetic polynucleotide
  source 1..201: mol_type = other DNA
cgatttggtattagcgcggaggttattttgcgtagtcgggtaggtacggcggtttttaggtattttcgtagtagttttagtttttggttcgcggcgtcgcgagggcgagaattcgtgggcgtcggttttttttttcgtcgtcggtgttttgtaaagtggaggtcggcgttttcggcgttttcgtcgcgttcggggtaggtc

SEQ ID NO: 4750 - DNA, 201 bp, synthetic construct
  misc_feature 1..201: note = Description of Artificial Sequence: Synthetic polynucleotide
  source 1..201: mol_type = other DNA
cggaggtttacgttgagttcgcgtagcgcgtacggttcgtcggcggcggtggttttcgcgttgcgttgtgttcgattcggttcgcgcggatttcgttcgcgttattttacgcgtaggttttgtagcgtttttaggagtagtagcgttcgtaggggatcgtcgaggtcgtcggggttatttgggtagagcgcgagtaggcgc

SEQ ID NO: 4751 - DNA, 286 bp, synthetic construct
  misc_feature 1..286: note = Description of Artificial Sequence: Synthetic polynucleotide
  source 1..286: mol_type = other DNA
gcgcgggaggcgtcgggggtcgcggaggcggggcggggaggggtcggcggcggcggcggcgcgcggaggagatcgtagtgcggtcggcgttaggattcgcgggggttttttaggtcgcggcgtttttcgtttttttttatttttcgattttttttcgtttttaaaatgaggaaacggagtaattcgttttaagttgtgtagtcgggatcgtttcggggtgtgtagtcggttcgcggaggtttttttgggggcgggcgcggggcgcggttcgggggcgttttttgag

SEQ ID NO: 4752 - DNA, 244 bp, synthetic construct
  misc_feature 1..244: note = Description of Artificial Sequence: Synthetic polynucleotide
  source 1..244: mol_type = other DNA
aatgtttagtattatttaaaaagaaaattatatatattagttaatgatatattttaatttttaataaagttggtatttttttttgattatagattttgtcgtggtaaattcgggtttcgacgatagaggtagcgtagaagttcgtttttaaatgagataattttattaaaattataattttttgtatttttatagcgtttttttagtggcggagattttaggtgttttacgttagggtttatta

SEQ ID NO: 4753 - DNA, 201 bp, synthetic construct
  misc_feature 1..201: note = Description of Artificial Sequence: Synthetic polynucleotide
  source 1..201: mol_type = other DNA
gttttaattttttttcgagatttcgggcggcggggattttttttcgggtggttgcgtgcgcgtttagtaattcggtgggtggaggtttggagtttcgttcgcggtcgttttcgttgattttttagtgtttttgtttgttttttagagtttaggtagttagtttttcgttaggaaggtagagtagcgagattttcggtttac

SEQ ID NO: 4754 - DNA, 372 bp, synthetic construct
  misc_feature 1..372: note = Description of Artificial Sequence: Synthetic polynucleotide
  source 1..372: mol_type = other DNA
ggattcgtcgtttaggttcgcgtggggatcgtagggaattcgcgttacgtcgggggttattgtttatcgcgaggtgttgaagtggtttcgtgatcgtcgcgggtcgtggttgatatcgcggagaagttaggatttttatagtttttgttagatttgaaagtaagttggaaatcgatagttgttttagttgttttagattttaatttggtttgggttttttttttttttatttgaaaatagatttagggtaatgtttaagagaattttaatcgacggaagtggtcgggaaattttgttttcggtattgagggatgttatcggagatttttttgttttaggtttgtcggagtttattatattcgttaatgttat

SEQ ID NO: 4755 - DNA, 201 bp, synthetic construct
  misc_feature 1..201: note = Description of Artificial Sequence: Synthetic polynucleotide
  source 1..201: mol_type = other DNA
aattttttcgtgttttttgtataatttgggagagacgtagcgttgtgggtgtagagttgtttagagagggttttaggttagggtagggaagagataggacgtcgcggggttcggttgtcggcgttgttgttattttatggttgaaggggattgaggtcgaattgggtaaggagaagtcggtcgtagattgtggagttgatt

SEQ ID NO: 4756 - DNA, 247 bp, synthetic construct
  misc_feature 1..247: note = Description of Artificial Sequence: Synthetic polynucleotide
  source 1..247: mol_type = other DNA
ggggtaggattttagaagttatttaattagggacgttgggttggaaatcgtttaattaggtacggggtaggagaggatagggcggttttcgggatgtggcggggtttttgtttttggttgtagttggagttttgcgtttcgttttcgtttttttgtgttttttgttgttagaggtttagtttttgtggttttgtgatttgcgggtattgggggatttatagttaagacgttaggatttttcggaagt

SEQ ID NO: 4757 - DNA, 201 bp, synthetic construct
  misc_feature 1..201: note = Description of Artificial Sequence: Synthetic polynucleotide
  source 1..201: mol_type = other DNA
tcgttttttttttcgggatgtcggatcggtatttttattatttttaggtttttagggggttttggcgttttagttgtggattttttaatattcgtaggtcgtagggttatataggttgggtttttacgtgtagaggatataaagtagatagacgaaaattggagtttcggcggtagcgagaaataaaggtcgcgttaaatt

SEQ ID NO: 4758 - DNA, 201 bp, synthetic construct
  misc_feature 1..201: note = Description of Artificial Sequence: Synthetic polynucleotide
  source 1..201: mol_type = other DNA
ggattttgagttggggatcgtttaattaggtacgtaattggagcggatagggcggttttcgggatttggcggggtttttgtttttcgttgtagttggagcgtttggtttcgttttttttgttttgtgttttttgtttttagaggtttagtttttgtggttttttgatttgtaagtattgggagatttatagttaagacgtt

SEQ ID NO: 4759 - DNA, 235 bp, synthetic construct
  misc_feature 1..235: note = Description of Artificial Sequence: Synthetic polynucleotide
  source 1..235: mol_type = other DNA
atttcgttttttgtaagtttgtaatatttcgtatttagattcgtaatttaggcggaggataaagggttgtagcggagggcgtagagtagatgtttagggcggggtagagggggcgggaagttggcgttacggtcgcggcgagggcgagtagtcgcgcgttttcggtgttaggaggaatgttcgtagagcggaggttggtaggcgcgagaggttttaagcgcgtagttcgattaag

SEQ ID NO: 4760 - DNA, 201 bp, synthetic construct
  misc_feature 1..201: note = Description of Artificial Sequence: Synthetic polynucleotide
  source 1..201: mol_type = other DNA
gcggtatttcgttttcggttttgcgcgtttatttcggggcgcgtcgaggttatcgtagggtatttatttggtatttgtttttgagtgtgtagatcgtcgcggtttttatttgggtttttaaataagttttagggagaaagaaggaggtaaaaaaaaaaaatttaattatgtaaatggatttcggattgggaggcgcgggat

SEQ ID NO: 4761 - DNA, 201 bp, synthetic construct
  misc_feature 1..201: note = Description of Artificial Sequence: Synthetic polynucleotide
  source 1..201: mol_type = other DNA
gtcgcgttaacgaacgtaggcggcgggaggttcggcggcggggttcgcgtttttgtatcgcgatcgcgttagaaaatatttcggggttgggcggcgtttcggagacgtatttttttgttatttttatcgtttttggtaacgattattaatgttattatgttttatttttttttattttttttcgtttttagagtcgcgttc

SEQ ID NO: 4762 - DNA, 201 bp, synthetic construct
  misc_feature 1..201: note = Description of Artificial Sequence: Synthetic polynucleotide
  source 1..201: mol_type = other DNA
aaagagggagaaagagattaaaaaaagaaaaagataaggggagggggaaggaaggaaggagagaaggaggaagaagtttggggtttgttgttttaggagcgtttaggtagtcggtgttggagcgcggggcgttcgttttcgtcgggattgtcggtttcggggtttgcgagagcgttagagttttagtcggcgcgttcgggc

SEQ ID NO: 4763 - DNA, 201 bp, synthetic construct
  misc_feature 1..201: note = Description of Artificial Sequence: Synthetic polynucleotide
  source 1..201: mol_type = other DNA
gtttttgcgcgcggaaaggcgttggaggcggttttatagtcggggaggttagcggcggcgtatttgtattttgggagacgtttggatttagtttaagttcgtaggttgggcgagcggagatttttgattttatcgtgtgggtgagattattgtttttcggtttaaaagaaaagaaagtatgttgtgaatttttgaaataaa

SEQ ID NO: 4764 - DNA, 201 bp, synthetic construct
  misc_feature 1..201: note = Description of Artificial Sequence: Synthetic polynucleotide
  source 1..201: mol_type = other DNA
tggaatttacggcgtttcgttcgtttcgcgtttaggaatattgtgcgtttagcgtagatgcgtttttacgattttttgtttggttcggggttatgtggtcgcgtatcggtttttgaagtttttatttgattgttggggaaggcgtttagaattaggagcgggttggttggggattggttttcgcgttgggtcgtttcgttt

SEQ ID NO: 4765 - DNA, 296 bp, synthetic construct
  misc_feature 1..296: note = Description of Artificial Sequence: Synthetic polynucleotide
  source 1..296: mol_type = other DNA
tcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggta

SEQ ID NO: 4766 - DNA, 201 bp, synthetic construct
  misc_feature 1..201: note = Description of Artificial Sequence: Synthetic polynucleotide
  source 1..201: mol_type = other DNA
gtcggtcgagtttcgggagtcgaggttggaaacgttggagcgggcgttgtttatcgaaggcggttcgggatcgggacgcgggttcgagcgatcggagcgcgggttgtcgtggcgttggtcgtagtttaggttgatgtcgttggatcgggcgttgtcgttatcgtcgtcgtcgtcggatttcgttaggttggttcgtgggtt

SEQ ID NO: 4767 - DNA, 201 bp, synthetic construct
  misc_feature 1..201: note = Description of Artificial Sequence: Synthetic polynucleotide
  source 1..201: mol_type = other DNA
attcgttattgtgtatttggacgttatttgtagatttagcgtttgcggggatttcggaaacgggagagcgggttttcggaaacggtgattaatgggaaacgtgattagatgttattaggcgaatagttcgtttttaggtaatatagaaggaagagacgtttttagttattttaaaatagacggagtttttagttaatggat

SEQ ID NO: 4768 - DNA, 266 bp, synthetic construct
  misc_feature 1..266: note = Description of Artificial Sequence: Synthetic polynucleotide
  source 1..266: mol_type = other DNA
ggaaatcgttagttttgagcgtcggattttttgtgttgggtgggagtgggggttcgcggttttggtgttttaatttttggaggaggacgtcgggcggggcgatgtttgtgtttgtggttttttgaggtagtgggagtggcgtgtgaaggattgtgagagtttggcgtgaagtgattgttatttgttagatattcgtttggttgagtgtggtttcgggatcgtgttcgtaagcggatttcgtggaggcgtttttttttttatttttt

SEQ ID NO: 4769 - DNA, 201 bp, synthetic construct
  misc_feature 1..201: note = Description of Artificial Sequence: Synthetic polynucleotide
  source 1..201: mol_type = other DNA
taaagaagtcgcgggtatcggtttaataaggtgtagcgaatagtcgttcgttttcgttttaatttatagttttatattttacggtgttattgattttttcgtatttagttatataggacgtggataggtatacggggtgatagtttcgtattgaacggtattaatttttattcgtatcggagttatatagatggtttgcga

SEQ ID NO: 4770 - DNA, 228 bp, synthetic construct
  misc_feature 1..228: note = Description of Artificial Sequence: Synthetic polynucleotide
  source 1..228: mol_type = other DNA
aggatacgttggatagtttcgaaaagatatagtgggtggtttcgggcgtgggtaatcgggtgcggaattatagcgtattcggagttgcgaatttagacgcgggtgattgttgattttttgttttgtcgtttttatttgtgtatgtaggtggcggttagttggggttagggaagcgtggagggtgggttttaatcgagttaagaaaagtttggggtgttttgaattttg

SEQ ID NO: 4771 - DNA, 248 bp, synthetic construct
  misc_feature 1..248: note = Description of Artificial Sequence: Synthetic polynucleotide
  source 1..248: mol_type = other DNA
tcgggattgagtttttgtagttttgaggtttggaggttcgggcggtagtaattgtgtcggattaggttcgtgggtgcggtttgtggtgtagttggagatcgaggtttcgcgtattttcgttcgcgttttagttatttaggttcggtcgtagcgaaaaggtttaagagggaagttagaggtgaacgttttaggatgaaggttttttgtaaaacgttgggatttagatttggggtgggtgtttggggttt

SEQ ID NO: 4772 - DNA, 387 bp, synthetic construct
  misc_feature 1..387: note = Description of Artificial Sequence: Synthetic polynucleotide
  source 1..387: mol_type = other DNA
aagtcgaggtgttggaggacgtgttgcgggagtagttcgggtcgttgttttagttggtcgttgtttgtcggtttaagcggttgttttcgggcggttattcgtttattgaaaatttttagttggtgttggagcggcggcgtgtggttaacgttaaggagcgtgagcgggtgagggatttttagggtcgacgttcgttttttttttttttgttttattattaaatatttggttaatattcgggggttcgtttatcgtttattttcgttcgaggcgatttcgagttttcgaggttttttacgtttttagtttgttaggagaatggtagtggttttttttttttgtattttcgtgtagttgttcgttggcggtcgttgcggtggtcgtttc

SEQ ID NO: 4773 - DNA, 203 bp, synthetic construct
  misc_feature 1..203: note = Description of Artificial Sequence: Synthetic polynucleotide
  source 1..203: mol_type = other DNA
cgatttaggttttttagttttcgtttagtttttcgcgtgcgggcgtcgggatcgtagtatttgtgacgtcgaagtttagtaggtcgtagacgggagttacgcgcggttttggtatagggtaaaaatttacgtttaggtaggcgggtagttacgatgtcgggtaagtttagggtagattttcggtggcgtatagggaagtagcg

SEQ ID NO: 4774 - DNA, 203 bp, synthetic construct
  misc_feature 1..203: note = Description of Artificial Sequence: Synthetic polynucleotide
  source 1..203: mol_type = other DNA
tgcgaataagattaaggcgaggtgaggtttaggttttcgggattgatagcgtcgcggtagggggttcgaggcgggagttggggattttagcgttttttacgcgcgttttacgggggttgtcgttaataaaggcggagggtaagggtgcgtttatttaagtaagggggacggtgggtcgttcgggttgagtagcggagcgtagc

SEQ ID NO: 4775 - DNA, 312 bp, synthetic construct
  misc_feature 1..312: note = Description of Artificial Sequence: Synthetic polynucleotide
  source 1..312: mol_type = other DNA
ggtttaggaggagtcgcgtcgggttcggttataagaggtcggttagtaggcgtttcgttagtattcgttcgatttcggttcggagtatcgggcgtttagcgcgggtgaaggcggagtcgtagggttggtttttaaagggatgttttcgttcgagcggcgagattagtttcgttcgtttttcgtcgcggtcgcgtcgtagtcgtttacggtcgtcgatatggttttttattgcggcgataatttcggagtgtattcgtagttcggtttgttttcgttcgtcgttatcgtcgtcgtttcgggcgttttttcggt

SEQ ID NO: 4776 - DNA, 407 bp, synthetic construct
  misc_feature 1..407: note = Description of Artificial Sequence: Synthetic polynucleotide
  source 1..407: mol_type = other DNA
tttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaag

SEQ ID NO: 4777 - DNA, 295 bp, synthetic construct
  misc_feature 1..295: note = Description of Artificial Sequence: Synthetic polynucleotide
  source 1..295: mol_type = other DNA
attttgggtcgcgggagaagtgcgtgtagttcgggtaaggtcgggcggggtcgggcgcgggcgggcggtcgagggatgcgatagggtcgggtacggtttcgtattttttcgtattcggcgtcgtcgtttcgtcgttttttttcgtttgtagggtcgtttcgggtattttagggttgttgaggggcgggcgggtcgtaaaagttacgagagaggggcggtagggcggcgcggtttgcgagcgtcgcgggatttcgaggagcggcgcggggagtataggggcgcgcggggcgggcgc

SEQ ID NO: 4778 - DNA, 435 bp, synthetic construct
  misc_feature 1..435: note = Description of Artificial Sequence: Synthetic polynucleotide
  source 1..435: mol_type = other DNA
ataattttggttttatatattttatatgtttcgtataaagaaatagaaagcgggcgatacgttttgggagggcgggttggcggtttttttagttcggagcgcgtggaggttgcgcgtaggggttcgggacgcgggatagggatttcgcgtagtttaggcgtcggggaatcggggttggagtcggggatttgagtttagcggacgtttttttcgtttggaggttcggtacggatcgggatattagggcgttcgtggtcgtggttcggtttttggttgttgcgggtcgcggtttttagtgggtttttaggatttttttttacggcgggtatttatcgaggttgagaggttacgtcgtgttgttggggtttttcgtcgattatatttttgggcgttagttcgggtagagatcgcggggattggttaggtcgggttagg

SEQ ID NO: 4779 - DNA, 410 bp, synthetic construct
  misc_feature 1..410: note = Description of Artificial Sequence: Synthetic polynucleotide
  source 1..410: mol_type = other DNA
tggttgtgttagtcgatatgagtttttttttttttaggaaggcgtaggattcggggaagttttcgcggttaggtcgtttgtttattcgtagatttcgggcgtcgttcgcgttttttgttttttattttttaatttttgcgtggttttagggtttatatttttggagtttttttttttagtaaatagtgttgttttttatttaatagtagaggcgtttaggagtttaggcgatgtgtttaaggtcgaatagagggatagtagtgagttgtttaatttttttagttgcgtagttaggatacggttgggggcgggtggagatgtggcgtagggttagggttcgggtttcgggaagtaatgatcgagggcggtgattattgtttttagtttttcggcgggtttttttttaaggg

SEQ ID NO: 4780 - DNA, 392 bp, synthetic construct
  misc_feature 1..392: note = Description of Artificial Sequence: Synthetic polynucleotide
  source 1..392: mol_type = other DNA
tggaagtattcgttttatcgcggggtttggtatttaggttttgggatttttgttattgttaaggattttttcggggattcgagttttcgggttgaggatcgcgggggattttaggtcgggacggagttttttttggttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcgagagtggcgttggtacgtttaaatttcggggtttttggttaggttaggggggcgggcgtgcggcggggtcgggtcgggtcgggtgcgtttagcgggtttc

SEQ ID NO: 4781 - DNA, 203 bp, synthetic construct
  misc_feature 1..203: note = Description of Artificial Sequence: Synthetic polynucleotide
  source 1..203: mol_type = other DNA
ttcgattttagttcgtcgtcgttttttaggcggattttttagaggtaggttttagttttcggcgcggggaggcggcgcgttttagaggggcgtagggtgcgcgggggtcgttggtttttcgggtattttttttttgcggttttttcgttttttttcggagttggtgtttgaggtcgttgggattttagtttggcgtttttttt

SEQ ID NO: 4782 - DNA, 398 bp, synthetic construct
  misc_feature 1..398: note = Description of Artificial Sequence: Synthetic polynucleotide
  source 1..398: mol_type = other DNA
gggttcggggataaagggtgacgtgtggttttggggaaggttcgggatgagggagttgaatttagttgtttcgcgcggtgtttagagtgttttatcgcgcgtaataaattttcgtagatatcgtatttttaatgcggtgtttttttgtgttagtgtttcggcggtttttgtagggtgttaatgttacggttgtatatcgttttttttttttattatttttatttgaatagatttggaggaggcggaaatggaaattagggtatgtttataagttggattcgttagatttttttgttcggcggtatgtttgtgtatgtttgtatgtcggtaaggagttacggatagggaaggtttaagagttggttatttgagcgtagtagatgggttttcgtagtttt

SEQ ID NO: 4783 - DNA, 286 bp, synthetic construct
  misc_feature 1..286: note = Description of Artificial Sequence: Synthetic polynucleotide
  source 1..286: mol_type = other DNA
gtcggtttttttatatttacgtgtttttcgtgtgcgcgttttcggtttgtagatgttataaggttggcgtcgtttggattttcgggcggttttatttttcgcggtcgttacgtttcgttttttgtatttagtttttttggcgttttcgttgtagtatttaagattaggcgtcgtttttgttagtcgtgttgtttagtacgtttgagggtcgttgtcggtaggttttatttttcgttcgggttttttatttatttttttttttggacggtggggtttaagttttgta

SEQ ID NO: 4784 - DNA, 267 bp, synthetic construct
  misc_feature 1..267: note = Description of Artificial Sequence: Synthetic polynucleotide
  source 1..267: mol_type = other DNA
ttttattttttttttttttttttagtttggttgaagaacgtttttaaggaaattcgggttgtttttttttatttggaagtggttttttttatatcggttcgtaaattgattatgaaatatacgatgttaattcggagttgtattttttagttgggtattttcgcgcgttggttttcggggtttcgttttttattttttgtttttttttttcgcgttttgtttttattttttatttttcgcgttggttatttcgtttttttggtagtt

SEQ ID NO: 4785 - DNA, 260 bp, synthetic construct
  misc_feature 1..260: note = Description of Artificial Sequence: Synthetic polynucleotide
  source 1..260: mol_type = other DNA
gaaattacgataggtttgtattatcgtttttttttttacgttttcgtttaggtttgtaaagtcggttgtttttggttaataggcgttttttttgttttacggtgaaaattagtttgtggtgtattgagatttgtaaattattttttgaatgttaggggcgttgtaaaatagtcgtcgggtgtagtgggtcgggcgttcggttattttggttgcgattatcgtagttttttaaaggatgcgggtagatgtagacggttttg

SEQ ID NO: 4786 - DNA, 239 bp, synthetic construct
  misc_feature 1..239: note = Description of Artificial Sequence: Synthetic polynucleotide
  source 1..239: mol_type = other DNA
gtgagcggggtacgagagtgtagggtttcgttggtgtttttttttcggcgttcgtcggatttatcgtttttatcgttgcggtgttcgaattcgcggattcggatcggcggtagtagaagcggtagcggtaaagtattcgtagaatggggtatcgcgaaatagttttttttttttttttttttgttggtggtgtagtcgcgatagttcgttttttaggtaggggtttggagtttgttttt

SEQ ID NO: 4787 - DNA, 846 bp, synthetic construct
  misc_feature 1..846: note = Description of Artificial Sequence: Synthetic polynucleotide
  source 1..846: mol_type = other DNA
ggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagt

SEQ ID NO: 4788 - DNA, 526 bp, synthetic construct
  misc_feature 1..526: note = Description of Artificial Sequence: Synthetic polynucleotide
  source 1..526: mol_type = other DNA
agttgtgaagaggcgtgggggtcgcgggaatttttttttggtcggtgcgatgaaagtcgggcggacgaggtggtttaacggggttgagagtggttcggtcgaggcgcgggttgagtttttagtatttggtttgagcggcgtgggtagtagtttgtatcgcggatatttttaattttgtcgcgtttgcgtcgtattttggtcgtggtagcgatttttcgggtatttttgaggtcgtttttagttttataagtatttagtcgtttattttagagtagcggcgtcgatcgttttaagaggagttagttttcgatatcgttttttatttatttttttatatttttatcgttggagggggtgagtgtcgtggataggcgttttcgttcggggatagtttagcggcggtagttagttcgattttttttcgcgcgggtcgtttaaatttgattagtagagcgagcggtttagcgtagtagtcgttttcgcggtttttagttgtagaaaagtaaagcgtcgggaggaagtagta

SEQ ID NO: 4789 - DNA, 201 bp, synthetic construct
  misc_feature 1..201: note = Description of Artificial Sequence: Synthetic polynucleotide
  source 1..201: mol_type = other DNA
gtttttcgtagataagtaaataatttggacgtgaaatggaaatggtaattaatgtagtaatgttgttatatttcgagtgtgtaaattttattgattcgtcgcgttacggggggtgtcgggcgtacggggatcggtggcgtgcgtttaggttgtttattttttttttttttttttttttttttttaggttttcgggcggggc

SEQ ID NO: 4790 - DNA, 523 bp, synthetic construct
  misc_feature 1..523: note = Description of Artificial Sequence: Synthetic polynucleotide
  source 1..523: mol_type = other DNA
ttttacgagaagaataagaagggttggtaaaatagtattcgttataattttagttttaacgagtgttttattaaggtgtcgcgcgagggcggcggcgagcgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcggttgtagtcgcgggtttcggtagttttggcgcggtcgttgtggttaaggggttggcgggttcggtcgtttcgtacgggtcgtatatacgcgtgtagagta

SEQ ID NO: 4791 - DNA, 276 bp, synthetic construct
  misc_feature 1..276: note = Description of Artificial Sequence: Synthetic polynucleotide
  source 1..276: mol_type = other DNA
tcgtttaggtagtattttcgtagtagtcgttaacgagttgtagtcgtcgtttattgttcgcgtcggttttcgtttttcggtgtttgtcgtatcgtgggtcgtttcgtcgtgttcgatgggtgcgtttttagcgttgtcgtcgcggcgttcggtttcgggttttcgtcgttgcgtcgttagttcgtcggtagtagtcgcgtttattggcgcggattcggagcggtttaggcgtttatttcgggacggttcgtgacgttacggagggagggaggtggt

SEQ ID NO: 4792 - DNA, 357 bp, synthetic construct
  misc_feature 1..357: note = Description of Artificial Sequence: Synthetic polynucleotide
  source 1..357: mol_type = other DNA
attttttttttaggtaggagtagatatttgtttgtttttacggcgcgttagcgttttgttttagtcgtttttgggttagagttcgaaatttatttattgcgtttttatttcggtatagatagtttttaaagttgttcgtattttttagatttcgttttttgtttagttttcggatttcgtttaggggttgagttgacgttcgcgggtggatttttttggttcgttgcgtagggaattgatttcgggaatttagggcgtatagaggttaaagaagttgcggtaagggagggtgggtaaatttagtttgagtttaggtttttgtcgtttttatttttaagtttgttttgtttttttttt

SEQ ID NO: 4793 - DNA, 278 bp, synthetic construct
  misc_feature 1..278: note = Description of Artificial Sequence: Synthetic polynucleotide
  source 1..278: mol_type = other DNA
tgtcgcgttgtcgtcgtagttagtcgcgtcgtcgtcgttgtcgtagcgcgggcggtcgcgcgtcggtagtaggggtttggcgaggaagtcgttgagtttcgcgcgtttcgcgtttttggcggtcgtagcgttgtttattaattgatttttttattgatttatttaatttttaggagcggttgttcggaggtacgggtttttttttaaatttgtagcgacgttttcggcgtgggtataaaggtttcgacggcggtcggcgggggttgtttagcgttcgg

SEQ ID NO: 4794 - DNA, 336 bp, synthetic construct
  misc_feature 1..336: note = Description of Artificial Sequence: Synthetic polynucleotide
  source 1..336: mol_type = other DNA
ggtgatgaagtttgggtagaaattttttgtcggtcgttcgttttacgtttttttcggggtcgatattgttaattttttcgggtattgaggatatttttgcgttttggagcggtgggaggacgcggagcgtcgttttttggttttcgatattttgttcgttttttttagtgggtttgtggttgcgttttttcgaaggaagtaataaatttttttgattttgggggttagaggagacgttttagtttttcggaggggtgtgcgggcgggatcgttttttcgttttattggatttttggtcggggttgtttttgttttattgtgttttatatgcggagt

SEQ ID NO: 4795 - DNA, 311 bp, synthetic construct
  misc_feature 1..311: note = Description of Artificial Sequence: Synthetic polynucleotide
  source 1..311: mol_type = other DNA
gggagggcggtaaggagtgcggaggtttaaacgggtatgagtacggggcggttcggtcggaggcggttttgggcgtttttagttgttttcggttgttttcgttgcggtatttagcggtttatcggggttgtattgttgtagcggttttttgtgttatttgtagtttaggaggttgagtatagtgagtattagtagtagtgtatagttcgcgtataatattagcgtttttttacggaatatttttatttcgagaggggacgcgggttagcggcgttttgggcgtcggggttattgcgggagtagggtacgcg

SEQ ID NO: 4796 - DNA, 201 bp, synthetic construct
  misc_feature 1..201: note = Description of Artificial Sequence: Synthetic polynucleotide
  source 1..201: mol_type = other DNA
aacgtcggtatcggttgggaagtttcggtgtttcgggttttttttggcgagggcggagaagtcggcggtttttgtttagaattttgtgattgtagggatcgagatattaagggcgggggtgtagaggattataagttttttagcgcgttttatttgtatataaatgtgttttgttttttaattttgtttttgttatttgtg

SEQ ID NO: 4797 - DNA, 201 bp, synthetic construct
  misc_feature 1..201: note = Description of Artificial Sequence: Synthetic polynucleotide
  source 1..201: mol_type = other DNA
tttttatttcgcgtttttcggaattttagaattcgggtggtcggtttttggaaagtcgtagtcggcgcgatgtattttgtagattttattttgttgggacggattttttaatttttagaatcgcgggtcgtagggagttaaattgttgtttttttttttttttttcgtgcggttggtggtttgttttttaaaggaacgttt

SEQ ID NO: 4798 - DNA, 481 bp, synthetic construct
  misc_feature 1..481: note = Description of Artificial Sequence: Synthetic polynucleotide
  source 1..481: mol_type = other DNA
tcggggtcgtatcgttatggcgatttgtttatttgattcgtttcgggtggattcgtcgcgatttttgggcgtttaggtttttgagggtttaacgggcgacggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcg

SEQ ID NO: 4799 - DNA, 280 bp, synthetic construct
  misc_feature 1..280: note = Description of Artificial Sequence: Synthetic polynucleotide
  source 1..280: mol_type = other DNA
gagttagtcggaggggcggcggcggtttcgcgcgtttagagttttagtttatgaatgggattttattttgagcgttttttttcgggtttggggaggcggcggcgcggcggcggggggcgtttcgtaagttcgcggttttgagcggttattcgcgtagtaagttgggcgagttggtagtcgtttgtatttgttttttggtttcggtttttgatttcgttttcggttttaagcgttcgggttgcgttttcggttgtttcgcgaggtagttttaggaggttta

SEQ ID NO: 4800 - DNA, 252 bp, synthetic construct
  misc_feature 1..252: note = Description of Artificial Sequence: Synthetic polynucleotide
  source 1..252: mol_type = other DNA
gcgtggggagtttggtattttatttaattagagcgttggattgagaattgtttaattaggcgcgtagtcggagaggagggggcggtattcgggatttggcgcggtttttgttttttgcgttagcgtgagttcggttagggtttttacggtcgtgtttttattttttagggaggcgtcggtgattcggttatagttttagttttcgtcgttttgtgatttgcgggtattggatgattcgtagttgagatttcg

SEQ ID NO: 4801 - DNA, 239 bp, synthetic construct
  misc_feature 1..239: note = Description of Artificial Sequence: Synthetic polynucleotide
  source 1..239: mol_type = other DNA
ataggcgatggatttttcgggttttcgggggcgttttacgtgggtgttggtcgggggttttttggtagtggttttggcgttggggggtcgaggttgtttcggcgttagtttacgttttcgttggcgttttttcggcgcgtagttatttcgggatttttaggtggtttttaggtttgggttcggtttgaggattttttcggggcggagcggggcggggttcgagagtagtacgtaggtaa

SEQ ID NO: 4802 - DNA, 405 bp, synthetic construct
  misc_feature 1..405: note = Description of Artificial Sequence: Synthetic polynucleotide
  source 1..405: mol_type = other DNA
agtttttaattaggtttaaggagtcgtagagtcggggtttcgggttcgtaggatttagaagttacgcgtttcgcgtttttcgtttcgtcgttgtttgttcggtcgatttatttggtgtcgcgtgcgttggcggttcgcgcggtagttaagttaaaggtcgaggtcgaggtcgagcgcggcgtttagtagtacggcgggggttagtagggcgggcgtcggtcgtagcgcgtttcgttttagtagtagtcgcgcgtcgtttttgtaggtcgtttcgtcgcgggttattcggggcgtttaggttgtcgtttcgtcgtatttcgtcgtttgttgtatcgttttcgttagggcggcgacgcgggatttggagttcgggcgggttaggggcgcggttcgtttcgtagattt

SEQ ID NO: 4803 - DNA, 237 bp, synthetic construct
  misc_feature 1..237: note = Description of Artificial Sequence: Synthetic polynucleotide
  source 1..237: mol_type = other DNA
ttaagttgttgtcgtttaaggttattaagtagaatttttttaacgacgagggttgttagagcgatttggaggataacgtttcgtagggtagtagcgacgcgttgttgttgcgcggggcggcggtcgtcgtgttttcgggttcgggagcgtacggtggtggcggcggcggcggcgcgtaggataagcgttcgggtttttttacgttgggttatcggggtttttatattatcgtgcgcg

SEQ ID NO: 4804 - DNA, 204 bp, synthetic construct
  misc_feature 1..204: note = Description of Artificial Sequence: Synthetic polynucleotide
  source 1..204: mol_type = other DNA
agtcgagtagtagttttagagtttttcgtaagttttttttatattttttcgttttcgttttaaaggagtagtagtttttttttgtttttttattgtcgtcgtcgtatcggcggagtttttttttcgcgcgtttttttttcgatggagttcgggcgtcgtcgacgtcgtcgttgtttcgaattttgagcggggtcgtttcggtcg

SEQ ID NO: 4805 - DNA, 224 bp, synthetic construct
  misc_feature 1..224: note = Description of Artificial Sequence: Synthetic polynucleotide
  source 1..224: mol_type = other DNA
ggtcggggtgcgcgcgtgtgtatgttgtgaatgcgttgcgcgatgtgcgtttttattttatatttagtcggttttttgtttgtgttgttcgagtgtggacgtgtgtacgcgttgtattcgttcggtgtggtagcgtttcgtgagtttttggaggtagggaaaggttatttgtgtttagaggttttgttgagggcgggaggggtttagttttagtggggagtttt

SEQ ID NO: 4806 - DNA, 278 bp, synthetic construct
  misc_feature 1..278: note = Description of Artificial Sequence: Synthetic polynucleotide
  source 1..278: mol_type = other DNA
agcgggtttgttttttatttttttagtttcgcgtcgtcggtttatagcggttttttttggggatagtttttttcgggtgtcgttttcgttttttttgtgcgttttttttttttttttttttttattaaatattatttgggaattgtttaaattttttttttaaaaaaagagagaggcggggaggagtcggagttgtggagaagtagagggatttaggtaagtatttgtggatttaaacgggcgtttttggaaattttggagaacgtcggatgggagac

SEQ ID NO: 4807 - DNA, 232 bp, synthetic construct
  misc_feature 1..232: note = Description of Artificial Sequence: Synthetic polynucleotide
  source 1..232: mol_type = other DNA
gggaaataggtcggcgtgtcgaaagatatcgagtaggtagaaataaggtaaatttatagaggcgtaataggttcggtttttcgtggttagggcgagtcgcggtttcgcgtggcgtttcggtcgttgttttcggattttgagcggttattgttggggttttcgaaagaggtgtcggttttttgggagtcggaagagttgtttgggtgggtttcgttttgttttttattttatc

SEQ ID NO: 4808 - DNA, 331 bp, synthetic construct
  misc_feature 1..331: note = Description of Artificial Sequence: Synthetic polynucleotide
  source 1..331: mol_type = other DNA
tgttttgtttggattttatcgtggtcgagaaggaggaatggtatatcgttttcgtgaatattatttacgtcgagttcgcgtcggatttcggggtcggggcggcgggcggcggcggcgcggagttgtatacggagaagacggagtgcgggcgttacggagagtattcgtttaagtaggacgttcgcggggaggtggttatggttagttcggtttacgatcgtttggtttgcgattttaatattaagttcgtcgtttcgattcgcggtaagaattggatagtttttatttttaagggtaattgtacgtatagggataagattcggaacgcgtt

SEQ ID NO: 4809 - DNA, 231 bp, synthetic construct
  misc_feature 1..231: note = Description of Artificial Sequence: Synthetic polynucleotide
  source 1..231: mol_type = other DNA
gttgcgttttgggcgtatttgcgcgtttggtttcgcgtttcgcggagagggcgatgggtttcggttaggattgagtttttttttttttttttttagtttcgtttggtatttttttttttgtttcgagggcgagttacggtttgcgtcgtcgttttttttttcggtgttttcggttcgtcgttttttcgcgtttttttttttcggattcgttttcggggttattatggtcgc

SEQ ID NO: 4810 - DNA, 201 bp, synthetic construct
  misc_feature 1..201: note = Description of Artificial Sequence: Synthetic polynucleotide
  source 1..201: mol_type = other DNA
tgttcggttttgggtttagttcgtcggcgttgttgggggcggtaagtttcgtattagtttttattcgttttatttttttcggttgaatgagtgttagttcgcgtattggggttatttagaggagacgggtaaagtcgcggttttacgggttgtattattggtcgcggagtttaggggagttgtaggagaaattattgcgag

SEQ ID NO: 4811 - DNA, 201 bp, synthetic construct
  misc_feature 1..201: note = Description of Artificial Sequence: Synthetic polynucleotide
  source 1..201: mol_type = other DNA
agttcgatgattaggagttttcggttttcgaagttgcgttttatcgtgtaaattttgttgatggcggtgtattgtagttatacggatacgagcgtttcgcgtagttcggggtagcggtggtattcgaaggagatgtcgtttttttgttgtagtcgtcggcgtcgttttatgttcgtcgcgggcgtttcgggtttttgggtt

SEQ ID NO: 4812 - DNA, 219 bp, synthetic construct
  misc_feature 1..219: note = Description of Artificial Sequence: Synthetic polynucleotide
  source 1..219: mol_type = other DNA
tcgttgtagttatgaggagaatttttatttttatggttggtttatcggttatttcgagatgtcgtttttcgattatagtatggttttgttttatagtttcgagtatgttagcggcgtcgtcggtttggattatttttattacgggggggtgtcgtcgggcgtcgggttttcgggtttgggggggtcgcgttcggtgaagcgtcgaggtatcgttaatcg

SEQ ID NO: 4813 - DNA, 284 bp, synthetic construct
  misc_feature 1..284: note = Description of Artificial Sequence: Synthetic polynucleotide
  source 1..284: mol_type = other DNA
gtcgggggaggtggggtcgtcggggaggaggcgagggaaacggggagttttagggagacggttttcgagggagagtgagaggggagggtagttcgggttcggtacgttttttttttcggtcgtttttttttatataagcgtaggtagagggcgcgttagttatgttttgtttttgcgttcgtcgtcgtcgtcgtcgtcgtttagttcggcgcgttttggaggattttgcgtcgcggcgttttcgggtttcgtcgtcgttagtcgtttcgtcgtttttttttcgt

SEQ ID NO: 4814 - DNA, 429 bp, synthetic construct
  misc_feature 1..429: note = Description of Artificial Sequence: Synthetic polynucleotide
  source 1..429: mol_type = other DNA
aaagtattttttttttaatttatgaacggatttcgatttttgttttgttattatttatgcgtttcgtattcgaggtgtcgtttttatttatacgttttacggtttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcgtggatcggttcgtggcgggggttgttttgcgttttcgttttcgtagtagtcgcggatttttattaacgttgacgagttagtgtcgcgattcggggagaga

SEQ ID NO: 4815 - DNA, 283 bp, synthetic construct
  misc_feature 1..283: note = Description of Artificial Sequence: Synthetic polynucleotide
  source 1..283: mol_type = other DNA
aaaagatcgcggtggagaagatggggcgtttttcgcgatattcggttgtttagaggtgtaaagtcggtgggcgtacgttcggggcggttttatagttttcgggtcgttagttttagggtgtcgggttttaattaaggtttcgaagtttttacgtatttgagggtattttgattagtttttgcgggttgttttgcggtcgtagtgggttttgaaagtttatttcggcgtagggtggaaatcggcgggaggcgttgttgattttcgattaaataatagtgacgag

SEQ ID NO: 4816 - DNA, 241 bp, synthetic construct
  misc_feature 1..241: note = Description of Artificial Sequence: Synthetic polynucleotide
  source 1..241: mol_type = other DNA
cgcgggtggcggcggttgtggggtcgtttgggatttttcgtagtattgattttgtaattttttgtgtttgcgtttcgtggtgaggggcggcgggatgcgcgcgatttttttttgatttagttaaacggaaaagttcgcgcgtttcggttggaaggtggaggttaggtaggattcggtaaaggtatattttaaacgaagtagattttattttttatttgtagagggaaggcggtgtggacgg

SEQ ID NO: 4817 - DNA, 244 bp, synthetic construct
  misc_feature 1..244: note = Description of Artificial Sequence: Synthetic polynucleotide
  source 1..244: mol_type = other DNA
gtagtagttttacgttgttggcgtaggcggcgcgtaggagggtcgtcgttttcgggacgtttttcgggacgtttttcgggacgtttttcgcgttttcgacgtcgtgttttttttcgttttcgaaagggtagaaagagtcgttcgaggcgatgttgcgggtgtttggtagattcgagaagtttttaaatttttcgtagttagcggggtttttttcgatttgcgcgtttcggggtggggacggcgg

SEQ ID NO: 4818 - DNA, 225 bp, synthetic construct
  misc_feature 1..225: note = Description of Artificial Sequence: Synthetic polynucleotide
  source 1..225: mol_type = other DNA
gtagggggcgttgcgttcgtcgagttcggaggggtcgtcgggtcgggcgttgcgtattcgcgtcgggagtcgtttttcgttcgcggcgttcgtttttgtcgttcgttagtattttttgtttcgcggtcgcgtttagataataaaagcggaagatgttgtagttgggtaaggttaggattttgttttgaagtcgggcggcgtcgcgtacgttttttttcggattga

SEQ ID NO: 4819 - DNA, 249 bp, synthetic construct
  misc_feature 1..249: note = Description of Artificial Sequence: Synthetic polynucleotide
  source 1..249: mol_type = other DNA
cgtcgttttcgcggcggtattgggtatgtttcgtattcggggtcggtttcggcggcggggcggacgtttttttattagtcgggcgttcgggtcggtcgtcgaggtttaggtggaggttgaggttgtcgcgcgtcgcgggaggagtttcgttttcggcggttgaggcggcggcggtataggtggcgcgggtcgcgcgcggggcgtagttcgggagcgttcggcgtcgggcgtcgcggcggttttaggttc

SEQ ID NO: 4820 - DNA, 255 bp, synthetic construct
  misc_feature 1..255: note = Description of Artificial Sequence: Synthetic polynucleotide
  source 1..255: mol_type = other DNA
ttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtat

SEQ ID NO: 4821 - DNA, 243 bp, synthetic construct
  misc_feature 1..243: note = Description of Artificial Sequence: Synthetic polynucleotide
  source 1..243: mol_type = other DNA
acgtttgtttgagtcgtgttgtcggggattagcgattttttatttttttttttttataggagcgtttcggttttcgttttcgttttaatcgtcggcgcgcgtttttatcgcgtacgcgtttttttcgcgcgcgtatacgttcgcgtatatacgttttttcgttttcgttcgcggagtttttttttattttttagtcgtttcgtcggttgaagtatcggcgttgggaggcggcggcgttgttga

SEQ ID NO: 4822 - DNA, 201 bp, synthetic construct
  misc_feature 1..201: note = Description of Artificial Sequence: Synthetic polynucleotide
  source 1..201: mol_type = other DNA
cggtttgttttgggttcgtgaggcgaggtcgtagcgtttcgacgtcgggtgggcgtgtgggtggagtggagatttgggtttttcggcgtatgggagtttcgtcgtttgcggtagggaatcgttttttatttttggttcggttcgggtcgggagtcgtgtttcgcgttgattcggtgtaattttttagtttattttttttta

SEQ ID NO: 4823 - DNA, 208 bp, synthetic construct
  misc_feature 1..208: note = Description of Artificial Sequence: Synthetic polynucleotide
  source 1..208: mol_type = other DNA
gagaattgaaaaggaaggcgaggagtaggggttgcgggtcgggtttttgttgttcgcggttttcgggggtcgcgtcgcgtcgggttacgtgggggttttcgtttttcgagcgggcgtcggtgggaaatttgcgcggcgagagatagggggatggggcgtttttgacgcgattgtggggtgcgggtagttttggaggaggatgttcggt

SEQ ID NO: 4824 - DNA, 257 bp, synthetic construct
  misc_feature 1..257: note = Description of Artificial Sequence: Synthetic polynucleotide
  source 1..257: mol_type = other DNA
tagcgttttcgttttggttatggagcggtcggcgttcggcgaggtggttatgagttaagttatttagtcggcgtacgttattgcgcgcggcgagttgagcgcggggtagttgtttaagtggatcgatattatcgtttgtttggcgggtaggcgggcgtcggggttgcggggaggcgcgggatcggggttgcgggagcggcggcggttgggggttggggggggtaggaaggcgaggaaggtatttgcggagagttgaa

SEQ ID NO: 4825 - DNA, 350 bp, synthetic construct
  misc_feature 1..350: note = Description of Artificial Sequence: Synthetic polynucleotide
  source 1..350: mol_type = other DNA
aaagtgtttgtaaagtttgagtagagtgcgcggggtcgagcggggagaagggtgcggggtatcggggtgagatataggaaagaggaggacggtggggagcggtagaagatagcgtttttaggattagcgattttgtggtttattcggttattgggtttcggcgtaaattttttttaggtagtgcgggcgatgttgattgtagacgtcgggtagggttttcgtgcgggcgggagcgggggaagttagtgcgttcgggcgttagttagttgatgcgggaagaggttggggagttgtagggtcgttcgttttcgggtgcggtgttttggcgtagggtttgggttgagtcgttc

SEQ ID NO: 4826 - DNA, 216 bp, synthetic construct
  misc_feature 1..216: note = Description of Artificial Sequence: Synthetic polynucleotide
  source 1..216: mol_type = other DNA
ttattttgttcgttagtatattttagagtttttaatttttttttgtatgtaagtttaggtagagttttgttaggttttatattagagtatatttttgtacggattttttaggatcgcggcgtcggttggttgtttcggtttttcgcggtcgcgtgagtttttttttggtggtggagggcgtattttaatttggaaatttttagtttttaatttggt

SEQ ID NO: 4827 - DNA, 269 bp, synthetic construct
  misc_feature 1..269: note = Description of Artificial Sequence: Synthetic polynucleotide
  source 1..269: mol_type = other DNA
tcgcgaagggtataatttgagaagttcgtggtagtttttcgtagcgtcgggtgatatagggtttttttatttttaggagaagtgggtaggagagagggtcgttcgttgtttttcgttgcgtttagggatggagggttttattatttatggaattgttggtttttttgcgtggttcgggattttagtcgtggtttcgcgttaagagggtattttttttaaacgaaatcgtttcgttcgttcgttcgttcgttcgttcgggtagtaatgtc

SEQ ID NO: 4828 - DNA, 258 bp, synthetic construct
  misc_feature 1..258: note = Description of Artificial Sequence: Synthetic polynucleotide
  source 1..258: mol_type = other DNA
agtaaaatttttattattttttcggtgtttattagttcgtttttttaggtttttgggattattttatttaaaagtagttttttttagcggggtttagatcgtttttgagatttcgttgagaaatttttagcgggttagcgtttgggcgttgggcgtcgagttcgatatggttttttggatgtcgttgatttgttcgtcggttgtttagtttttgttttatttcggggcgtagaaaggggacgggtaggggttcgattt

SEQ ID NO: 4829 - DNA, 224 bp, synthetic construct
  misc_feature 1..224: note = Description of Artificial Sequence: Synthetic polynucleotide
  source 1..224: mol_type = other DNA
agtttttagggatatttgaggtattatttttgttattgtcgggtattcgcggcgttgttaacggtttggttatatgtttttcggagagttacgggagggcgttgggtaatttttattcgagtcgcggtcgcgaggaggagggaaaaggcgagtaaaaaggaagagtgggaggaggaggggaagcggcgaaggaggaagaggaggaggaggaagaggggagtata

SEQ ID NO: 4830 - DNA, 256 bp, synthetic construct
  misc_feature 1..256: note = Description of Artificial Sequence: Synthetic polynucleotide
  source 1..256: mol_type = other DNA
ggtcgtgtagttcgtttcgttttttttttcgaagagagatttggtgttggtatgggtatttcgcggttatcggagtggtttttcggatgagtttggtttcggcgttgacgttttggttttgggggttgtttggttggtgttaggtagcggaagacgtttggagagttattcgtttttttttttattcgtttttatcgttgttcgtgttaggacgcgtagtttgtagttgtagtttaggtattggcgcgggatggcg

SEQ ID NO: 4831 - DNA, 310 bp, synthetic construct
  misc_feature 1..310: note = Description of Artificial Sequence: Synthetic polynucleotide
  source 1..310: mol_type = other DNA
tttcgtcgtttcggaggttggcggtgagggtattcgggcggtaggggttcgtcgaggggtcgtggtatacgggtaagggggttaattcggaatggttttcgagtagttttacgttttgttaaggacggtaggtgtaagggtcgggggattttttgacggggtcgttttttcgggtacggggaggtttttatcgagttttaattttgaacggggtagggggtagagtttttggtaggtaaggttttcggaggagggaacggttggggagtggcggagtttcggagtggtggttttgttaacgttttttttc

SEQ ID NO: 4832 - DNA, 410 bp, synthetic construct
  misc_feature 1..410: note = Description of Artificial Sequence: Synthetic polynucleotide
  source 1..410: mol_type = other DNA
aaggatttatttagacgtacgttcgcgcggagacgtacgttggtatacgcgtttatatacgcgagtatatatacgcgtatattattcggttcgtgcgcgcgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcggtggttttagttttattagtaattgtcgttggtaggagtattatacgttttaggagtttttcgggtattaagtatgggtttagttcgttttagttatttt

SEQ ID NO: 4833 - DNA, 274 bp, synthetic construct
  misc_feature 1..274: note = Description of Artificial Sequence: Synthetic polynucleotide
  source 1..274: mol_type = other DNA
agatcgagggaacgttgtttatgcggtgagagttagcgcgggaggcggcgagggcgcggggagatcggggagggggtgggtttcgcggcgttcgtcgttcgtttttacgcgcgttgtcggtatttgttcgttttgttgtaatttgttgtagtgtttgaaagagtagtaggagcgtatggaggtggggtcggggaaagattaggcggagtggttgtggggtgagcgcggagtgggtggggaggcggcggcggtggggaggggggattggttttag

SEQ ID NO: 4834 - DNA, 201 bp, synthetic construct
  misc_feature 1..201: note = Description of Artificial Sequence: Synthetic polynucleotide
  source 1..201: mol_type = other DNA
gtcgtcgtcgtcgttgcgtcgttttttatttagagttcggcggcgtcgttttttttttttttcgcgtggtggcggggtatggtattattacgggtatcgcgagggggtcgttagcgtttgcggcgggggtagcggttttatgtgcgtcggcgggttttaaggaggaagtcggcggtcgacggggcgttcgttagttagaga

SEQ ID NO: 4835 - DNA, 265 bp, synthetic construct
  misc_feature 1..265: note = Description of Artificial Sequence: Synthetic polynucleotide
  source 1..265: mol_type = other DNA
ggtcgggaggcgcggagttagtcgtttacggagtttaattgtttgtatcggggatcggcgggcggggcgcgttcgagtggtttcgtcgggaaagggcggcgggcgttggagaaggcgtttggcgcgaagttgggcggcgtttcgagggcggaggataggtggtcgcgcgatcgtagttaggtagcgaacggttcgggggttgcgtagcgcggttttaaagtttagttcggtttcgggtttagttcgttgtcgtttgttacgggag

SEQ ID NO: 4836 - DNA, 201 bp, synthetic construct
  misc_feature 1..201: note = Description of Artificial Sequence: Synthetic polynucleotide
  source 1..201: mol_type = other DNA
gcgtagggggtagttgcgtataacgcgtttttggtagcgcggcggttgcgggcggggcgcgttttacgtgtttgaaggcggacgtttttttcggggggacggagagtagagggaagtcgcgtagggttttagagtagggtaggttaggcggcggcggcggcggcgggtttttagcgagtaggtatttgggatggtggtggt

SEQ ID NO: 4837 - DNA, 362 bp, synthetic construct
  misc_feature 1..362: note = Description of Artificial Sequence: Synthetic polynucleotide
  source 1..362: mol_type = other DNA
ttttaaatcgagttttcgggtgtgtagattcgtagcggagtcgcgggagcgaggtgggaaattttggtcgcggcgtcgggtttcgttcgtcggggggcgcggggcggcgggcgtatgcgcgtgcgcggtgcggttttagttttggttgtcgtcgtttgtcgtcgtcgtcgcgatgtttattttagttaaagcggttgcgggtttggggattcggttcgggtagcggagttttcggattcgtcgattcgtcgaggagcgcgcgtcgggttttcgtcgagtagttgagttcgtgtgtttcgcgtttcgcgtttcgaagttgtcgtttcgaattttggtcggcgttgtttaggtttttcgttagg

SEQ ID NO: 4838 - DNA, 298 bp, synthetic construct
  misc_feature 1..298: note = Description of Artificial Sequence: Synthetic polynucleotide
  source 1..298: mol_type = other DNA
tagcggagacggttaagtgtttttttattaatttttttttttcggagtttaggggtgttgtatgggcggcgtttggattcgcgttttggagttattaggcggagtaaagttagcgcgtttcgcggttcggaatttagttggttcgttatttttttatttttgcgattttattttcgatcgcgttttagggtagaagcgtttgagttttcgttagtgggtatttaaagtttatgttcggcgggcgtgttgacgttattcgggggttgcggagcgggagggggcggtggggggcggggat

SEQ ID NO: 4839 - DNA, 295 bp, synthetic construct
  misc_feature 1..295: note = Description of Artificial Sequence: Synthetic polynucleotide
  source 1..295: mol_type = other DNA
gaaggatacgtaaatttgtcgagggttcgggggtttcgggttgttgttgttgttagcgttttgggaagtgataggtattaggatttgttggtgcggcggcggcggcggcggtagttttagtcgcgttcgttatatatatttttattcgttcggtgtatacgtcgcgtcgcgggtagtgtcgtttgcggaggcgcgttcggggttcgtaggggtagtagcggtagtttggtagcgtcgtcgcgttttcgggtatttggttcgcgaagtttcgtttttgtcgtttttcgcgtcgttc

SEQ ID NO: 4840 - DNA, 203 bp, synthetic construct
  misc_feature 1..203: note = Description of Artificial Sequence: Synthetic polynucleotide
  source 1..203: mol_type = other DNA
ggatgcggtcgcgtaggcgttcgttttttggttttttggtcgggtagcgggcgttcggttatcggagtttagtttaagggtttagtcgaggttttttcgcgcgaggcggttgcgttaggtgagcgggtatcgcggtcgcgttttttttgttatttatttagcggttagaggtattttgcgtttgggagttttaagtgttttcg

SEQ ID NO: 4841 - DNA, 215 bp, synthetic construct
  misc_feature 1..215: note = Description of Artificial Sequence: Synthetic polynucleotide
  source 1..215: mol_type = other DNA
agttttaaattttacgttataaagtttcgaagaggcgggttgggggcgggggtcggggcggatttttaggggcgtggttgcgcgtttgcgatttcggatcgtgttaatttcgtcgtcgttttaaaatttgtgggaaattttagttttgttatttattttttttggaggacgtagataggatttgttttgtaggagtttaggtcggtcgattcgcg

SEQ ID NO: 4842 - DNA, 201 bp, synthetic construct
  misc_feature 1..201: note = Description of Artificial Sequence: Synthetic polynucleotide
  source 1..201: mol_type = other DNA
gggcggcggcgcgcgggggatttatttcgtttttatttgatttcgggtgattgtttattgttatggtttgcgatttcgcgtggggatcgtttagggtttcggggttttggatgtttcgggtggcgtcgtcgtaattttcgtgtttttcgcgtcgtttttatttcgtttttattcgggtcgattcgagcggttgtagttttt

SEQ ID NO: 4843 - DNA, 340 bp, synthetic construct
  misc_feature 1..340: note = Description of Artificial Sequence: Synthetic polynucleotide
  source 1..340: mol_type = other DNA
tttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtt

SEQ ID NO: 4844 - DNA, 201 bp, synthetic construct
  misc_feature 1..201: note = Description of Artificial Sequence: Synthetic polynucleotide
  source 1..201: mol_type = other DNA
ggcggagggatagagttggattcggaagtcgcgggtgggagttgtttttcgcgagttcgaggttgttggtattttgtcgcgggtagttcgcgttagtttcgggagtttttgggtttcgggagagcgagtcggggtcgtttggttataaagatgttcgcgcgttcgttttgcgtacgggattcgttttgcgttttgagtttt

SEQ ID NO: 4845 - DNA, 236 bp, synthetic construct
  misc_feature 1..236: note = Description of Artificial Sequence: Synthetic polynucleotide
  source 1..236: mol_type = other DNA
aacgttcggttaggttttagagttttcgcggagagcggggcgtttgttgggggcggtcgggagggtcgggttaggggcgcgggagatttcgcggggacgcgaggtgttgcgggttttgtgcggttggttgggaacgaggagaatgtgttattaatagtgtttaatcgattgattattttgggtgttgtgtttttttttttatttttttttatttttgggaaaatgtattgtttagg

SEQ ID NO: 4846 - DNA, 251 bp, synthetic construct
  misc_feature 1..251: note = Description of Artificial Sequence: Synthetic polynucleotide
  source 1..251: mol_type = other DNA
gtgtttgaatttttcgggatatttagacggttggagtttttcgattttaaggcgggcgacggtaaagttaaacgttagcgcgttgcggttttcgggtatcgaggcgttttcgttttcgttatttatatagggcgttaagtgtttcgattcgcgagtgacgaggacgtataggttagtgatacgattcgtagttagtattgagcgggacgacggggttcgagcgtaggagggtgcgcggggagttgaggagc

SEQ ID NO: 4847 - DNA, 201 bp, synthetic construct
  misc_feature 1..201: note = Description of Artificial Sequence: Synthetic polynucleotide
  source 1..201: mol_type = other DNA
tgagtagtttaggtagtcgcggtggtcgtgaacggggcgggagtggggggtgtttaggttattagaggcggtttcgcggtttgtatcggttggagtgggcgatttagagtttgagtggagggggcggggggcggcgatagcggggggttttggtagcgatggtttgaatttgcgttggtgggggatggggcgggggcgggg

SEQ ID NO: 4848 - DNA, 206 bp, synthetic construct
  misc_feature 1..206: note = Description of Artificial Sequence: Synthetic polynucleotide
  source 1..206: mol_type = other DNA
gcgttggggaagggatttttcggaggtacggggtagcgtgcgggttgcggtagcgatttcgattcgggttttcgggttttgtcgggttgagtttgcgttcgtttcgtcgtcgttaagtttttttaattttgttcgttgcgttcggatcgcgcgttaggtttgggggcgtagtaggggttgggggcgtacgttgcgtattcggggac

SEQ ID NO: 4849 - DNA, 201 bp, synthetic construct
  misc_feature 1..201: note = Description of Artificial Sequence: Synthetic polynucleotide
  source 1..201: mol_type = other DNA
gtttcggtttcgggcgtcgattaggtttttttggttttcgtcgcgcgttttttaatttgttgttgtcgtcgtcgcgttttttaggttttgttagttattcgcgttttgagttcggggttagatttttatggaagcgtcgcgatgttcgtttttcggttgttggatttttagaagacgaaatacgcgaggtgagcggcggtc

SEQ ID NO: 4850 - DNA, 203 bp, synthetic construct
  misc_feature 1..203: note = Description of Artificial Sequence: Synthetic polynucleotide
  source 1..203: mol_type = other DNA
tgggattttttttttaaaaacgtaggcgttttttcgggtcgtagtcgtagtcgggagattgagggttagggcgcggtcgcggggttttttgggtcggggcgcggtttacgttttaggtttttgcggttttgattagaagtcgttgcgtttttggtcgttttttattcgtttcgttttcgtaattttaggtttagggttatagc

SEQ ID NO: 4851 - DNA, 216 bp, synthetic construct
  misc_feature 1..216: note = Description of Artificial Sequence: Synthetic polynucleotide
  source 1..216: mol_type = other DNA
taggggagacgaatcgattggttgttcggtcgtcggaacggtaggtttcgtcgtttttttcgtttttcgtattttcggttcggtttttttttattatcgcgtttcgttttaattcgtagttagtattttttttttatttttttttcgttttcgttgttatttttttttttggatgttggaagcgtagttggtattttcgtttttttaattttttaa

SEQ ID NO: 4852 - DNA, 335 bp, synthetic construct
  misc_feature 1..335: note = Description of Artificial Sequence: Synthetic polynucleotide
  source 1..335: mol_type = other DNA
gtttattcgttttttaggtgattcggcgttttcgtcgcgttcgttggaagtttgtaaatttttttcgggggtttcgtcgttacgttgggaagttggggacgcggggggaggtttttggttcgtcgttttcgttgtcgtttgatcgtatttttggagggtttcgtattttgttaggtttttggaggtaaatatatattttcgatttataattggttttcgcgttaggggattcgcgcgtttttatatacgtacgtacgtcgggcggattcggcgtcggttttacgttagtatttttttaggcgcgcggcgcggcggttatcgagcgtttcggtatt

SEQ ID NO: 4853 - DNA, 230 bp, synthetic construct
  misc_feature 1..230: note = Description of Artificial Sequence: Synthetic polynucleotide
  source 1..230: mol_type = other DNA
tcgggcgttgatagacgattttttttatttgttagttttttcgtttgttagtagagttgttggtaagtgagagaaaatagaggggcgcgaaggtaggcgcggttagggagtgagcggggcgttgggcgcggggcggagtcgggtgcgcggcgttcgggttaggttttatcgttcgcgtcggttttcgttttgtttagtcgtcgtttttttttttttttttattttttttt

SEQ ID NO: 4854 - DNA, 224 bp, synthetic construct
  misc_feature 1..224: note = Description of Artificial Sequence: Synthetic polynucleotide
  source 1..224: mol_type = other DNA
agcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattg

SEQ ID NO: 4855 - DNA, 211 bp, synthetic construct
  misc_feature 1..211: note = Description of Artificial Sequence: Synthetic polynucleotide
  source 1..211: mol_type = other DNA
gggatacgtagggggatacgtagggattgttcgcgcgaatggtttcgaacgtatgcgttttattttatattttatagtcgttatgacgatcgggaggttcgttcgttaacggttagttaacggttgcggggataagttcgttgaggttgttaggcgagttaggtttttttggatttcgtttgattcggatgggttgtgtttgaaattgatt

SEQ ID NO: 4856 - DNA, 205 bp, synthetic construct
  misc_feature 1..205: note = Description of Artificial Sequence: Synthetic polynucleotide
  source 1..205: mol_type = other DNA
ggcggtgttaggtcggggcggggggtttttttatttagtacggggtattaggtcgggatgggatttttttttagaaagtcgattggatgttaggagaggcgtacggttgggggttttttttttttttttttttttttttttcgcggttgaattaaattagaattgttatttagggtttgtgagttagaagggatcggattatacg

SEQ ID NO: 4857 - DNA, 398 bp, synthetic construct
  misc_feature 1..398: note = Description of Artificial Sequence: Synthetic polynucleotide
  source 1..398: mol_type = other DNA
ggcgcgggtttcggcgcgtttagtagttcggttagcgttagcgcgttcgttagtaggttgagaacggttagcgtttttagcgtggtcgtttgttttagtcgtagcgtgtagtcgcggaatagcgtttttagttttgggtaagcgaatttttcgtcgtacgttcggagttcgcgtcggcggtttgtttcggtcgttcgttcggcgttttcgggttcgttcgcgtcgttttcgtcgtcgttttcgtcgcgcggcgttttcgttattttagcgttatgtagcggtcgcggtcgcgggcgcgtttttcgtcggttcggggcgtcggggcgcgggcggcggcgtcggggcgggcgggcggcgggcggcgaggcgtcggggcgcggggcgcggggcgggcggag

SEQ ID NO: 4858 - DNA, 290 bp, synthetic construct
  misc_feature 1..290: note = Description of Artificial Sequence: Synthetic polynucleotide
  source 1..290: mol_type = other DNA
tatcgcgtcgcggtttcgtacgggatgcggcggtcggcgttgtgttcgcgggtcgggtagttcggttcggtcgcggcgttgcgggattcgcgcgtaattcgtgggggcgcggcgcgggcgatacgtgcgggtcgttaggagggggagggggacgcgcgtcgtcgggttcgttattttgtattcggggtcgttggtcggtcggggtatttttacgttcgtttcgttggcgagattggagggattcgggatatcgtaaagtattttttttagtgtttgggagcgttcgttgt

SEQ ID NO: 4859 - DNA, 307 bp, synthetic construct
  misc_feature 1..307: note = Description of Artificial Sequence: Synthetic polynucleotide
  source 1..307: mol_type = other DNA
ttatcgtagtcggtttcggtcggatttaaatagttttttttttattttcgggatatttattttacgtatttattattttttagtttttagatgtttcgtcgttttttttatggattttttagtatttgtaggttataggataatagaagttatagtagagttatcgaggaattttaggaacggaggagatggaatagtggagacgcgaattaggattagagttcggaagttaggagataaaggtttcgttatattgaagaggtcgtttttttttttgtagttgcgtatttgattggatagttttacg

SEQ ID NO: 4860 - DNA, 212 bp, synthetic construct
  misc_feature 1..212: note = Description of Artificial Sequence: Synthetic polynucleotide
  source 1..212: mol_type = other DNA
gggggtggttgtgggttcgaagtggaggacgagtatggtttgggagataaggaatcgttttgagatagagaaggttttcgggagcggatagagagtgggcgaaatcggtgcgtagtaatcgcggcgttagttttagcgcggtttttggggcgtagttttatttcgttttagtagttgcggagttttttgacgagttttcgtttggtagtatt

SEQ ID NO: 4861 - DNA, 375 bp, synthetic construct
  misc_feature 1..375: note = Description of Artificial Sequence: Synthetic polynucleotide
  source 1..375: mol_type = other DNA
tagggcgttttcgtttggattataggagaaagtttgggaggtaggtttaattttttaatttggcggggaattttttttttttttatatagtttgtagcgcgggggcggcggggtgatagttttcgtgtatgaattagttattttttaggtttcgtttcggcgggggtcggtcggacgttcgtttcgtataaagcgggtattcgggtcgtttggagtagaaagtcgcgtattttttttcgttaggcgttttttcggacgttttgtttagcgggtcgttcgattttttgtattatggatttcgttcgttttttggggttgtcgattttgttgttttttttgacggaggttgtattgggcgatgttgtttaggagtta

SEQ ID NO: 4862 - DNA, 201 bp, synthetic construct
  misc_feature 1..201: note = Description of Artificial Sequence: Synthetic polynucleotide
  source 1..201: mol_type = other DNA
ggcggtatggagcgtagtggttgggttcggtagattttttttttagcgttgttgttgggggcgacgttgagggcgcgcgcggcggttggttattattttcgtttttcgttttttttttttttgtgtatttattacggggagttggaaggggatggggagtagggcgaggtgtttatttttttgtatattgcgggtaatttt

SEQ ID NO: 4863 - DNA, 356 bp, synthetic construct
  misc_feature 1..356: note = Description of Artificial Sequence: Synthetic polynucleotide
  source 1..356: mol_type = other DNA
gggcggggcggcgcgcgggggcgggggagcggtcgggatacgtgtggcggcggcgggggggacgcggcgttcggggttttaagaaggtgtggagcggggcgggcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcggcgggggttcgtttttaggttcgttttcgagttcgtttcgttttcgttcgtttttttttcgtttttttttcgcgtggttttttcgtttcggcgtttttaa

SEQ ID NO: 4864 - DNA, 265 bp, synthetic construct
  misc_feature 1..265: note = Description of Artificial Sequence: Synthetic polynucleotide
  source 1..265: mol_type = other DNA
atttttaggtattattcgagtttgttaattttattttcgtttaattttattttaaaattttttatagatgaggttttgtcgttgtcgcgaggggtcgggcggtcgcggcgggagggatagggggtttgggtgggaagggagcgcgagggtttttagcggttcgcggtttcgggcggatttttagaacgagtgcgggtcgttcggattggtagattgcgagtttcgaggggcgcgggacgtagtcggtttagataaagaaatcggc

SEQ ID NO: 4865 - DNA, 697 bp, synthetic construct
  misc_feature 1..697: note = Description of Artificial Sequence: Synthetic polynucleotide
  source 1..697: mol_type = other DNA
gcggggaggcggcgggggcgggagcgggcgaggggtcgcggtcggtcggcgttcgggtttcgattttcgggtcggttaggggcgcgtcgagtagtaggtcgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcgggtcgtggcgcgaggcgtagtagtatcgtttgtgtacggtgtaggtttcgtggcggttgaagcggatgttgtaggtttcgtatagcgtgcggttggggtc

SEQ ID NO: 4866 - DNA, 226 bp, synthetic construct
  misc_feature 1..226: note = Description of Artificial Sequence: Synthetic polynucleotide
  source 1..226: mol_type = other DNA
gtagaggcgcgtagaaaacgcgcgggtggcgcgcgcggttatttagtgggtttcgttcgcgtcgtcggcgtcgtcgtcgtcgtcgtacgtgcgtcgtcgtgagcgcgaagggcgttcggattcgcgttttgttcgttcgtttgttcgtcggggttattgtggatttttaggtaatagttaagtgagaagttttttttattatcgaaaggtgtttgcgtttttttta

SEQ ID NO: 4867 - DNA, 201 bp, synthetic construct
  misc_feature 1..201: note = Description of Artificial Sequence: Synthetic polynucleotide
  source 1..201: mol_type = other DNA
tttagggaggatgggggtcgcgggggaagtcgggcgtttcggggttttcgatatttatattttcgtacggcgtacgttttgtttcgagtttgcgtttttcgagttagtacggcgagtttgggattttcgtgttttttttttgtggttttcgagaaacgtcggagtttcgtgttttgttgggggttggggggatggagaaaa

SEQ ID NO: 4868 - DNA, 201 bp, synthetic construct
  misc_feature 1..201: note = Description of Artificial Sequence: Synthetic polynucleotide
  source 1..201: mol_type = other DNA
tttggagatgtgattttttaaaagtttagtcggcgaatgggagattgaagggtgacgggaagggggtaggcgcgttcggcgttttgattgggcgtgcggcggtaggattttaaagcgttttgtttcggatcgtttgttttgggtgatttttcggatttgttttggtggaattcggatttgtttcgtcgagatgacgaggta

SEQ ID NO: 4869 - DNA, 215 bp, synthetic construct
  misc_feature 1..215: note = Description of Artificial Sequence: Synthetic polynucleotide
  source 1..215: mol_type = other DNA
agaggaggaaggaaggaggaaagaggaagacgggcggtcggaggcgcggggttgcgcggcgtcggtcggcgcggcgttggaaggcgtcggcgttaatttcgcgaggtaggcgacggagggggagcggcgttaatatataagagtattgtattacgttaatttttttttagaatagtatgcgttagtagtatatttacgttttgattgaaggataa

SEQ ID NO: 4870 - DNA, 252 bp, synthetic construct
  misc_feature 1..252: note = Description of Artificial Sequence: Synthetic polynucleotide
  source 1..252: mol_type = other DNA
tcgtcgttgttcgggtttcggggttgggtggaggaaaggggtgttcggaatcgatttttatttttcgatttttttgttggatattacgtttattttggacgtcgtaagagaagttgttaagtttcgtaggttttgattcggcgtttttcgcgtttttcggttgttttcggtttttttgtgtttcggtggagtatttgcgttcggggttggggttggaggaggtagttatacgcgcgtatacgtatacgttta

SEQ ID NO: 4871 - DNA, 203 bp, synthetic construct
  misc_feature 1..203: note = Description of Artificial Sequence: Synthetic polynucleotide
  source 1..203: mol_type = other DNA
ggcgggggagtgagcggagttttttataatgtttcggtgcggtgtagtcgcggatggatgttgcgggaaggggttgttatttgttgtttttgttagcggcgcgcggatttgttcgcgtttttgtagtcgtcgtcgtcgtcgtcgttagttcgttcggtttttgtagcggcgtcgtttgcgtttttttcgcggtcgtcggagcg

SEQ ID NO: 4872 - DNA, 201 bp, synthetic construct
  misc_feature 1..201: note = Description of Artificial Sequence: Synthetic polynucleotide
  source 1..201: mol_type = other DNA
ggtcggttttatgcggggcgtttcgtcgcgtcgcgttcgcgtttttgtatcggggtgcggggtttagttcgacgcgtattcggcgtttcgcgcgttttgcgggttttttaggtcggtttcgggtgggttaggatcgcggcgttggtaggtcggggttgagttcggtttttcgcgttggagtttttgcgtcgggtgtcgtcg

SEQ ID NO: 4873 - DNA, 201 bp, synthetic construct
  misc_feature 1..201: note = Description of Artificial Sequence: Synthetic polynucleotide
  source 1..201: mol_type = other DNA
tgaattttagagggttgggttttgatttgagtgtcgattcgttaatgaggacgggaggataaggttgtcgacgtagcggaaggtaggggggaagcgattcgaggatttgacgattatttttaggtaggggttttttaagtaggtacggaaattaattttattaaatcgcggagtggggattgggttcgggcggtgtttagt

SEQ ID NO: 4874 - DNA, 201 bp, synthetic construct
  misc_feature 1..201: note = Description of Artificial Sequence: Synthetic polynucleotide
  source 1..201: mol_type = other DNA
ataattttcggaaggagggggttaaatgcggtagcggcgggtttgaaaagggttaggagcgtcgtaggaattggggtgtataggttttcgcgtgtttagcgtttcgttttttttcgttttaggtttgttaggggcgcgcgtggcgcgggtagagtttggtgggtgggttggcgcggatagaagttttgtcggggagcgggg

SEQ ID NO: 4875 - DNA, 213 bp, synthetic construct
  misc_feature 1..213: note = Description of Artificial Sequence: Synthetic polynucleotide
  source 1..213: mol_type = other DNA
tcgatcgcgttttttgcgttcgttcgcgttttttttgtcgtttcgcggtttaggggtgtgagttattcggcgatagtttcgttaggttatttcggggcgcgtaggtggatacgtataggaagatcgttatttttaagatttttatattgtttatcgtggggcgaaattttataattttttgtataaaatgtataaataatattaaatgagttg

SEQ ID NO: 4876 - DNA, 385 bp, synthetic construct
  misc_feature 1..385: note = Description of Artificial Sequence: Synthetic polynucleotide
  source 1..385: mol_type = other DNA
tttgtacgtatgagtaggtatttaatattttttggtttagttatatgtgatatgaggttatttacgttttttttaattaatttttatgataattatgtgcgttatggagaaaattaatggaggaaaaattatagagttattcgaaatagttgcgttgtttattattcggtgtttgagtttgttttttttgtaattagattatatgtgaggtagttttagttaattgtttgtgttatttatcggggaattttagttttatttgtgaatatttaggttttttcgtcgtaggatagatgttgggtgaggtttgttttttacgtaaatatttgttttgttgtttcgagttagttacgagagttagtcggtttagataagtaggggatga

SEQ ID NO: 4877 - DNA, 278 bp, synthetic construct
  misc_feature 1..278: note = Description of Artificial Sequence: Synthetic polynucleotide
  source 1..278: mol_type = other DNA
agggtattaagaaaagaggggtatgcgagtttggaagttggagagagttcggggttttttagagcgggtgggacgtcgcgtttttaggatttcgcgttacgcgtattttttttatttcgatatttattgttatttttatagcggagcgaggggtttcgtcgagggcgagcgtatttcgtgcggttgagatgttcggaacgttttttcgcgtttcggtttttttagaaggggttatagtcggttcgcgagttttcgggcgggggttgagtcgtagtgtt

SEQ ID NO: 4878 - DNA, 248 bp, synthetic construct
  misc_feature 1..248: note = Description of Artificial Sequence: Synthetic polynucleotide
  source 1..248: mol_type = other DNA
tcggcgtaggcgagtttggtttaagggttcggatcgggtttgggaaaagtttgtttttcgagggggagagcgagcggtcgcgttgaggcgttcgcgttgcgcgggggcgtttttcgttgtttgtagggagcgcggcgcggacgcggcgggcggttcggttatttggaacgggcgttcgttttggttttcggggttgtttttgtcgtttcgggaagtcgtcgatgggttttatcgttggcggttcgcgt

SEQ ID NO: 4879 - DNA, 216 bp, synthetic construct
  misc_feature 1..216: note = Description of Artificial Sequence: Synthetic polynucleotide
  source 1..216: mol_type = other DNA
tcgtcgtcgttggtgggtggcggcggttcgggtgttttttggattgcgtagtaaagaggtattttgggagatggggttaaggttttagggggtgttattcgcgaacggtttattcgttagattaggggggttttttggttgtgcgtttggttagaattggttttgacgatggaagtttttggaattaaagcgttgtttttttttttttgtgttata

SEQ ID NO: 4880 - DNA, 201 bp, synthetic construct
  misc_feature 1..201: note = Description of Artificial Sequence: Synthetic polynucleotide
  source 1..201: mol_type = other DNA
gtatttattagggcgtttcgtaaaaaatttcgttttcgtttgtttttgggaattataggtaagttttgggttttcgaggtgtagttttaggtagagtttcgtgttgggaggtgggaagggggtttgattttggggatttaggtagtttggggatagttttattaggggtcggtgtttagaattggtgagggaggtatttta

SEQ ID NO: 4881 - DNA, 208 bp, synthetic construct
  misc_feature 1..208: note = Description of Artificial Sequence: Synthetic polynucleotide
  source 1..208: mol_type = other DNA
cgagacggataggaatcgaggagatttttttgtagcgttttttatttttcggatagaaattttgtagattacgtttatttttttatttcgtgtatcgttcgtggttcgtgggtagtagttgtttttttgggatttttttcgtttgttcgcgagttttcgtacggtcgcgtttttgttgttggggtcgttcgttggttttggttgttcg

SEQ ID NO: 4882 - DNA, 201 bp, synthetic construct
  misc_feature 1..201: note = Description of Artificial Sequence: Synthetic polynucleotide
  source 1..201: mol_type = other DNA
atttggtttaatcgtcgttagttttaagttacggtttcggttttttttttttaattgtgtgggatttcgtcgtttggtttcggtcgggcggaggggtgacgttagtcgtttatatagtgttttttggtcgttggagttcgggaaatttgtgcgttcgaatttggtttcgttaagaagttgggtaaggattcgggtttttga

SEQ ID NO: 4883 - DNA, 364 bp, synthetic construct
  misc_feature 1..364: note = Description of Artificial Sequence: Synthetic polynucleotide
  source 1..364: mol_type = other DNA
ggcggttagtagggttttcgttttcggggagaagtgtttacgatttaagggttgtttgttttaggaattttttaaagaattatagatattgagagtattcggggtttggtaggaagtgtagtgtattttttagttttagggtaattaggatagtatgaattttttattttgtggtagaataaacggttagcgtttcgatgtggcgcgttcgatttttttttatagagtttaaaagttacgtttaattaaattgtagcgttttcgttttagttgggtatcggtttggaagcggtttggaattagattggattcgaggaggtaagatttcggtagcgcgaggttaattataggttttattcgcggt

SEQ ID NO: 4884 - DNA, 213 bp, synthetic construct
  misc_feature 1..213: note = Description of Artificial Sequence: Synthetic polynucleotide
  source 1..213: mol_type = other DNA
ttttttaggtttttggcgttttcggcgcggttgttttcgcggttgttttcgtttatggtcggcggcggtgcgtagcgcggcgttgttcgtcgtgttgagcgttgattcgcgcgttcgttgttgttcggttttcggcggcgagaatggaaagttgtcgttttcgttaatttcgaggagagatagaagattttatatgttggggagaggttgggc

SEQ ID NO: 4885 - DNA, 201 bp, synthetic construct
  misc_feature 1..201: note = Description of Artificial Sequence: Synthetic polynucleotide
  source 1..201: mol_type = other DNA
ggtttgtttttggaagaatcggttttttagtttttcgtcgtcgtagttgtgatataagtaagtgtagtcgcgttgttcggggttcgttagggtttttcgcgttcgttttttatcgtggttcgcggcggtcgcgttttcgtttcgtttcgttcggtcgtttcgtcggtttttgtttttagttgggttgtcgtgacgaggaga

SEQ ID NO: 4886 - DNA, 201 bp, synthetic construct
  misc_feature 1..201: note = Description of Artificial Sequence: Synthetic polynucleotide
  source 1..201: mol_type = other DNA
tttatttatcgcgtttaattattttgtatagttggtttttttttttttttaagtatagtttaagaaggtaaagggagataggaaagggtggtagtttgacgatttagcgatgtattttagaatcgtttttatttttttagtgtgaagttttttgggagaggtgagttaaatcggacggtcggtttttgtagtcgtttagag

SEQ ID NO: 4887 - DNA, 296 bp, synthetic construct
  misc_feature 1..296: note = Description of Artificial Sequence: Synthetic polynucleotide
  source 1..296: mol_type = other DNA
tattagtcgggttggttgggcggttcgggagttcgagcggtggcggagcggcgagtagcgagtagcgtttgcgggagcggtcggtcggtcgggttttcgcgtttcgtacgttcgtacgtttagcggggttcgtattgagtatgggcgcggcggtcgtgcgttggtatttgtgcgtgttgttggttttgggtatacgcgggcggttggtcgggggtagcgggtttttaggtaagttttcgatcgaggtggggggcggcgggcgcggggggttcgggcggtcgaggcgcggtttcgga

SEQ ID NO: 4888 - DNA, 201 bp, synthetic construct
  misc_feature 1..201: note = Description of Artificial Sequence: Synthetic polynucleotide
  source 1..201: mol_type = other DNA
gtttttagtaggtttttattttatttttttcgtcgttcgtcgagttgggttttattaagggtatgcgaagtcgtaaggaaggtaagatgtagcgggcgtcgcgcgatagtgacgcgggtcgggagggttaggaattatagtcgcggttttaggacgaatttcgggtttagtagtttcgggcgtaggagtcgttaggtaggg

SEQ ID NO: 4889 - DNA, 297 bp, synthetic construct
  misc_feature 1..297: note = Description of Artificial Sequence: Synthetic polynucleotide
  source 1..297: mol_type = other DNA
tgtattttcgatacggagttggtgtttcgggaaggttgttttttgaagttttttttgttttgttgtggttttgttttttcgcggatttttttttcgtgtcgaggtttagtttttggttttaaggaataaattcgttggtttgaaagggagttacggtagaagtttaggggtagagcggcgggagcgcgcgattcgcgcggttggagtttcgggggtatttggagagtagcgcgtttaagcggggttattggtttcgcggttgcgtttttttttttttcgcgtcgcgttttttttttc

SEQ ID NO: 4890 - DNA, 268 bp, synthetic construct
  misc_feature 1..268: note = Description of Artificial Sequence: Synthetic polynucleotide
  source 1..268: mol_type = other DNA
gtgtagcggggtttggcgtcggtttttttttattacgcgttcggtttagggtcgtttagtcgtcgttatcgtcgtcgttttttgggtcgatggagtcggcgcggaaggttcgcgcgttttgcgtcgtcgtcgtttagtgtcgtcgttagtatttttttcgttttttcgtttttcgggtttatttcgcgggggcggcgttattttttcgttgtttaggttcgggtatcgcgggcgtttcgcgggcggtagtcgtttttttcgagcgcga

SEQ ID NO: 4891 - DNA, 201 bp, synthetic construct
  misc_feature 1..201: note = Description of Artificial Sequence: Synthetic polynucleotide
  source 1..201: mol_type = other DNA
aaggagcgggattgttttttcggttggacgatagcgtcggggattcgtagcgtgcgcgggtcggaattaaaaaagtagttcgggagcgcgagggttgagcggggtaagtatgggttgtttttcgtagttttttttttgttcgaggttcgggttggtcgtttgtttgtttatgattgtttagttgttttttcgattgtttag

SEQ ID NO: 4892 - DNA, 201 bp, synthetic construct
  misc_feature 1..201: note = Description of Artificial Sequence: Synthetic polynucleotide
  source 1..201: mol_type = other DNA
ttaattcgttcgtagttgttcgttttggattaagtcgtttcgcggttcgtgttaggtagtgggttcgtttttttttttttttttttttttaaattgggacgtgcgaaggcgtagttgttttttcggggttttttttattttttatatattttgttttcgttttttgttttttaggttcgtggcggagagatgttgatcgcg

SEQ ID NO: 4893 - DNA, 201 bp, synthetic construct
  misc_feature 1..201: note = Description of Artificial Sequence: Synthetic polynucleotide
  source 1..201: mol_type = other DNA
gttttggagtttagtagagttggagcgtatattttcgttttttttttttcgttttcgagtattaggcggatatattcgtatttcgaatgttttagtgggcgtagagtttattagaaatggatagtcggatttttcggcgtttgttgggggtatcgttgttaggtgtttggggttcgttttttcggttttgttcgtataggg

SEQ ID NO: 4894 - DNA, 201 bp, synthetic construct
  misc_feature 1..201: note = Description of Artificial Sequence: Synthetic polynucleotide
  source 1..201: mol_type = other DNA
ggtcgtcgggcgttgtagtgggacgcgcgcggttgtgagtttgcgggatatgtttttcgcgtcggttttttgttggcggttatgaagaggtagaacgtgcggattttgttttttatcgtttgtatttttatttatttgttggtgggcgtcgtcgtgttcgacgttttcgagtcggattacgagatgcgcgaggaggagaaa

SEQ ID NO: 4895 - DNA, 302 bp, synthetic construct
  misc_feature 1..302: note = Description of Artificial Sequence: Synthetic polynucleotide
  source 1..302: mol_type = other DNA
cgttcggacgtcggagggtttcgattttcgcgcggtttatgcgttcgcgttcgtttcgttgtttcgcgaggttcgcgggatttttttcgtcgtcgtcgtcgcgttcgtcgttttcggaggagcgggttggtcgatcgttatcgcgtcgtttttcggtcgttttcgaagtcgttttatcgcggtttttgtcgttttggggtcgcgtttcgttttcgcgttttgggggttgagtcgagtaaatttcgcgtatcggtcgacgttcggcggggatttcgttgcgtattcgcgcgttcgggtgggcg

SEQ ID NO: 4896 - DNA, 201 bp, synthetic construct
  misc_feature 1..201: note = Description of Artificial Sequence: Synthetic polynucleotide
  source 1..201: mol_type = other DNA
tttttttggggttttttatgttaggtttcgcggttgtgttcgtaagcgtagatggtttcgggattcgggttattttgacgtcgtagatttagtacgttgcggatcgggtacgttggatttcgggataagtgcggagggtcgggggttggaagggattcgagagtagagttcgcgtttttattttacggacgcggttatcga

SEQ ID NO: 4897 - DNA, 220 bp, synthetic construct
  misc_feature 1..220: note = Description of Artificial Sequence: Synthetic polynucleotide
  source 1..220: mol_type = other DNA
cggttcgtcgtttcgtatttgcgttcgtagtcgcgcgttcgttcgttcgtcgtcgttaggtttcgcggttcgggcgtttatgtcgcgttttgcgttcgtcgtcgtcgtcgttgagagtcgcggagcgtagttcgagggagcgtcgggcgggggagtcgagcgatcgggggcggggcggggggcgagagttggttcggggttcggtagtcgttcgtttcgc

SEQ ID NO: 4898 - DNA, 347 bp, synthetic construct
  misc_feature 1..347: note = Description of Artificial Sequence: Synthetic polynucleotide
  source 1..347: mol_type = other DNA
ggcggtatatcggtagggcggtcggttttgttgggttttttgggcgtcggtttcgggggttcgggcggtttttttcggttttcggtttggattcgcgaacgcgcgggcgcgaggggttgggacgcgggagttttttgagtgcggagcgcggagttttggtgtttcggcgtattgtagttatattttcgggtcgcgcgttttcgtcgttttttattcgcgtcgtagggtttttttttttgaggcgtcgttcgcgtatcgtcgggggggagggggtagcgttaataaattggggagttcggttcgtcgcgtttaggttttcgtttggagtcgtcgtattcgggacggtg

SEQ ID NO: 4899 - DNA, 201 bp, synthetic construct
  misc_feature 1..201: note = Description of Artificial Sequence: Synthetic polynucleotide
  source 1..201: mol_type = other DNA
cgtgtacgtttcgtttttattggtttcgtttcgtgattacgttttcgtaattttgatagattttattttcgaggattttttttaggagtatagtgatttcgtttttatagggttcgtttcgttatattgattttttcgtgtcgttcgcgggattttatttttgttcgtttgtttcggtgtttatggggaagtttggtgtta

SEQ ID NO: 4900 - DNA, 201 bp, synthetic construct
  misc_feature 1..201: note = Description of Artificial Sequence: Synthetic polynucleotide
  source 1..201: mol_type = other DNA
tagattcgggggaattaggaaacgcgttcggcgattttcgggtagtagtatcgggttaggtttgttttcggaatcgttgacgttattcgtcgtttttttcgtttgggtttttcgcgggtcgtaggggtggaagttcgatttgggttagggttcggatttttttttttcggtttttgcgtcgtcgttttcggtgttaggacg

SEQ ID NO: 4901 - DNA, 225 bp, synthetic construct
  misc_feature 1..225: note = Description of Artificial Sequence: Synthetic polynucleotide
  source 1..225: mol_type = other DNA
ttgtagtttgggtaatcgagcgagattttatttaaaaaaaaaaaaaaaaaaaaaaattaaggttgaattcgggttttcgtacgttcgtatttatttgcgcggttattacgcgttgtttttcggcgattaggttgtattttttgtattggtagtcgcgttatatgtagaagcgtttgtggtttttgagcggcgaggcgtagtcgtggtttttgtagcgtgcgtatt

SEQ ID NO: 4902 - DNA, 318 bp, synthetic construct
  misc_feature 1..318: note = Description of Artificial Sequence: Synthetic polynucleotide
  source 1..318: mol_type = other DNA
ggttttggtagagcgcgtagcgagtcggggatgaggttttttaagttttcgttggtttgttgtcggcgtagcgttatttgcgtagttatgattcgttgtcgttcgatgatgaggatgtatttttcgtaggtgtagtttttgaagcggtagtaacgtttgtggtttttgagttaggataggacgttatggttgcggtagcgcgcgtatttgggcgtgcgttgtaggggcgttcgtggcggttgcgatatcgggtcgtttatgtataggtagggggagtcgtagtcgtttatgtttcgggttttcgaatgagttggtagt

SEQ ID NO: 4903 - DNA, 265 bp, synthetic construct
  misc_feature 1..265: note = Description of Artificial Sequence: Synthetic polynucleotide
  source 1..265: mol_type = other DNA
gtggagggaaggagggaggaagttagttaagtttttagcgatttagtttagtatatttcgaattttgtaaagttttgttcggttttttgtagtttcgggcgttttattttgttgaggtcgttttcggttttttttgatttaggttgggcgggaaaggtcgggtcgttttcgtttggtttagatcgttggtttattcggcgggcgcgcgtagttgtatttagcgtagcgttattggttttagtttgtagattgcgttttttttttt

SEQ ID NO: 4904 - DNA, 259 bp, synthetic construct
  misc_feature 1..259: note = Description of Artificial Sequence: Synthetic polynucleotide
  source 1..259: mol_type = other DNA
gggtcgcggggtcgggggcggtcgtcgtttggttgggggatcggggtcgtgttgggcgtcgcggagtcgggatagtagtagtggcggcggggatagcgtcgcggttggggtttcgcgttttttggagcgttttttgtttagatacgacgatttcgttcggaggtatatcggttttggggataaagattagagagagatgttgtagattttggggttggcggtaaggatttttattcggtttttcgcggtttttttttcg

SEQ ID NO: 4905 - DNA, 201 bp, synthetic construct
  misc_feature 1..201: note = Description of Artificial Sequence: Synthetic polynucleotide
  source 1..201: mol_type = other DNA
gagcgtagattaggtttttagggcgcgggagtttgttgtttttttttgtaggggtcgttttcggacgttttattcgtcgttacgtggtttcgggatgtgcgggttgcggtagagagtgggtagtaatgtttttggttttgcgttttcgttttagtcgcggggatttcgaggcgagtcgttaattggtatcggtgtttcgtt

SEQ ID NO: 4906 - DNA, 323 bp, synthetic construct
  misc_feature 1..323: note = Description of Artificial Sequence: Synthetic polynucleotide
  source 1..323: mol_type = other DNA
acgcgtttgtcggggaagggttcgtcggcgtcgcgttttcgaggtttttgcggcgaatcgcgttacgcgcgatttttggtcgggggcgggaggcggcggcggcggtaggagaagtttaaggttcgagcggttcgtagtttttacgtttgtatttttttattttcgttagttcgatggttcgtttcgcggcgtgtattggagtaagtaggtttcgtttcgagcgcgcgcgttttgggaagtgttgtaagtttggagatttggagtgagtttcgggcgttgttggttcgattgttcgcggtgttttttcggtgaggtcgcggggg

SEQ ID NO: 4907 - DNA, 201 bp, synthetic construct
  misc_feature 1..201: note = Description of Artificial Sequence: Synthetic polynucleotide
  source 1..201: mol_type = other DNA
tagcggcggcggtcgagtttagttcgtagggtgggaattgagataggcgttttacgttgtttatcgcggttgtcgcggtcgtcgtcgtcgtcgtcgttacggtcgtcgttttttgtattttgtcggggtgagacggttgttgaggttgcgattgttggggcggttgttgcgggggttgtgacgggaggtgcggaggcggtt

SEQ ID NO: 4908 - DNA, 355 bp, synthetic construct
  misc_feature 1..355: note = Description of Artificial Sequence: Synthetic polynucleotide
  source 1..355: mol_type = other DNA
tagcgtcgtatagaagtcgtagagtagcggcgtgaagtcgcggttcggcgcgtatcgggtcgtcgcgaagtatagtgttattattttgttttgtagcgtcgtttcggtttttatcgtcgcgtttttataggttattaggtgtcgttcgtttagaatgttaattatggcgtagatacgtagttatttgagattcgaggatatttgtaggaggatgattatttgcggggaggcggcggcgagcgtcgcggtgtttcgtttttgttcgtattatcgggcgttggattttttaagatttgttttagatgcgtttatattttggttaggtttcgtttgtggttggagtaattgtgttcgc

SEQ ID NO: 4909 - DNA, 201 bp, synthetic construct
  misc_feature 1..201: note = Description of Artificial Sequence: Synthetic polynucleotide
  source 1..201: mol_type = other DNA
tgtatttgcgtcgtttttggtttttttaggaatgcgttgaagtttgtaattagttttgtgaagttattgagtgtacggttgagtgaaatttttaaagttcgaggaaaacgggtcggttgaatgggagttagtatggggtttttttttaagttttcgcgttgttaaattttagtagagttttttataatcgtttcgcgcggg

SEQ ID NO: 4910 - DNA, 290 bp, synthetic construct
  misc_feature 1..290: note = Description of Artificial Sequence: Synthetic polynucleotide
  source 1..290: mol_type = other DNA
ttgttatgcgcggtagttcgcgtcggggtcggtattagtagcgttcgggcggatgtagcgagtttacggaggggtatgtttttacgtattaagtataatcgttttaggaatgattcggtgatatcggtcgatgattttttttatagtttgtcggtgagcggcggcggaggtaaggtttcggcggcgcgcgcgatttcggcggcggttttttatttggtgttcggcgaggcgttgcgtaaggcgttcgacgatgggttcggtagtttgggttatttgttttataaggtgtt

SEQ ID NO: 4911 - DNA, 201 bp, synthetic construct
  misc_feature 1..201: note = Description of Artificial Sequence: Synthetic polynucleotide
  source 1..201: mol_type = other DNA
ttattcggcggaaattcgcgagtcggttttttcgcgtttaagaagtttattttttaagtttttttattatgattttgaatgcggataattggggttaaacgaggaaggatatagatttaaaagttagatttaggttttagcgcgtttttgggttttaatttgggagattcgtatttagttcggcggaagttatagttttta

SEQ ID NO: 4912 - DNA, 201 bp, synthetic construct
  misc_feature 1..201: note = Description of Artificial Sequence: Synthetic polynucleotide
  source 1..201: mol_type = other DNA
ttttagcgtttaggtcgattgcgttttgatcgggagttattgcgtttagcgtagttcgagggcgttgagttcggaggatgcggcgcggggcgggggtttcgggagtaatagagattgggattcgagggttcggttcgcgttgttgtttacgtagcgtttttattttggaaagagtgtttttcgcgcggcgggtcggttttt

SEQ ID NO: 4913 - DNA, 288 bp, synthetic construct
  misc_feature 1..288: note = Description of Artificial Sequence: Synthetic polynucleotide
  source 1..288: mol_type = other DNA
gtttaggagaattcgtaagttagcggcgtttgcgttcgagttgtagtcgttttttgtcgtttacgcgagttcgagagcggttttcggagttcgggttagcgtcgagttgtaggcgcgcgtttaatcgttttgttgggtttacgcggtttgagaggtcggagcgtttaattgttggtacgcgagtaacggtttagttaagtttattcggtttgagaggtcggaggttgcgagtgtcgttgttgaaggttgtggtggatcgggttggatcgcggattttgagttatatcg

SEQ ID NO: 4914 - DNA, 212 bp, synthetic construct
  misc_feature 1..212: note = Description of Artificial Sequence: Synthetic polynucleotide
  source 1..212: mol_type = other DNA
ttttgcgtggtagatatttagggataggttaattattatttttaattattcgtttttgagaggtttaggatttgtttttatttgatggatagtggtgtacggattaaagacgacgtaggataggtaatttttttttttaatttttcgggattagggtagttttgaagatttttagaggtagttaagtagttttttttcgtagcggggagtga

SEQ ID NO: 4915 - DNA, 201 bp, synthetic construct
  misc_feature 1..201: note = Description of Artificial Sequence: Synthetic polynucleotide
  source 1..201: mol_type = other DNA
gaggtagggaggcgggggtgcgggaggtttcgcggttgcgcgggcgcgtgttggtggtttcggcggaggtttagtttcggttcgcgttcgcggcgttttcgttgcggttcgagcggtttggttgcgggatttgtgcgtacggatggcgcggtcgtttcggtagtattcgggggtttgggcgtcgttgtttttgttgttatt

SEQ ID NO: 4916 - DNA, 246 bp, synthetic construct
  misc_feature 1..246: note = Description of Artificial Sequence: Synthetic polynucleotide
  source 1..246: mol_type = other DNA
cgtttagtttcgcgtacgtttttttgcgagttcggtcgtttagcgttttttttcgttcgagtcgtcgtttgcgtttcggggtagtcgttttgtttttagcgcgatgtggtttcgtttggttttttgttgttggggtttggcgttcgtttcgggttgggcgattttttagtagatgttttcgtcgcgtaattttagttttcgtttttttttcgagatcgcgttcggggttttcgggagtattttcgc

SEQ ID NO: 4917 - DNA, 201 bp, synthetic construct
  misc_feature 1..201: note = Description of Artificial Sequence: Synthetic polynucleotide
  source 1..201: mol_type = other DNA
ttttttagggatggagtagttacgtttttcgagtgtgtttattttatcgatggagtaaagtgaggtttttagttcgttcggatgtttttgcgtcgttcgcggggtagttttcgtatagatacgttcgtaagttttcgattcgttcgttattcgcgtttagatattcgcgagtttttggggtcgtagggacggtgtagcgtt

SEQ ID NO: 4918 - DNA, 201 bp, synthetic construct
  misc_feature 1..201: note = Description of Artificial Sequence: Synthetic polynucleotide
  source 1..201: mol_type = other DNA
attttagatatataggtagtcgggattttcgttcggtgcgtttgtttatttatttttttgcgttaggttgggacgcgtttcgtttgtaaaaggtttaaacgtatttttcgtcgcggggcgggatttaggggtttaggtttcggggtttagaggcgggtaattttgttaattttttttagcggcggggaacgtcgcgtaatc

SEQ ID NO: 4919 - DNA, 358 bp, synthetic construct
  misc_feature 1..358: note = Description of Artificial Sequence: Synthetic polynucleotide
  source 1..358: mol_type = other DNA
ttaacgggttcggtgtatcgttatcgcggtttcggtttcgttcgagttcggttgagtttttaggtcgggtttcgggtttcgggcgttcgcggggtaggacgtttttcgtcgaggcgtaggggtagttatattgcggggcgtttgggcgacggcgttaaagttagggttataagggtacgggataagcggggcggggggagtaggagattaggatagaggtcggcgttcgtcgcgggcgtttttacgtcgcgggtatcgttcgttcggttttagcgttcggggcgtaaagtaagggcgtaaattttgttcgaggcggcgacggttgcggtcggggtttattttgaagtcgttaggtgtt

SEQ ID NO: 4920 - DNA, 201 bp, synthetic construct
  misc_feature 1..201: note = Description of Artificial Sequence: Synthetic polynucleotide
  source 1..201: mol_type = other DNA
gttgcgtgttcgtcgtttatagtcgtagttaaagagacgtaggcggttttacgcggtttggtttatcgtcgtttgtagtgttcgcggcgcggggcgtttcgaggttgggtttatcgtttttttcgcgtttttgaagatttttcgggttttttcgaaggagtattgtttttttttgtattttttttttagggagttcggtcg

SEQ ID NO: 4921 - DNA, 201 bp, synthetic construct
  misc_feature 1..201: note = Description of Artificial Sequence: Synthetic polynucleotide
  source 1..201: mol_type = other DNA
cgttttttcgttttcggttcgagcggtcgttatcgcgggcgggcggcgttgcgttcgggtgcggtttttcgtcggcggcggcggcgcggtcgagaggtgcgggtttcgcgcgggcgggacgcggggcgttgttcgtaggagcgattaggtgggcgtcgggtcgatcgtagtcgtcgtcgcgttttttttcgcgtttcgggt

SEQ ID NO: 4922 - DNA, 201 bp, synthetic construct
  misc_feature 1..201: note = Description of Artificial Sequence: Synthetic polynucleotide
  source 1..201: mol_type = other DNA
gtcgaggtttagagtcggtttttgttcgtaggcggcgaacggtattttgtttcgttaggtttttgcgggtgtgattcgtgattcgtagattttttcgggcgtttttggtttatgacgcgggggttgttcgttttacgtaggcggtttcgggatgttttttcgtttagattttagcggtagaaatagtttcggatttttttt

SEQ ID NO: 4923 - DNA, 277 bp, synthetic construct
  misc_feature 1..277: note = Description of Artificial Sequence: Synthetic polynucleotide
  source 1..277: mol_type = other DNA
aggggagtaaaacggagttttcgggggtacgtaggtttcgtttttgggtgttggttttgtttttggtttttttagtcggtgtagtgattcggaatagcgcggtcgttttttcgacgttcgcggttttttattgcgtcgaggcgagcgttacggttaaagtttaagtttcggcgttcgttgcgtttgtcggagttttgtttgttcgagtaggtagcggggtttaggtacggcggcgacgtcgaagggttagtcggtagatagggttgggtttttgcgg

SEQ ID NO: 4924 - DNA, 201 bp, synthetic construct
  misc_feature 1..201: note = Description of Artificial Sequence: Synthetic polynucleotide
  source 1..201: mol_type = other DNA
tattttgtttttagttcgattttttttgcgttcggagtttgggttcggcgcgtaggagattgcgtgtattttggcgttttcgatttttgttagggcgtacggggattttagagcggattttttacgagttttaataggaggttagggagtcgggatattagagataaattttttcgaagttttttttcggttttattgatt

SEQ ID NO: 4925 - DNA, 247 bp, synthetic construct
  misc_feature 1..247: note = Description of Artificial Sequence: Synthetic polynucleotide
  source 1..247: mol_type = other DNA
gtcgttatagtcgtttcgagttcgcgcgtagttttagttgttacgcggattttttgtttagattgcgttgttgaagtcggcgtttcgttttatacgggtcgcgttaattcggtcgttgtgtacggtcgggtgcgaaattttttcgcgggtttacggggttgtcgaggcggggtcgtagcggtcgtcggggttggggttggtttcggtttgagatagttttatggaaggttaggttttcggtttttgc

SEQ ID NO: 4926 - DNA, 201 bp, synthetic construct
  misc_feature 1..201: note = Description of Artificial Sequence: Synthetic polynucleotide
  source 1..201: mol_type = other DNA
cgtcgtttcgcgcgtttcggttatcgtcgtgtttttttcgggcgttagggaaggtggttaggtggtttttgttcgtcgcgttttgcgtttcgcgtcgttcgttttgcgttttgttttgttcggttgcgttttttcgggttttttcgtcgttatcgggaagcgtcgttcggttttgagcgttgcgcgggttgcgcgcggggg

SEQ ID NO: 4927 - DNA, 201 bp, synthetic construct
  misc_feature 1..201: note = Description of Artificial Sequence: Synthetic polynucleotide
  source 1..201: mol_type = other DNA
tttgaagtcggcggtgtttaggagcgcgtcgtttttcgcgtagggtcgtttgcgggtatacgttagcgttttttagttcgcgtcgggcgttttcgcggacgcgcgtagttttcggttcgttaggttcggttcgcgtagcgtagttcgcggttatcgcgatttatcgggcgggcgggcggtcgggcgggggcgggtttggcg

SEQ ID NO: 4928 - DNA, 201 bp, synthetic construct
  misc_feature 1..201: note = Description of Artificial Sequence: Synthetic polynucleotide
  source 1..201: mol_type = other DNA
taggtttggttttagaatcgtcgggttaaggagaagaggttgaagaaggacgtcggtcggtagcgttgggggtagtattttcgtaatatgaagcgttttcgcggcggttttaagtcggataaggatagcgtttaggaggggtaggatagcgacgttgaggttttttttttcggtaggcggagggatcgcggagttcggggg

SEQ ID NO: 4929 - DNA, 356 bp, synthetic construct
  misc_feature 1..356: note = Description of Artificial Sequence: Synthetic polynucleotide
  source 1..356: mol_type = other DNA
ttgatcgtgatgataagaaggttggggaggttaagagaaaagggaagagagagtgtagttgtaaattttttttcgggttcgagaagtatcgtttttttgcgtgtttaattggtatttgttattaatatgtttgtttttatttaaatggtttagagtaaggttttgattaaattagtatttttacgttaatatttagtagcgtttttggtttttggtagattttttttttagttgttaaagtaaaattatagaagcgttttggttttatttaaggtttgttggggttttttgttttttttcggagattcgaatagttcgtagatgtgcggtatttgtttatgttcgtgtttcgtgtt

SEQ ID NO: 4930 - DNA, 201 bp, synthetic construct
  misc_feature 1..201: note = Description of Artificial Sequence: Synthetic polynucleotide
  source 1..201: mol_type = other DNA
agtcgatacgcgcgatgcgcgagaaagcgcggtgtatcgggtcgttgtcgcggtaaaattgtagtacgtggcggtatacgttgtttacgcggtcgtatacgtagcgcgttttgtgggcgttttagttttcgcggcggtataggcgcgagtagtagtaggtgtagtagttgtggtaggatttgaagtagaggtaggcgttga

SEQ ID NO: 4931 - DNA, 281 bp, synthetic construct
  misc_feature 1..281: note = Description of Artificial Sequence: Synthetic polynucleotide
  source 1..281: mol_type = other DNA
gggttttatcggggcgtagggttggggaatcggagtttcgttcgtcgattcggagtatcgtttacgtagattcgtttcgggcgagggaggggtcgggcgcgtattcgcggggagggcggcgagcggggattagtcgaagtcgggagaggggcgtttttacggggcgggaaattggcgcgcgattttgggggaagtgtaggatggggggataggggcgttttcgcgggggtggatgggggattatagcggggttggcggggtaggggtcggcgtacgaggtt

SEQ ID NO: 4932 - DNA, 222 bp, synthetic construct
  misc_feature 1..222: note = Description of Artificial Sequence: Synthetic polynucleotide
  source 1..222: mol_type = other DNA
tatcgatttttcgtgtagcggtttcgtttcgtcggattttaattattgttttaaggattgggattataatggtttttttgtgtttattattaacgttatcggttaggtgaggcggttaggcgggtcgcgggtttgggggcgggtagagagcggcgagggcggggttttacgttcgttgtattttttttatatttttagtgggatttggtgtgtgatttgggt

SEQ ID NO: 4933 - DNA, 237 bp, synthetic construct
  misc_feature 1..237: note = Description of Artificial Sequence: Synthetic polynucleotide
  source 1..237: mol_type = other DNA
gcggttcggaggcggttatgattatgtatatgaaggggcggtcggtgcgtcggttcgtggggtagatggtggtgggcgtgaagcgtttgttggtttcgacgaattcgtaaagttgttcgtagacgcgcgggaattcgtggcgtaggaagacgtcgcgtagtcgtagttcgcgttggatgtggatgaaggttatttcgcgcgcgcgtcggttcgtttcgtcgttttgatttaggttcg

SEQ ID NO: 4934 - DNA, 201 bp, synthetic construct
  misc_feature 1..201: note = Description of Artificial Sequence: Synthetic polynucleotide
  source 1..201: mol_type = other DNA
ggtttggaatagagattttagttgatttataaggacggggtttgagatttggggttttttgttatagtggtataatttagtttgtattgattaatatagttttttgtgaatttcggttttaatatttaaattaaggtattcggttgttttattaagttgttatacgtttatttaaaagtattgttagattgaggaattagg

SEQ ID NO: 4935 - DNA, 364 bp, synthetic construct
  misc_feature 1..364: note = Description of Artificial Sequence: Synthetic polynucleotide
  source 1..364: mol_type = other DNA
gcgttcgggttttgtagttttttgttgttgttcgcgttcgggtacgcgtgtttcgcgggttgcgtttgtatcgattcgtatatcgtggattgtcgcgatcgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacgtttagcggttcggttaagttcgtgtttttcgattttagttataataatttgatttagttgggcgtcggcgtttttcgttcggtcgggaggttggtgaagt

SEQ ID NO: 4936 - DNA, 201 bp, synthetic construct
  misc_feature 1..201: note = Description of Artificial Sequence: Synthetic polynucleotide
  source 1..201: mol_type = other DNA
tcgggatacgttttagggaaatcgtttttgggtttggtagttgaatttagacgtcgagtgtagttcgttcggtgcgcgcggcgttttattgttagatttcggaaattagttgttagggtggggtcgcgttttggcgacggttattcggttatttttgtcgttttcgttttttttaagagatttttttagcgggttaatttt

SEQ ID NO: 4937 - DNA, 201 bp, synthetic construct
  misc_feature 1..201: note = Description of Artificial Sequence: Synthetic polynucleotide
  source 1..201: mol_type = other DNA
gttttagaggggagtcggggtggatttttatggaagggagacgtttgcgttagtttaggagtggagttcgtgttttatcggttttttaaattgcgagtacgaaatttttagaggggagttgagttggtgtttcgcgtgttttttattttttattttttattcgtaggttagatttgcgttgtttattttaggagggagcgt

SEQ ID NO: 4938 - DNA, 201 bp, synthetic construct
  misc_feature 1..201: note = Description of Artificial Sequence: Synthetic polynucleotide
  source 1..201: mol_type = other DNA
tcgttttatcgatgcggagcgcgagttgtttattgttttttattatgtttaggattttggtttgggggcgagagaggtgataaagagttgtatgatgcgcggggggcgcgcggtcgggtattttcggttttatttgttgtgtttttcgcggttcggtttcgttcgcgtttcgatttttaggtatcggtagcgtcggttttt

SEQ ID NO: 4939 - DNA, 222 bp, synthetic construct
  misc_feature 1..222: note = Description of Artificial Sequence: Synthetic polynucleotide
  source 1..222: mol_type = other DNA
agcgtatatatatagatataggtttatatagatagattcggttttaaaaatacgtattcgtagaggtaaaggttagcgtataagtacgtatagatatatcgataggcggttttcggatatcgcgttttttgtcgtatttacggtttacgtaagggtttatatacggttttacggaggatagttataaaatatttagatatacgttatatacgtacgcgcgta

SEQ ID NO: 4940 - DNA, 201 bp, synthetic construct
  misc_feature 1..201: note = Description of Artificial Sequence: Synthetic polynucleotide
  source 1..201: mol_type = other DNA
gtttatatatattagtgaaacggttaaatggtagtattaggtgttaagtgatcgtataggcgtgtttttgttagttgtgagtaagataaggtagtttatcgtttttagggagtttagtttttatgggggtgtattcgtttgttagggttgttgtatttaagtattattaattcggtggcgttaataatagattttattgtt

SEQ ID NO: 4941 - DNA, 265 bp, synthetic construct
  misc_feature 1..265: note = Description of Artificial Sequence: Synthetic polynucleotide
  source 1..265: mol_type = other DNA
ggcgggcgtcggcggggcggttttttagtaagatgtgcgcggcgtcgcggggcgttttttatttgtagcggcgttcgggagtcgggcggttgggttaggcggcgttttcggggttgttgcgcgttcgcgtttagagttgtcgttttagggagttcgttacggtcgcgtttcgggtacgttcggcggcgtttaacgatgatcgttttttggcggcgttttcggagtttggtttgggaatattgggtcgggtttttcgtgtgcgttt

SEQ ID NO: 4942 - DNA, 242 bp, synthetic construct
  misc_feature 1..242: note = Description of Artificial Sequence: Synthetic polynucleotide
  source 1..242: mol_type = other DNA
gttttcgtcggcggcgttgtattattattattattatatattgttcggtttagtgtagtgatttcgcgggtcgggttttcgtcggcgcgttgtagggcgcgggcgcgtagttcgttcgcgcggtttggattttttttgttcggttgttttggattttataaaaaaaaaaaaaagtttagaaattttcgaataaaattaaatattcggacgatttttttcggtgagcggcgaagatagttcgg

SEQ ID NO: 4943 - DNA, 201 bp, synthetic construct
  misc_feature 1..201: note = Description of Artificial Sequence: Synthetic polynucleotide
  source 1..201: mol_type = other DNA
ttttttttcgttttttttttgtttttttttttgttttgtggtttttttttttttttttagagatatttgggagttgtttttaagttttggggcgtttcgcggggttttgttaagggtgcgtgtgagagagggcggcggagtcggcgtcgggtgttaggggtcgagggtgggagcgggagttcgtggttttgcgttttggag

SEQ ID NO: 4944 - DNA, 261 bp, synthetic construct
  misc_feature 1..261: note = Description of Artificial Sequence: Synthetic polynucleotide
  source 1..261: mol_type = other DNA
cgggttgtacgcgtaggcggtttattcggggggcggcggcggcggtttggtcgggatgttggcggcgggcggtggcggcgcggggtcgggtttgtattacgcgttgtacgaggatggttacgaggcgtagttggagtcgtcgtcgtcgtcgtatttgggcgtttacggatacgtatacggatatgtatacgcgggcggtttgtacgcggcggcggcgtatttgtattcgggcgcgggcggcggcggtttatcggtgggcga

SEQ ID NO: 4945 - DNA, 201 bp, synthetic construct
  misc_feature 1..201: note = Description of Artificial Sequence: Synthetic polynucleotide
  source 1..201: mol_type = other DNA
ggggattcgcgtaggttagcgtgtcggttttttttagtttatcgttgtcgtcgtcggggttgttttaagggagttaagcggagtgggagcgggtttgcgcgtttttgttttgcgcgtaggggcgggggggtttaggacggggcgtttttttttatttatatgttgatttaggatttttaagcggttcggtttaggatatcg

SEQ ID NO: 4946 - DNA, 337 bp, synthetic construct
  misc_feature 1..337: note = Description of Artificial Sequence: Synthetic polynucleotide
  source 1..337: mol_type = other DNA
gtaagagcggtgtagtcgagtcggcgttttagaagtcgagaggttatataagtttacgtagagaggcgtatcggatacggtaattaggagtaatttatacgttttcgggcgtacggaaattatttgttaggaaatttttaacgttttttttcgtttatttttttttattttttttttggcgcgttttttttttttttagaggtacgtagtggagtttttggagtttcgaatttttcggatattgtagaatgcggggtttttcgggcgcgggttcggttaattagagcgtcgtttgttttttttggttaatggtaggcgttatattgttgtttaattt

SEQ ID NO: 4947 - DNA, 201 bp, synthetic construct
  misc_feature 1..201: note = Description of Artificial Sequence: Synthetic polynucleotide
  source 1..201: mol_type = other DNA
aagttttgggtggcgcgtaaaggcgtaggcgagggtcgtcgtatagagtcgtttaagttgtggtcggagcgttagggcgatttttgggaattttttaagcggaatttttcgagataagcggtttttgttttttgatattttagtcgaggtcgagttgacgcgtagttatttaattttttttgtttcggggaaataatttta

SEQ ID NO: 4948 - DNA, 201 bp, synthetic construct
  misc_feature 1..201: note = Description of Artificial Sequence: Synthetic polynucleotide
  source 1..201: mol_type = other DNA
atgagtcgagagggttgagcggagagtgtggttttcggcggttggaggtaggagaatatgttgcgttcgttcgtcgcggcgtgagaggttcgaggtgggcgcgtcggggtaggggcggtcgcgggcgtttgttcgtttagtgggcgttgttcggatttggcgaggtggtggtttgtaatattgtgttcgtattgtttattg

SEQ ID NO: 4949 - DNA, 201 bp, synthetic construct
  misc_feature 1..201: note = Description of Artificial Sequence: Synthetic polynucleotide
  source 1..201: mol_type = other DNA
gtagcgtcgcggcggttagtagcgtcgggtagtggattcgcggtggcgcggcgtcgggtcgcggtgtttagggcgggagtagtagtacgaggtttagggcgagcgtttaggatagcgttagtatgttcgtcgtgtggcgtttttggtatagcgtttggtaggtggcgggcgttcgggtgatgagtaggtagcggtttaggg

SEQ ID NO: 4950 - DNA, 201 bp, synthetic construct
  misc_feature 1..201: note = Description of Artificial Sequence: Synthetic polynucleotide
  source 1..201: mol_type = other DNA
gttttaggagggaaggaggcgacggtgtttaaggacgtcggaagtcggggattttcgtttttttcgggtttcggttaggttattagtgttggttcgcggcgcgggtgtttagttgcgtttgggatattgcgggtacggttgtggcggtaacggtagcggtcgtcgcgtcgtcgacgttcggtaggattgagcgtacggagc

SEQ ID NO: 4951 - DNA, 386 bp, synthetic construct
  misc_feature 1..386: note = Description of Artificial Sequence: Synthetic polynucleotide
  source 1..386: mol_type = other DNA
ggtggtatgtacgttttatttaaaaagtagatttttttttgtaattgttagtaagtggaaggatagtaaattttatattatttcgagatttgtgcgtttcgagcggttttaatttcgtttcgtttgttgttgttgttgttggtgttgtttcggttgtagttgttgtcgttttacgatttcggggcgttgaggtaatagggttttttttttttattttttatttttttcggtttttttatagaagcgtcgtttttagtaatttttcgtgtattttttatttttgtcgtcgtttattttattttttttttttttgttttttttttaaatcgtttttaagtatatttttcgtcgttggaagtgattataatgttgttttttaataagta

SEQ ID NO: 4952 - DNA, 201 bp, synthetic construct
  misc_feature 1..201: note = Description of Artificial Sequence: Synthetic polynucleotide
  source 1..201: mol_type = other DNA
tttttcgtttttcgcggcgcgcgtcgttttcgggggtttcgcgttttcgcgtttaggttttttttttttggcgggcgtttataggcggcgcgggtagcgcgagtttcggagtttcggaggtttgtgcgttttgagtcggtatggatttcgagtattgcgcgttttttcgcgtggggtttgtattcggtttttatgtggttt

SEQ ID NO: 4953 - DNA, 201 bp, synthetic construct
  misc_feature 1..201: note = Description of Artificial Sequence: Synthetic polynucleotide
  source 1..201: mol_type = other DNA
ggggcgattcggagttgcgcgtcggcgtacgcgatttcgttcgttttttattttttgttttattattagttttaatttggttttcgttcgtcgcgcgttcggggtttaggggagcggcgcggggatttaggttttacggcggagagagcgcgcgggattgcgaagattggggtcgagtgtcgttttttttgcgttttggta

SEQ ID NO: 4954 - DNA, 309 bp, synthetic construct
  misc_feature 1..309: note = Description of Artificial Sequence: Synthetic polynucleotide
  source 1..309: mol_type = other DNA
aggcgtagacgttggagttggagcggcgttttcggtagtagcggtatttgtttgcgttcgagcgcgagtagttggcgagtttgtttcgttttacgtttacgtaggttaagatttggttttagaattatcgttataagttgaagcgcgttcgcgttttaggggcggcggagtcgtttgatttggtagtattcgtcgagttgtacgtcgcgttcggtttgttgcgtcgcgtggtggtgtcggtgtttgttcgcgacgggtagtcgtgcggcggcggcggcggtggcgaggtgggaatcgtcgcggtttagg

SEQ ID NO: 4955 - DNA, 203 bp, synthetic construct
  misc_feature 1..203: note = Description of Artificial Sequence: Synthetic polynucleotide
  source 1..203: mol_type = other DNA
agcgtatattgtcgttagttagttagtcgtcgtcgtattggtttagtttcgaaaatttttaggcggcgtagaggtgtttaattttggttattacggcgtcgcgtcgtcggtacgtcgcgtgggttttagatagcgttagtcgttcgggtacgaagaatatttggtttggggattatagcgggttatcgatcgagggtagggtg

SEQ ID NO: 4956 - DNA, 388 bp, synthetic construct
  misc_feature 1..388: note = Description of Artificial Sequence: Synthetic polynucleotide
  source 1..388: mol_type = other DNA
ggttcggttcgcggagttagcgtttttttcgcgtcgatttcgggtttcgggcggtcgtcggggggcgtcgggcgtatttttcgttgttaatttttcgttcgtgttttcgttcgcgtttgggtttcgtcgtattttagtagaagttattatagagaataaattatttttttgttttcgagatgggttttcggggaggaaggtaaattgtttgtttcgtgtataataagttaggcgtggagagtagcgcggaggaggtcgcggtagttatcgagcgggtagagtttttcgtttttattcgtcgttcgcgtttgtcgagttttttgtcgagcgggcggcgcgtaggttcggagaattttaaaaggtttggaatatcgggttgtttttcggt

SEQ ID NO: 4957 - DNA, 241 bp, synthetic construct
  misc_feature 1..241: note = Description of Artificial Sequence: Synthetic polynucleotide
  source 1..241: mol_type = other DNA
agttttttatttagatcgcgttagtgcgtttcgggttttattagtttttattaggcgttgtttttttcgtttttatttagtttttttttttcgttttttcgcgagtgtatttaagcgttttcgttttatttatttttagcgtttttttaagtttggaggagcgtttagagtagtagaaatagtaggtattttatatcgttcggcgtggggatttcgcggagcgtcgttgcgcgtcgttttt

SEQ ID NO: 4958 - DNA, 232 bp, synthetic construct
  misc_feature 1..232: note = Description of Artificial Sequence: Synthetic polynucleotide
  source 1..232: mol_type = other DNA
cgtttttttttttagcgtttaggttgggggcggcgtcggtgttagtttagtttagggcgaagtttttagggtcggttcgggtcgggttgcgggattcgtcgtggagcgtaaagtgtttgaagttttcgcgcgtattcggttttgtttttaaaggttttttagaaatgtaagaggttaggcgtagaaatatatacggacggtagttttatgagaaaatgtagataaagagttc

SEQ ID NO: 4959 - DNA, 214 bp, synthetic construct
  misc_feature 1..214: note = Description of Artificial Sequence: Synthetic polynucleotide
  source 1..214: mol_type = other DNA
gtttttttgttttcgcgttttttggattagttttggtggggagttggaaggtatcgagtgcgtttcggttaagaagggcggatagttttgtgcgagtagcgttcggttggcgcggcgcggggtgttttttatgttaaaggaaaggatggattttttgtttgtttagggtttttattttttaaaatttttttaattgcggtattggaagggattt

SEQ ID NO: 4960 - DNA, 250 bp, synthetic construct
  misc_feature 1..250: note = Description of Artificial Sequence: Synthetic polynucleotide
  source 1..250: mol_type = other DNA
cgtagcggggtcgttttattgtcgtatttttatttcgcgttttgcgcgtttatttgtttacgaagttttcgagtatcgagtttttgtcggcgttttggtcgtttattacggcgatttgcggtagttttagtaggtagttttgttttagcgtcgaaaacgcgttttgtagacggtttattagcgggattagtttttttatttttcggttttttattttgttcgaggggtcggcgattagttggtttttgtt

SEQ ID NO: 4961 - DNA, 201 bp, synthetic construct
  misc_feature 1..201: note = Description of Artificial Sequence: Synthetic polynucleotide
  source 1..201: mol_type = other DNA
tggtcggtgaagttttaggattcgttcgtttggggttaaggtaaggggtgcggtacgaggagcgtagggagtttcgagttttaggcgtagatttagttgcggattcgtcgtatagttttggtgttgtaagcgtggatcgtgggcgtaaggtttcggcgggaggtattcggttcggtcgcggtcgggtttgtagggttttgg

SEQ ID NO: 4962 - DNA, 467 bp, synthetic construct
  misc_feature 1..467: note = Description of Artificial Sequence: Synthetic polynucleotide
  source 1..467: mol_type = other DNA
tcgggtatcggcgggagaggggggagaagcggcgtggagaggatttggtaagggtttgtttttaaatttagattatgatttaatattttggacgcgaagcgaagatgggaaacggtcgtttgttgagagggggtatttgtagtttttttagaaaaggttggggtaggagagcgtgcggttagaggggtgggggtatcggagggggggttttattttttgttttatagtcgggtttttttcgcgaggcgttgggaagtatgaggtatgtagtatttaaaatgttttttgaaaaagacggatttgaagtttttttttataaatacgttattgtatttattttttatttagagacgggttgcgcgtttcgagttgtacgggtaggtatttttttcggttttgttttataaggtggggagagcggggttggacgcgggagggggcgggggggggagcgtgagaagaaacga

SEQ ID NO: 4963 - DNA, 201 bp, synthetic construct
  misc_feature 1..201: note = Description of Artificial Sequence: Synthetic polynucleotide
  source 1..201: mol_type = other DNA
cgtatagttagcgaagcgattcgagggttagcgaataagcgttggattttcgtaggtttcggcgattttagattcggtttttcggcgaagataggaaaacgtgtgtcgagagtcgttggagggaatcgttcgtaaatcgaagaagaaattaaattagtagcgaatatttgtaaattagtgttaagttgtgagtttttcgag

SEQ ID NO: 4964 - DNA, 232 bp, synthetic construct
  misc_feature 1..232: note = Description of Artificial Sequence: Synthetic polynucleotide
  source 1..232: mol_type = other DNA
tcgggcgcgggggaggcgtgggtgttggggcgggcgagtttagatttttcgtgggttggtttgtgggtgttttttcggaaataaatgaggttgtaggagcggtgatcggtttgattgtttttgggggtttcgaattcgtgggtggagagggtaaggcggaggtcgtggttagtatttttttagtgataatgtcgtcggggatttttttttttattttttgggagtattttag

SEQ ID NO: 4965 - DNA, 222 bp, synthetic construct
  misc_feature 1..222: note = Description of Artificial Sequence: Synthetic polynucleotide
  source 1..222: mol_type = other DNA
tacgattttaggttcgttgatgatcgttgtggtatgaatgaggttatcgtattcggagaggtggatgtttagatgtggatttaggaaatggttttatttcgaaagtttcgggttagtgggcgtgttttttggttagtgtttttacgttcgcgttagaagggtagtaggttttcgtagggttcggcgttttatttattcgtgttttttttgttgtttttagtt

SEQ ID NO: 4966 - DNA, 239 bp, synthetic construct
  misc_feature 1..239: note = Description of Artificial Sequence: Synthetic polynucleotide
  source 1..239: mol_type = other DNA
tagcgtcgcgttttacgttcgttatcgtcgtcgtcgttttagtatatcgtaggcgtgagtttcgtcgcgatcgggagagtttttttagttgtgcgttttcgaggtatttggtcgggcggggaggcgtcgggtcggggcgtataggggttaggcgggggcgttgttgtttatttttcgtttttcgggcgtgcgtttcgtttcggagttcgtatttcgcgttcgcgtttcgtttggaagtt

SEQ ID NO: 4967 - DNA, 209 bp, synthetic construct
  misc_feature 1..209: note = Description of Artificial Sequence: Synthetic polynucleotide
  source 1..209: mol_type = other DNA
gtttattcgtcgtagtagtttatttttgttcgttagggagtttagggtagtttttgaagttgttagatttttttacgtaggcggcggcgttttgtattgcggagtcgcgttttgggggagtagtatttttagtttcggcgtttcgtagttagatagttttttttagggtggtagtatttttcggttagggtgtagggattttcggggcg

SEQ ID NO: 4968 - DNA, 380 bp, synthetic construct
  misc_feature 1..380: note = Description of Artificial Sequence: Synthetic polynucleotide
  source 1..380: mol_type = other DNA
gtttagatagataaaattattttattaaagtgtaatgggagagaggaagaggagtaatgagaaggtatgtgagcggggagaaagaaaaagttcgggaggcgaaaacgaaatttatttttttgcgtttatttttgttagaggtttgtaggacgtgttttaatttggtatttcgagtttagaataaaagttacgggggttgcggtatgggtagggggaaggcgcgcggtggttgacgcggggtaggggttttggcgagcgcgggaggggcggttagtagtcgttcgcggggttggattgggagtttcgtgcgatttcgggtttggcgtttgggtcgggggtggttttcgggtttttttcgggggtcgtcgaggttcggtttc

SEQ ID NO: 4969 - DNA, 394 bp, synthetic construct
  misc_feature 1..394: note = Description of Artificial Sequence: Synthetic polynucleotide
  source 1..394: mol_type = other DNA
ggtttttttttatgagggtttcgagtagatgaggtttaaaagtcgttttaaggagttttttttaagtttgattcgagtgggcgcgaatttttatagtagcgttaagtagtaggattatagcgttagcgtttggtttcggaggaaagataagttggagtacgtaagggcgattcgttttcgggggtttcggttaggtatttgtcgtatgtatttttttcgtggtggtggtatgagcgcgcgcggggcgcggggggtaggcgaggggattttggtaggcgtcgacgttttaggtcggattcgggggtttttttgtttgtagttttttgttttaatgatcgggttgcggggaggggagggtaggtttttttttaggtttttggtttttgtcgattcg

SEQ ID NO: 4970 - DNA, 201 bp, synthetic construct
  misc_feature 1..201: note = Description of Artificial Sequence: Synthetic polynucleotide
  source 1..201: mol_type = other DNA
ttcggtttttttatttcggttttttatggggttttcgggtttgttcgttgtgagtagttttattttggggtgttggcgggatggttgtttcgtgtagggcgttcgggagtttagatttcgtggaaatgtttggggtttttttttgtttagaggggatagtgagtagttacgttgcgatatgtttgagggattcggacgaag

SEQ ID NO: 4971 - DNA, 557 bp, synthetic construct
  misc_feature 1..557: note = Description of Artificial Sequence: Synthetic polynucleotide
  source 1..557: mol_type = other DNA
cgggggaaaggtcggcgttttagggcggggaggatttgggagtggagttcggagataaaatcggggttaggtagaggagttagagggaaagttagtaaacgcgagttcgggtgagagttatcggaatgcgggaacgtagtttagtcgggaatagggttttcgataggggtcgttcgtggttaggacgcggtcgttgaatagaggtcgcgcggcggtttttgttcgagggatttcgtgggcgggggttatacggaggtcgcgtacggttttcggggttggcgggggtaggtgggaggatttttttcgggttcgcgaatttgatttggtagcggttaggtgtttggaagcgtttttaaatgatagggttataaagatatgttggttaggtttgtagttagcgtagtaacgtggtttgtaggagcgtagaacgaggttagatagggttattcggacgtcgtgttgttagtgggtgggggtcgggagtaagcggtattggtttggagatttcgcggtaggtgattttttttatttgggtagcgaggttgaacgatggcgat

SEQ ID NO: 4972 - DNA, 212 bp, synthetic construct
  misc_feature 1..212: note = Description of Artificial Sequence: Synthetic polynucleotide
  source 1..212: mol_type = other DNA
ttggagggagttgggggattttggagggtgggaagtggttgattttcggtggtcggatatttatttagagtttgattcgtattcgtgtttttttggaagcgttataattgcggggaaggagtttttagaaatcgtgttagttttaatatggcgggttaaggtggtttttaaaaattgaaaataaaggttttgaggtgggaaaaaatttagtt

SEQ ID NO: 4973 - DNA, 201 bp, synthetic construct
  misc_feature 1..201: note = Description of Artificial Sequence: Synthetic polynucleotide
  source 1..201: mol_type = other DNA
aatagtttttttcggtttttttagttttgtttaaggggtttggaaatgttcgtagttttaagaaaggttttatttaagtataggatggggtggggcgggcggggttaagattgttttggggattgaatttattttcgtttttagcgattttcggcggataaagcgtaagtttgtgtatacggtcgattgagttattggaaa

SEQ ID NO: 4974 - DNA, 201 bp, synthetic construct
  misc_feature 1..201: note = Description of Artificial Sequence: Synthetic polynucleotide
  source 1..201: mol_type = other DNA
gggggagttaggggtttttcgtttggggattttcgtgttgggtatttcgtacgttttggacgcgcgtagttttatcgggagcgaattttgtttcgtttgcgggtgttacggagaggggttgggaagtcgagttagttttggcggcgattgggggcgtttttggttttttgggggggcgggggcgcgtattgttgtttagga

SEQ ID NO: 4975 - DNA, 294 bp, synthetic construct
  misc_feature 1..294: note = Description of Artificial Sequence: Synthetic polynucleotide
  source 1..294: mol_type = other DNA
tttgaaagtttttgaagcggttttttttttttttttttttttttcgtaggtagagttgtggtgtggttgggtggtttgcgtgggcgttcgggggattcgcgggtattcgggacgaggcgagggcgtagaaaatttggagtttaattagtacggagttgagttttcgcgttttaatttttaggtgatttcgtgcggcggcggcggtagtagtagtggtagcggcgatcggagttcgtagtagtttcgagcgttttcgggaggataggcggcgagttcggcgaatcgttatttgtt

SEQ ID NO: 4976 - DNA, 244 bp, synthetic construct
  misc_feature 1..244: note = Description of Artificial Sequence: Synthetic polynucleotide
  source 1..244: mol_type = other DNA
ggcgggcgtgagcggcggaggagtcgggcgcggcgatacgcggttatggagcgggagtcggcggggatcgaggagttcgggttttcgggacggcggaggcgtcgagagggtaggacgcgtacggtgcgttttaatttgttgtcgttttcgggcgtcgaggattttgcggttggcgcggttaagggcgagcggcgacggcggcgcgggtgtgtttagtatttggtcgataatcggtttaagatta

SEQ ID NO: 4977 - DNA, 303 bp, synthetic construct
  misc_feature 1..303: note = Description of Artificial Sequence: Synthetic polynucleotide
  source 1..303: mol_type = other DNA
cggggtagtcggggtcgggagagcgggcgtagcgcggcggggatcggagtcgcgggcgtcgggaaaggttttcgttaggaggggagggaatttcgggagcgcgagttagggggaggcgcgtcggaaagcgagagtgataagtagtttataagtcgaaaagtttttcgcgggaggcgcgcgtcgcgtgggtttcgatttagtcgttgcgcgtcgtcgtggtatataggttgaaaagtttgcgaagttatagaagttaggttcggcgtttagggggttttgattttgtttttatggttttagatt

SEQ ID NO: 4978 - DNA, 286 bp, synthetic construct
  misc_feature 1..286: note = Description of Artificial Sequence: Synthetic polynucleotide
  source 1..286: mol_type = other DNA
cgcggaggttggttttggtagtggttagggagtggagaaagtaaattagagtcggttcggttatcgattttgcgaagttttttcgattttagtttagcgcgggagggtggcggaaggtggtgtatcgtagcgtggttttcgtcgttgtcgtcgcggttttgtaaagtgttagcgggggcgaaagcgagagtttaaaggaataggaggtttattgaattttttatcggagtttttaggggttttggttttttagtttgtttttgtttttttagttcggggatttgtt

SEQ ID NO: 4979 - DNA, 261 bp, synthetic construct
  misc_feature 1..261: note = Description of Artificial Sequence: Synthetic polynucleotide
  source 1..261: mol_type = other DNA
gggaatcgagaagaggaagaagcgaacgcgagtaggagcgtagcgtttttcggatttttgaggttttttttgtaatttgttatattcgtagtttttattcgatattgaataataatcgcggggaggagaggttatttgtagtcgaggttcgtaaattgtcggttttattcgggtagcgttaattcggtgttcgcggacggtgattttcgagttttagcgatgcgttttattgggtttaaaatagatttaattttatagtta

SEQ ID NO: 4980 - DNA, 201 bp, synthetic construct
  misc_feature 1..201: note = Description of Artificial Sequence: Synthetic polynucleotide
  source 1..201: mol_type = other DNA
tattgaaaggtagaaatggggagtaggtatttagttcgcggtgggtagggttttaggaggtagttttcgttcggcgatagttttcggggcgtaatttttcgtaggacgcgtatttgttaggatagttattaagaggatgcggaggttgggggttttttcggggataaaattagggtattttaaggaattttttgcgcgttt

SEQ ID NO: 4981 - DNA, 201 bp, synthetic construct
  misc_feature 1..201: note = Description of Artificial Sequence: Synthetic polynucleotide
  source 1..201: mol_type = other DNA
gttggattgggtgcggttgtatttgtggagtgggtggttcggtgattgttattcgggttagtgttgttagtagatgtgtatattttgggcgggggttggcggtcgagtgttattagtaggggcggcggttaggtagttattcgtcgttttttaagttcggcgttgcgcgtagggtttggagtattcggtgttgagacgcga

SEQ ID NO: 4982 - DNA, 201 bp, synthetic construct
  misc_feature 1..201: note = Description of Artificial Sequence: Synthetic polynucleotide
  source 1..201: mol_type = other DNA
taagttgttttttgttttgggtttttgatatttttatagtttttgaaagggttttcggagattttagagagaggcgggtgtcgaggggttacgagttcgcggttgatattcgcgttgcggaagagaatggtattgattgagggttttggggatttgggttttggcgttttggattttaggattatgtatttttcggggcgc

SEQ ID NO: 4983 - DNA, 201 bp, synthetic construct
  misc_feature 1..201: note = Description of Artificial Sequence: Synthetic polynucleotide
  source 1..201: mol_type = other DNA
cgttcggttcgcgggttttaattttatcgtcgtcggtcgaattttgttcgttcgcggcgcgtatagtcggcgttcgcgtatacgcgcgtataaattttacgtaattcgcggtcgtttcgtttcgtcgtcgtcgtagttcgtttgtcgcgcgtttatagttcggttcgagtcgcggggttcgagcgatagcgacggcgtcgg

SEQ ID NO: 4984 - DNA, 201 bp, synthetic construct
  misc_feature 1..201: note = Description of Artificial Sequence: Synthetic polynucleotide
  source 1..201: mol_type = other DNA
cgttcggcgtagagtcgcggtttttttgtttgcgttcgtagtttgcgtcgttcgatatagtgggggtggaggtagttcgtttagttgggcgttttggtgcggtgtcgcgtttaaagttttatttttgcgtcgagggtttgtgatttgtagagagcgatcgtttgattttaagttggttgtagagcgaggttagtcgggata

SEQ ID NO: 4985 - DNA, 201 bp, synthetic construct
  misc_feature 1..201: note = Description of Artificial Sequence: Synthetic polynucleotide
  source 1..201: mol_type = other DNA
tttcgaggtgagtcgtcgttgcgtttatttgttttcgtagttggattgtggagtcgcgttcggaggagcgttggatacggatatttttaatttttttttcgatttcgttttttggttttttgtatatatattttcgttaggaggggaggggaaggtttagtaattgtttggtttggttttgatttatcggttttttcgtag

SEQ ID NO: 4986 - DNA, 201 bp, synthetic construct
  misc_feature 1..201: note = Description of Artificial Sequence: Synthetic polynucleotide
  source 1..201: mol_type = other DNA
gcgtcgtttacgttattcgttatttcgggtcgcggtttcggttcgggtttagtggttgcgtcgtttttcgttagtaacgttcgcgcggaatgagcgcgtcgcgttgttcgcgtttttattcgtagggttcggcgtttttttttcgttcgtcgtttttatagtcgcgcgtttattggttcggttagtttacggggagtcgcg

SEQ ID NO: 4987 - DNA, 201 bp, synthetic construct
  misc_feature 1..201: note = Description of Artificial Sequence: Synthetic polynucleotide
  source 1..201: mol_type = other DNA
gcggaatttcgcggtcgagagtcggtcggtttagttgggcggggatacggcggtttcgggtttgtgttttagttttagtcgggttttttcgcgtcgttgcggttgttgcgcggtgcggtcgtgataagttatagtaaatttgtttttcgcgtcgttttaagttattaggaagcgtaatcggtgtttttggggatcggcgaa

SEQ ID NO: 4988 - DNA, 344 bp, synthetic construct
  misc_feature 1..344: note = Description of Artificial Sequence: Synthetic polynucleotide
  source 1..344: mol_type = other DNA
ttttgattagatgaacggagtggtcggaggtaagtcgcgtgttttcgtaggttcggatttgcgcggttcggaggtggtggatggggtgtagtgggtgtgcgggaatcgtaggagaggattggggttttaggtggacggtgttgattgtattggttttgaagattggaagtgggtgtaggaggaatttgcgatagttgagattagggcgcgcgggtagatgcgttaggtcgttagtaaatcggcgtgcgtgcgtttcggcgcgtttagtttcgggcgagcgtagggatgggggtggaagaggcgttttttcgggtttcgaggtttgcgtaggttttttggtcggt

SEQ ID NO: 4989 - DNA, 201 bp, synthetic construct
  misc_feature 1..201: note = Description of Artificial Sequence: Synthetic polynucleotide
  source 1..201: mol_type = other DNA
ggcgtttgttcgaggcgggagtcgttgggttatgtttttgtttattaggtttttcgaatttttggtagggtagcgtttgttcgtgttttcgatttttttcgtaggtaattcgcgcgaatttggggttcgtagagagcgagcgttcgcggatatcggttgaatagtttggaggttgcgcgagggggcgtcgcggggagggat

SEQ ID NO: 4990 - DNA, 218 bp, synthetic construct
  misc_feature 1..218: note = Description of Artificial Sequence: Synthetic polynucleotide
  source 1..218: mol_type = other DNA
cgggtgtcgtggtgcggggtggggatagttaatttagcggggacggaggaagttgggggtagttgggtgcgtgttttgtatcgtttatttgtcggggttcggtttttggcggtgggcgagagggagtatattcgtttatattttaggaatttgttggggagatgagttcgtggggttagaaagaagggaaaaattttttgggtaagggagagaataat

SEQ ID NO: 4991 - DNA, 234 bp, synthetic construct
  misc_feature 1..234: note = Description of Artificial Sequence: Synthetic polynucleotide
  source 1..234: mol_type = other DNA
cgttgttgttcgttatcgtcgtcgtcgttcggttatcgtatcgtatatattaattatttatcgttcgtttttagtttttcgggcgaagttaattataggcggaggtttcgttaatggggtcgtcgtcgtcgtcgtcgaggaggtagttagtcgcgcgttcgggcgtaagcgatagttttttagggacggggatgggtcgggggcgcgcggggggcgggggcgtacggggcgcgt

SEQ ID NO: 4992 - DNA, 201 bp, synthetic construct
  misc_feature 1..201: note = Description of Artificial Sequence: Synthetic polynucleotide
  source 1..201: mol_type = other DNA
tgaggcggagagaggtcgtttcgcgtttggggttttcgaaagcggttagttgtttttttgttttttttgagcggggagcgttgcgttttttgcgggttgcgggagatttttttagattttcgggtgggaaaattatattgagcgtttcgggaggttgttagatataatattgtatttggtatttttgttcgggtgttttcg

SEQ ID NO: 4993 - DNA, 201 bp, synthetic construct
  misc_feature 1..201: note = Description of Artificial Sequence: Synthetic polynucleotide
  source 1..201: mol_type = other DNA
agttagggtcgggggcgtacgtcggaatatttgggtcgtcgggtatcgagcgtcggggggttgcgcggcgcgtatttggagagggcgtagttatgcgggcggcggcggcgggggggggcgtgcggacggtcgcgttggcgttgttgttgggggcgttgtattgggcgtcggcgcgttgcgaggagtacgattattatggtt

SEQ ID NO: 4994 - DNA, 235 bp, synthetic construct
  misc_feature 1..235: note = Description of Artificial Sequence: Synthetic polynucleotide
  source 1..235: mol_type = other DNA
gtaggggtgttttgttcgtacgtatttacgatagtgagtagtatgttgtttagtagtagcgttaggaatacgatgaataggatgagttttcgcgagcggcggtttttttgtagttagcggattagcgttagttcgtttagggttatggtttcggggtttcgttgcgggcgcggtgcgcggtgaggatttaaggcggtcgtggattttttattttttcgttttttaggtcgcggaa

SEQ ID NO: 4995 - DNA, 201 bp, synthetic construct
  misc_feature 1..201: note = Description of Artificial Sequence: Synthetic polynucleotide
  source 1..201: mol_type = other DNA
ttttttaatagggcgcgttggttcgcgagtcggaggaattttcgtttaggttttgttaagcgtttattcggagtaggtcgggggtagtgaaggatgcggcgggagcggcgcgttgtagtttcgcgacgtggtacgtattttggaagcgatgatttagatatcggtagcggtggatgagttaggggtagaaggtggacggat

SEQ ID NO: 4996 - DNA, 241 bp, synthetic construct
  misc_feature 1..241: note = Description of Artificial Sequence: Synthetic polynucleotide
  source 1..241: mol_type = other DNA
agttttcggttcgaggttgcgttaattcggcgtcggatgttaatgatgaaattaaaatgttatttaagttaaatgcggggagtatacggcgattgggcgcgtataatggtaaatgggattaggtaggcgaaggtttagtcgagtttcggtttcgtagtcgttttcgttatcgtttttttttcgttttttttcggattttggcgttttggtttcgggttataagagttcgttcgttattggt

SEQ ID NO: 4997 - DNA, 201 bp, synthetic construct
  misc_feature 1..201: note = Description of Artificial Sequence: Synthetic polynucleotide
  source 1..201: mol_type = other DNA
gacgatttgggtgatttgggtggaaggtggtgtagtaggtaggtagtggggaggggcggggaggaaatttagggggagggggcgtcgaggttggtgaggcgtttttttcgcgttagggatatgtaggtatcggatggttgcgtaggggtttttgttcgtttggttttgggtgcgttcgtttagtttcggtgtaaatgtttt

SEQ ID NO: 4998 - DNA, 201 bp, synthetic construct
  misc_feature 1..201: note = Description of Artificial Sequence: Synthetic polynucleotide
  source 1..201: mol_type = other DNA
tcgtttcgatttattaggcgcgtagggttcgttttcgaaattcgcgcgggttttcgtagtcggtcgcgcggtttttagtcgcgaagagagcgtcgcgtacggtggcgtcgttatagtcgtgggtcgtcgcgtttaggtagcgttttagttgttcgtaaagtttttgtagcgtcgtttcgtcggggtttacgcgcgtcggtt

SEQ ID NO: 4999 - DNA, 217 bp, synthetic construct
  misc_feature 1..217: note = Description of Artificial Sequence: Synthetic polynucleotide
  source 1..217: mol_type = other DNA
ttaaggttggtttgtgttagaacggcgcgcgcgcgcgtacgtacgtatatatacggggggaaatttttttaaaaatgaaaggttagaagagtttagcggcggcgcgggcgttgcgcgagggtttcggagttgattcgtcgaggtaggaaattttttcggtcgcgacgttcggtttcggttcggcgttcgcgtgggatggtgtagcgttcgtcgtcgg

SEQ ID NO: 5000 - DNA, 201 bp, synthetic construct
  misc_feature 1..201: note = Description of Artificial Sequence: Synthetic polynucleotide
  source 1..201: mol_type = other DNA
ttatattgcgtaagagatcgtaatgaagttcgtagatttttaggttggagtcgtagagcgaggtggcgaggtggagaacgcggggttgggtttggatagcggttttggggtcgtttggagttttcgtttttttaattcggaaggtagcggattgatatttgcgtcgaagtcgcgcgtattttacggagggtcgggattttg

SEQ ID NO: 5001 - DNA, 201 bp, synthetic construct
  misc_feature 1..201: note = Description of Artificial Sequence: Synthetic polynucleotide
  source 1..201: mol_type = other DNA
gaggggtggttttgttttatttagggggtgtcgtgggtaaaggttttggggttatttgtttggtgttttggagggcgtagggtaggagtcgtcgaggttcgcgggttattgtggggcgcggaattttagattaggtattcgcggtttaattttcgggttaggggattcgcgggggttttacgaatttgtttggtttatttg

SEQ ID NO: 5002 - DNA, 201 bp, synthetic construct
  misc_feature 1..201: note = Description of Artificial Sequence: Synthetic polynucleotide
  source 1..201: mol_type = other DNA
attcggggtcggaggtaggcgcgtaattatggggatcggggcgggcgatggcggcgggcgggtttttgtcgtagggtggggatggtttttttagtcgggcggtcgtcgttatattgtagagcgtatttaaagagatatttcgtttcgcgttcgttttttagtattagattttcgttcgaaaacgtcgtcgggcggattgta

SEQ ID NO: 5003 - DNA, 317 bp, synthetic construct
  misc_feature 1..317: note = Description of Artificial Sequence: Synthetic polynucleotide
  source 1..317: mol_type = other DNA
tatcgttcgggttttcgtttggttatagtattaggttatagtgcgttggtttttgattatttttttggttcggtggtcgtttttcgtttttttttagttcgcgtcgttgttttgttttaggtttcggtgcggttttaagttttagtttagggtttttaggtttttttaggcggcggtggcggtatttatttgggtcgcggagtcggggtttggtacggtttcgtaggtggtaaatgaaattttggtagttgtcgtgttttagggttttacgggtatagagttcggttagtagttgtagcgtttggtgatagagcgcg

SEQ ID NO: 5004 - DNA, 221 bp, synthetic construct
  misc_feature 1..221: note = Description of Artificial Sequence: Synthetic polynucleotide
  source 1..221: mol_type = other DNA
atttatagcgacgggtaattacgcgggaggagtaggttaattttcgatagtggaggtgaagatgcgtgcgtttcgcgtattttgtttttcgcgcgacgtcgttcgcgtcgttcgcggttcggtcgggagcggtagttcgtgtttcggtttcggtttcggtttcggttggcgtttgtatttgcgattatcgtgagtagttatggcgtattttatagtgtaga

SEQ ID NO: 5005 - DNA, 201 bp, synthetic construct
  misc_feature 1..201: note = Description of Artificial Sequence: Synthetic polynucleotide
  source 1..201: mol_type = other DNA
gtgggcggttattatttttttagagtatttggtatatcgggttggggttcgtattcgtagggtattgcggggcggcgttcggtgattgggtggggtcgtcgttgttttttttttcgttgggggcggtagttttttgtttgcgcggaggcgatttagaaggtacgttcgttagtaggagggcgggcgtcgtagggttttcgg

SEQ ID NO: 5006 - DNA, 201 bp, synthetic construct
  misc_feature 1..201: note = Description of Artificial Sequence: Synthetic polynucleotide
  source 1..201: mol_type = other DNA
gttttttcgaaacggagatttgttatttttttagagggcggggaagtttatattattttttgttttatagtgttcgtttcgtttcgtttgttggtttttcgtttattcgagatattttaggtacggttcgtattggagagggtcgcgttgttgttgcgatcgtacggcgttcggggtaggaatatgttcgtttttttttgc

SEQ ID NO: 5007 - DNA, 201 bp, synthetic construct
  misc_feature 1..201: note = Description of Artificial Sequence: Synthetic polynucleotide
  source 1..201: mol_type = other DNA
atcgaagttaggtggaagtaaatgagtttggattttgaggcgcgtttggtttggagtcgttaaatttgttagcgggcggcgggggaggtggttcggtagcgtcgggtgttgcgttcgtatatgcgttcgggaaggtagtttcggtcgtttcgtttttagttcgttttttatcgttggcgcggcggcggcggcgtggggttc

SEQ ID NO: 5008 - DNA, 201 bp, synthetic construct
  misc_feature 1..201: note = Description of Artificial Sequence: Synthetic polynucleotide
  source 1..201: mol_type = other DNA
tgcgttttttttttgttatttcgatgttgggagtggcgttttggttttggcgttttttgggtaagtattagtcggcggtatttgcggaggtggttggtacgttgttattttttgaaatgagtgaggagggaggtttagatttaggcggttttacgcgttcgttttggtattagtagattgggaattgtcgtggttatgttc

SEQ ID NO: 5009 - DNA, 230 bp, synthetic construct
  misc_feature 1..230: note = Description of Artificial Sequence: Synthetic polynucleotide
  source 1..230: mol_type = other DNA
tttttcggttgtagaacgtttttcgttgtcggagaaggggtttagtaaaattgatttttttttatttgtttttatttataattgatggggagatgagaacgtaatatattttagtatcgagtttttgtcgtttggcggagattttgtttaagacgttttcgtaaagtatttttagtcggggaataaagtacggaaagttgttgggtagagcggtcgggaggagatatcgg

SEQ ID NO: 5010 - DNA, 201 bp, synthetic construct
  misc_feature 1..201: note = Description of Artificial Sequence: Synthetic polynucleotide
  source 1..201: mol_type = other DNA
gatagtggtagaggcgatcgtttttttttttattatttatattttagttttagatttttttttttttttttcggtgatattaagttttagatcggcggtcgtatttggttttatagtgtaaaatgtgtttggcgaggaagtcgaggcggcgttgtagtagttgagcgtgggggtttgtaagggcggttagttcggggaagc

SEQ ID NO: 5011 - DNA, 201 bp, synthetic construct
  misc_feature 1..201: note = Description of Artificial Sequence: Synthetic polynucleotide
  source 1..201: mol_type = other DNA
cgaaggttatcggttgcgttttgaagcgagattggcgcggtcgtcgtagtcggtttcggtttttgggtagtttggcgggtcgtacgggttgcgggaattcgtcggttaggtatacgaagtgcggtattatcgtttggtaattggagtagatgtttattagttcgtcgggtttggcggttatggcgttttcggcgtttgcgg

SEQ ID NO: 5012 - DNA, 201 bp, synthetic construct
  misc_feature 1..201: note = Description of Artificial Sequence: Synthetic polynucleotide
  source 1..201: mol_type = other DNA
tgttgttgttgttgttgttggcgttggcggcgcgcgcggacggtttggagttcggcggcggtttcgggtagtgggttcgttacgcgcgttgggcgggcgcggcgagtagcggcgagtttagttttagtttgcgtattaacgttacgcgcgcgttgttgttttatttggacgacggcggcgattgcgattttttggagttgt

SEQ ID NO: 5013 - DNA, 201 bp, synthetic construct
  misc_feature 1..201: note = Description of Artificial Sequence: Synthetic polynucleotide
  source 1..201: mol_type = other DNA
agtttcgagtcgttagtttttaggtttgggggtcgtcgttttcggagttgttggcgtttattcgtttcgcgttggagatgtttaatcgcggtcgggttgcggggacgcgggtcgtgttgggttttgtgcgcggtcgcgttcgtcgggtgaggacgcgtcgggggcgggggcgttaggttcgggtttaagggataggagttt

SEQ ID NO: 5014 - DNA, 201 bp, synthetic construct
  misc_feature 1..201: note = Description of Artificial Sequence: Synthetic polynucleotide
  source 1..201: mol_type = other DNA
ttttgacgcggggttggggacgtagatatttttggtttcggtagtttagcgtaatttttgaggtcgggcgtcgtttttcgtttttagaaattcgggtttcgagcgtcgaattttagcgttttcgttcgtgggtatagggcgcgcggtgtagttatagggggttcgagatacgcgtttcggtttggtttaggttggggaatc

SEQ ID NO: 5015 - DNA, 201 bp, synthetic construct
  misc_feature 1..201: note = Description of Artificial Sequence: Synthetic polynucleotide
  source 1..201: mol_type = other DNA
cggcgattatttgttgggtattaagcggttgcggcggttttattgtaacgtgggtatcggtttttatttttaggcgtttttcgacggtcgtatcggcggcgcgtacgcggatattcgcgatagtgagtggcgcggttaggcgcgaaggggcgggggcggggggtaacggtcgtcgggttaattcgtttagttatattttga

SEQ ID NO: 5016 - DNA, 201 bp, synthetic construct
  misc_feature 1..201: note = Description of Artificial Sequence: Synthetic polynucleotide
  source 1..201: mol_type = other DNA
gttgtattaagttataattttatttatatggtgtgagaattttttgggttttttttttttagtaagatttggtattttttgatatttattagtttaatgcgtgggaaatggtgtttttttttaatttgtattttttttgatttatagaaagttgtttttagtttcggtttatcgattatttagttttttattttttgaatg

SEQ ID NO: 5017 - DNA, 201 bp, synthetic construct
  misc_feature 1..201: note = Description of Artificial Sequence: Synthetic polynucleotide
  source 1..201: mol_type = other DNA
gttttttcggtattcgtagtttcgatagtttagttttttttatttgaaagttttatttgaggttttttttaattttgtttttttgtatttttggcgtcgcggggagttaggggttaaatttcgtggttcgcgtggtttttttttttttcgtagttttttcgtttttattcggcgtcgcgtttggagcgttcgtttcggaga

SEQ ID NO: 5018 - DNA, 201 bp, synthetic construct
  misc_feature 1..201: note = Description of Artificial Sequence: Synthetic polynucleotide
  source 1..201: mol_type = other DNA
tttcgggggtgtcgagtcggcggggggtgaggtggttgcgtcggcggtcgggttaggaggtgcgggtattgggggcgcgggaggggacgtggtaggtttcgcgggggttacggcgattttaggggttaggaaggtttcgttgcgggtacgtaatttgttttcgtttttttttacggagtcgtttcgggtaggcggcggcgg

SEQ ID NO: 5019 - DNA, 268 bp, synthetic construct
  misc_feature 1..268: note = Description of Artificial Sequence: Synthetic polynucleotide
  source 1..268: mol_type = other DNA
agttggcgttggataagtcgggtaagtcgaagcggaaggtgaattatcgtaagtatttgtagaagtagattaagcgttgtagcggttttatgggcgtcgcgtttttcggttcgtttttttcgagcgtcgtcgatacgttagttaaacggtcgttggtcgtttttagcgtttcgatagtcgcggtttcggtttacggtaaggttgtttttcggcgggaggcgtcgtaggtcgtcgcggtcgttagtttgtaaagtcgaagtttggtcgc

SEQ ID NO: 5020 - DNA, 614 bp, synthetic construct
  misc_feature 1..614: note = Description of Artificial Sequence: Synthetic polynucleotide
  source 1..614: mol_type = other DNA
atcggtcggggttgttgtcgtcgggggtttgggttttttagttagttgtggattaaacggtttttttttatttaaattaattgcgttacgcgtaggcggcgtacgggttgggtttgggaatggggatcgcgaggttttagtatttcgatgttttgaaagttttttcgtttcggggatttgtttttgtgttgtagttggtaggggtcgtttgaagtgggagtagcgtttggagaaggcgggaggagttcggttcgggggacgggcggcgggatagcgggatttcggcggcgcggtgcgttttagggcgtagcggcggtcgtagatcgagtttcgggcgcggtaagaggcggcgggagtcggtggcggttcggtattatgcgtcgagggcgtttgttggagatcgttttgggatttatcgtgtttttagcgttttatacgagttatggggcggacgttaatttggaggttgggaacgtgaaggaaattagagttagtcgggttaagagaagaggcggtggaggatacgacgcgtttaaagggtaaaggaatcggtttttttttttggtgtgggttttttaagttttaagatttagaataacgggtaggatgatttt

SEQ ID NO: 5021 - DNA, 201 bp, synthetic construct
  misc_feature 1..201: note = Description of Artificial Sequence: Synthetic polynucleotide
  source 1..201: mol_type = other DNA
agatgtattttagtttagcgatttttattggcggaattttcgcgtttatcgcgcgtcgcgttaagatggtttaggttatttttattgttttttcgttagcgttttttagttttttatatttgttttgtatatatattggtttgtagaggggattcgtttcgaatcgttcgggagtggggtttgagttcggagttggtgttt

SEQ ID NO: 5022 - DNA, 201 bp, synthetic construct
  misc_feature 1..201: note = Description of Artificial Sequence: Synthetic polynucleotide
  source 1..201: mol_type = other DNA
gttttgttttttttataagaggttaagtcgatattacgcgagtgtgtacgcgttggggattgagttttcgaagcgaagttttgtcggaggagttttaggcgggagtgggaacggttgggcgtggggttagtaacggcgttattcggtagggtggggggagttaggtttgttagagttagagcgcgttatcgtcgtcgcgag

SEQ ID NO: 5023 - DNA, 201 bp, synthetic construct
  misc_feature 1..201: note = Description of Artificial Sequence: Synthetic polynucleotide
  source 1..201: mol_type = other DNA
gtattgcggagtagcgaggtagcgcgtaagtaagttagggtaggggtcgggggtaggggcgggggttggagttatggttaggggtggttgtttaggtcgcgtgagttgttttttttattcgtatttggtcgttaggttattcggttattagaagtttttatttatattttgttttttatttggatcgtcggttggttgtaa

SEQ ID NO: 5024 - DNA, 201 bp, synthetic construct
  misc_feature 1..201: note = Description of Artificial Sequence: Synthetic polynucleotide
  source 1..201: mol_type = other DNA
ggggatcggtcgtagggcggggttttttttggcggtgagtgagcgagatcgttaggttgaagtatcgggagattgttttggtagtttttggtcgttattcgcgtcgtaataaaagtttttcgcggtttttcgtttagttagtttcgtattgattggtcgtcgtgggagggattcgagttggttggaggcggcggtcgagcg

SEQ ID NO: 5025 - DNA, 201 bp, synthetic construct
  misc_feature 1..201: note = Description of Artificial Sequence: Synthetic polynucleotide
  source 1..201: mol_type = other DNA
aagtttcggcgcgcggcgttcgttgggcggtgcgttttttttcggttttttatttatcgtagtcgagtcgggtattgtggggtgggtgtgcgtgtttgtcggggggtgtgtgtttgtgtcggggaggggtgttgttggggaattgttgtttttcgtattacggcggtagcgatagtatcgttcggtagttcgtagtattcg

SEQ ID NO: 5026 - DNA, 261 bp, synthetic construct
  misc_feature 1..261: note = Description of Artificial Sequence: Synthetic polynucleotide
  source 1..261: mol_type = other DNA
gcgttcggtttaagtacggtgcgagcgtttcggggaggcggcgagcgagtcggtgcggagcgtttcgtgcgttcgggtggtttcgcgggtcggcgggatcgtgcgtattttaagcgcgtgcgggagtgtgcgaggcgttgtgcgagttagcggcgggcgcgttagggtgggaaaggtatttcgaacgtattaggtgtagagatcggtatttatcgagagcggtcgggagcgtacggcgagtttcggtgttatcgtcggttt

SEQ ID NO: 5027 - DNA, 201 bp, synthetic construct
  misc_feature 1..201: note = Description of Artificial Sequence: Synthetic polynucleotide
  source 1..201: mol_type = other DNA
gtttgggttttaggttatcgtagaggacgtgttttcgggcgcgtagatggcgggagatgaggcggtcgaatttcgcgtttttgcgtggtggagtatatacgttttaataagtttagcgttatttgtttagttttttaatttttttttttttcgtttcggggcggtttttttttttttttgttttggttgttgttttggtcg

SEQ ID NO: 5028 - DNA, 201 bp, synthetic construct
  misc_feature 1..201: note = Description of Artificial Sequence: Synthetic polynucleotide
  source 1..201: mol_type = other DNA
ggtttacgtattgttcgtcggtttacgcgggagtttcgaggggcgaggcggaggttgggcgtagtttttgtagttagtagttattttcgcgcgtttcgtcgcggtttagttaattatttgttgcggcggcggtcgtgttttttagggtgtattagtattttcgtcgcgggcgttgttttcgcggcgtcggtatcgatgttc

SEQ ID NO: 5029 - DNA, 201 bp, synthetic construct
  misc_feature 1..201: note = Description of Artificial Sequence: Synthetic polynucleotide
  source 1..201: mol_type = other DNA
taggtagtttcgcgtggcggcggtcgggatagttgggcgcgttggtaggagagtaggtatagcgttttttataggtaggatgacgcgggtttcgtagttcgtttttttacgttgtttcgtattattgtttcggttttgacgtgcgtgcgatagatttatcgtaaatagtttttagcgggagtacgaggtcgggataggagg

SEQ ID NO: 5030 - DNA, 201 bp, synthetic construct
  misc_feature 1..201: note = Description of Artificial Sequence: Synthetic polynucleotide
  source 1..201: mol_type = other DNA
atatagttttaagggattgagcggttcggacgggatttgaaatttttggaggattagttacgttcgtatagttcgtttatgcgcgttggtattaggattcgtaggttgttagcggcgagttttcgtcgcggttttttagggtattttcggagaagggggcggttttgaggaattttttgtatttcggatgttttatttttt

SEQ ID NO: 5031 - DNA, 219 bp, synthetic construct
  misc_feature 1..219: note = Description of Artificial Sequence: Synthetic polynucleotide
  source 1..219: mol_type = other DNA
gtcgtcgttttttcgggagtcggagtcgtcgtttttttagtgggtgtagtcggggtttcgacgggggtcgggcggttatcggggttggagttgcggttacggaggtttttgcgtttgcgtcgcgtcgagggtagggatagggattggggtgaggggttgtttcggaacgtttatagttggcgttggtttttttttgtttgatagttttttggttcgggg

SEQ ID NO: 5032 - DNA, 268 bp, synthetic construct
  misc_feature 1..268: note = Description of Artificial Sequence: Synthetic polynucleotide
  source 1..268: mol_type = other DNA
ttagtcgtcggcgaggttattcgggaggggcgggagtcgtttgttagttattcggtagtttttttggggtttttttcgcgcgttcgtttgtttttttttcgttgcgttttttcgtttgttggcgtttttgttttagcgggattcggtagttaggggttttagggggcggtgtagtaaatttttagcggtttgcgtttagtagattaggttggggagtcggtttggcgttgtagggaggtagagagcgggaggaagaggtagtggtagg

SEQ ID NO: 5033 - DNA, 201 bp, synthetic construct
  misc_feature 1..201: note = Description of Artificial Sequence: Synthetic polynucleotide
  source 1..201: mol_type = other DNA
ggttgttttcgggcgtattttgcggttcgggtatttgtagggcgggtagcggtcggttttttattatgttggtcgtcggtatgggggtcgtcgtttttgcgttttttttgagtttttcgttagcggtttggttcgcgtttttttttggttgttttttattttcggtttcgcggtatattttttaattttggggtcgaagga

SEQ ID NO: 5034 - DNA, 517 bp, synthetic construct
  misc_feature 1..517: note = Description of Artificial Sequence: Synthetic polynucleotide
  source 1..517: mol_type = other DNA
tagcgtttattgtcggggaagattcggacgaaaatcgaggtaaattaattattaaaaagtgtatttaataagaatttttttatttaggtttttcgttgtcgagacgcggtagatttttagagcggtttatttatttatcgaagcggattttgggcggtttcgggttgattcgcgttgttagggcgcggattttatttcgggcgtattgttaggagaaggggtttttcggggcggcgcgtttcgattttgggttttcggtgttcgtagagggcggagattcgcggcgttttaggttatttattcgtattttttcgagttaaatttttagcgtttattcggattcgacggtttaagtattgatttttaggtaagagtcgttttttttggtttttagggaattgatattatcgcgggacgttttttttaggatagttagtaggttttaggagcgtagtacgtaatagcgtagagtagatttagatttttttcggggtgagattcggaggttcgcgttttg

SEQ ID NO: 5035 - DNA, 226 bp, synthetic construct
  misc_feature 1..226: note = Description of Artificial Sequence: Synthetic polynucleotide
  source 1..226: mol_type = other DNA
cgtcggggggttttgtttttcgggaggagaaggaatcggtcgttttcgtttttttttttttttaggcgttttcgggagggggtcgttgggcggcggaatcgcgttttcgttcggggagttattacgcggttttttcgcggaattttgacgttatttatacgtgggggaaggggttgggagagtaagaggaagcggcgggggagggggtcgcggttgggagagcgcg

SEQ ID NO: 5036 - DNA, 201 bp, synthetic construct
  misc_feature 1..201: note = Description of Artificial Sequence: Synthetic polynucleotide
  source 1..201: mol_type = other DNA
atttcggaggtagagatgagagcgttttaaaattttttttttttattttaattttcgaggagtaggtgggtgtatagtgtcggcggcggcggggacgcgcggcgcggagtttggttttgggaggtagtggtcgttttagtagtcgaatttttcgcggttttagttttcgcgtttagtagttcgcggttcgtttttcggaaa

SEQ ID NO: 5037 - DNA, 212 bp, synthetic construct
  misc_feature 1..212: note = Description of Artificial Sequence: Synthetic polynucleotide
  source 1..212: mol_type = other DNA
tgcgtagtggggcggaggaggtggcgatggtcgggggaggcggggggattgttgtttatttgtagttgggttaatttcgcggcgtaggcggcggcggagcgcggggagttcgcggcgggtttagttgtcgtagtattatgttcgagttttttttcgggtagacgtcgcgcgtcgtcggggtttcggtaggggaggatgttagacgttcggga

SEQ ID NO: 5038 - DNA, 388 bp, synthetic construct
  misc_feature 1..388: note = Description of Artificial Sequence: Synthetic polynucleotide
  source 1..388: mol_type = other DNA
ggtagtcgtagttttttcgcgcgttttttttttttttacgtttttcgttttcgttatggggttaacgtggggtttttaagagttgtcggtttttagcggcgtaatttttagttaaagttatcgcgggcggattatggtttagggcgttagaggggttagaggtacgggaagaggaaaagacggttaattgggaaaaaaagagaaaacgaaagaaaagttaaacgatgagtttttataaggaggacggagtgaatagtttgtgttagaaggttttgtatatcgttatcgagttgtgtttcgtcggttaggtggagtgggagaagtgttcgggtattttttttcgggataggggtagttagggcggaagtagtataggtaatcgggaggg

SEQ ID NO: 5039 - DNA, 201 bp, synthetic construct
  misc_feature 1..201: note = Description of Artificial Sequence: Synthetic polynucleotide
  source 1..201: mol_type = other DNA
tttttttttttttgttttttaagatacgcgttcgaaatcgaggggtgagagtaaagatcgtttattaatttagtattttggatttagagtttttaatttcgaaaggaggttggtattgttcgggttatcgagagagggagggagaagagttgaggttgtaacggtttttgggttttttagatcgggtttggtatttaggag

SEQ ID NO: 5040 - DNA, 201 bp, synthetic construct
  misc_feature 1..201: note = Description of Artificial Sequence: Synthetic polynucleotide
  source 1..201: mol_type = other DNA
ttattttttttggaagtttattagttgtttaagtgataattaatatcggagagttagggttcgtttaataggagtacgcggagatattttagacgatagcgcgttttttttatttttatttcgtttttcgggcgttttaggttagcgtttattagattttacgtttgggggattgtttgggttttagcgagagtgttacgg

SEQ ID NO: 5041 - DNA, 212 bp, synthetic construct
  misc_feature 1..212: note = Description of Artificial Sequence: Synthetic polynucleotide
  source 1..212: mol_type = other DNA
aggtgtagagatagtggagatgaggttttgatgttcggttttggttttacgcgggtagcgttagttggtcggtgttacggagttttcgcgtttttcgttcgtttagttttcgcggatttatttattggggttgtttcgtagcgcgatttttttttatttcgggggagggttaagggcggcggtggggggcggggtgggggggaagcggcggg

SEQ ID NO: 5042 - DNA, 250 bp, synthetic construct
  misc_feature 1..250: note = Description of Artificial Sequence: Synthetic polynucleotide
  source 1..250: mol_type = other DNA
tttttcgtgtttttcgtagggtaggttatagttttttagattttcgtttaggtggtaaagaagatggagttgggggtcgcgtttcggcggcgcggggttcgaaggcgaggtcgtttagttcgtattttattttacgtacggtatacgtcgtcgcggtttttgttacgtatattttcgcgttgtttcgtttacgtgggcgtcggggaggaggttcgagagatgggaagaaaggttggtatttatttttttg

SEQ ID NO: 5043 - DNA, 488 bp, synthetic construct
  misc_feature 1..488: note = Description of Artificial Sequence: Synthetic polynucleotide
  source 1..488: mol_type = other DNA
ttgtaaatattggaggaaagttgcgttgttttaattaaatacgtttttttaaaatacggagatgcggggagtgggggttcgggaaagaaatttttaaagcggtagtgtttttttaagaaggggtaaaaaaatttgtttatggttatttttttttcgttttattttttttttttttgatagtttcggttttggttgttcgagtcgggggtgtgttttcggttttttttagatttgggcggggggcgggaggagtgagcgatttgggaagtttcgggggtggagagggggcgtttcggggtttgggggcgacgtggatattttttttggagtacggcggtgcgtttgggatttgaaggaagggtcgaaggaagcggggtgcgggcgggcgagttgttcgttaagttgtttggcgggcgcggcgaggggagatgcgtaagtttgtagatcgggggttcggagttcggcgtttaggttggcggggggcgtgt

SEQ ID NO: 5044 - DNA, 201 bp, synthetic construct
  misc_feature 1..201: note = Description of Artificial Sequence: Synthetic polynucleotide
  source 1..201: mol_type = other DNA
gtagagttgtagtttttgcggttttttttttttcgttgtttagtcgagttttgggtttttagtttaagtttttcgtatcgtcgttgttgttgtcgttatcgtcgtcgtcgtcgcgcgttgttagagtcgttttttcgtttttttttttttttttcggtcgggtttttttttttttttgtttttttttttttttttttagtt

SEQ ID NO: 5045 - DNA, 364 bp, synthetic construct
  misc_feature 1..364: note = Description of Artificial Sequence: Synthetic polynucleotide
  source 1..364: mol_type = other DNA
attgcgtatgtgggtttggggtttgcgcgtatcggaggttgtaggcgttggggagggtgtggggggttgtgcgtggggttgtttttatcggaagttgtacgttttgggaagcgtagaggcgggggtgttgttcgcgttggggagtacgtgaggggatatttagggattgttcgcgcgaatggtttttaacgtatgcgttttattttatattttatagtcgttatgacgatcgggaggttcgtaacggttgcggggataagttcgttgaggttgttaggcgagttaggtttttttggatttcgtttgattcggttgggttgtgtttgaaattgatttagttttattatattttttgattatgaga

SEQ ID NO: 5046 - DNA, 220 bp, synthetic construct
  misc_feature 1..220: note = Description of Artificial Sequence: Synthetic polynucleotide
  source 1..220: mol_type = other DNA
gtgtaattttttggttaaaatgttatagttaagattaaattcgaagaaaagaatgaaattacgggaagttttttagatagtcgtcgtaaggttatgggtcgaagtggtgtaggggcggcgttcggggaagcgattggtagagttgtgcgtattgggggtgttgtaggcgttggggagagtgtggagaggttgcgtggagttgcgcgttcggggtgggggt

SEQ ID NO: 5047 - DNA, 201 bp, synthetic construct
  misc_feature 1..201: note = Description of Artificial Sequence: Synthetic polynucleotide
  source 1..201: mol_type = other DNA
gcggttgagttcgcggagttgggtgagtgtttgcggttgatcggttcgtgggagtagggagcgtatagtcggttggtgttggagggttacggggatttacggggtatcgcgggagtcgtcgagcgtagggaagttagtaggtatttgtagtgcggagtttgtaaggttgaggtaggagatcgttcgaggcggggagggcgg

SEQ ID NO: 5048 - DNA, 201 bp, synthetic construct
  misc_feature 1..201: note = Description of Artificial Sequence: Synthetic polynucleotide
  source 1..201: mol_type = other DNA
tttgagggttcgggtagttattcgtattttttcgttacgcggagaaagtcgagtatataggtcgtagggtgggggttcgcggggagagggtggaagtagcgggtttttcgcgtttggggtggtcgttgttttatttaggttttcgtttgttttttatttttttagattaatcgttttttgtaggtgttaacgcggtgtttc

SEQ ID NO: 5049 - DNA, 201 bp, synthetic construct
  misc_feature 1..201: note = Description of Artificial Sequence: Synthetic polynucleotide
  source 1..201: mol_type = other DNA
gttttagtttttatttgtttaggtgttttcggcgttttggcgaattcggttattttagttttttacgtggtgagtatttagggtagcgggtcgatttttcgaggttttatatttgggtttgaggggcgcggttcgtagcggcgggtgtaggggcgattgttagtttttatttcgtttcggggtgcgttcggaggtcgatat

SEQ ID NO: 5050 - DNA, 358 bp, synthetic construct
  misc_feature 1..358: note = Description of Artificial Sequence: Synthetic polynucleotide
  source 1..358: mol_type = other DNA
atttagggttattgtagtttcggggtatttcggaggttacgattcgcgagtagatgtttcggaagaggttttttatgtaggttgttaggtagatggcggcgtgttcgtggatgcgtagcgttacgcggttgtttattatttagcgatatacgcggtttacggagaaggtgaggtcgtagcgggtcgatttgtcgcggtttaggcggtcgtcgtcggcgttgtttatgttgtagagggatagtgcggttagcgtagtcgtcgtatagtgcgcggttaggttttaggatagtacgatttttatggcgttttggatttcgtatttggtgtatttggcgaagcgtaggtttaggcgttgcgt

SEQ ID NO: 5051 - DNA, 201 bp, synthetic construct
  misc_feature 1..201: note = Description of Artificial Sequence: Synthetic polynucleotide
  source 1..201: mol_type = other DNA
agcgtttttttatggtcgcggtagttaatcgatgattgaatcgaataaagagtagcggcgagattaatttttaatatttatcgatgggtagcgggcggtcgagtttcggcgagtttcggtagtcgtcgttcgtcgttttagggcgttcgtttgttcgttcggggatttttttaatgcgtttagggcgcgttcgggggtttt

SEQ ID NO: 5052 - DNA, 328 bp, synthetic construct
  misc_feature 1..328: note = Description of Artificial Sequence: Synthetic polynucleotide
  source 1..328: mol_type = other DNA
ttttttagtttcgttggtttgggagtcgggagtttcggaggagtttttcgttaagtttttttggttacgagcgcgtttggttttggtttgggagtagatcgtgcgttcgagtggggtatttgttcgaggtcggggattgtgaatcgaaagattttatttagttttgttgtttttttggtattgcgatttgggggcgggttattttatttttttgaatttcgtttttcgttttgtttatggaaggttgtaagtttttttggggttcgggatttttttttatttttatttttcgagtagagaaataggcgatgttttttttttttttgcg

SEQ ID NO: 5053 - DNA, 201 bp, synthetic construct
  misc_feature 1..201: note = Description of Artificial Sequence: Synthetic polynucleotide
  source 1..201: mol_type = other DNA
gaggtgtgtgttggaggtgggtagtcgtcgcggaggttttagcggtaggtgcgttttagtaggtagtagtagtcgttattttgggtaagtagtaaatttcgtataaatttcggagttattatgtttgttttttcgttttatcgtcggtttttttgttaggagtagtagaggatgtggtgaatgtatcggttttatcgaacg

SEQ ID NO: 5054 - DNA, 319 bp, synthetic construct
  misc_feature 1..319: note = Description of Artificial Sequence: Synthetic polynucleotide
  source 1..319: mol_type = other DNA
gggcgtatatatacgtttatttagatatttcgcgcgttttttcgcgtttttgtttgttcgttcgtcgtcgtttgtttttttttttttgttttcgtcggtcgttttttttttttttttttttttttttttttttttttttttttttttttttttttggtattatagagttgttttgaaaatagaagatagagggagtttcggagttcgttatttttagcgatttttatattgggaaaaaatatggagttagtttcggtagttttcgatttcgtcgttagcgagttaggtagtagcggcgcggacgcggtcgtcggtttta

SEQ ID NO: 5055 - DNA, 201 bp, synthetic construct
  misc_feature 1..201: note = Description of Artificial Sequence: Synthetic polynucleotide
  source 1..201: mol_type = other DNA
ttaagtttaattttacgtttttttcggtgttcgattttgcggtcgaatcgtaattgcgagtcgtaggtaatggcggagtttttggtattgttagttgttcgcggttgggggttcgaggttgggagggtttcgttttcggaatatcgtttcggtttggtttttaattttgcgaggagtttttttgcgtttttttttcgcggt

SEQ ID NO: 5056 - DNA, 370 bp, synthetic construct
  misc_feature 1..370: note = Description of Artificial Sequence: Synthetic polynucleotide
  source 1..370: mol_type = other DNA
ttggattttcggggtgcgggtttttttttttgttttgttttttagtatttttggtaattgcgtaaagttgtttgggttgtaatggtggggtgtagggggcgttcggttgttgtatttgttagtgttgggtttaggttgagaggcgatttttagtttttataataatgtttcgggttttttggtttgggttttcgtagcgttcgattgatcgttagcgatacgacgagaacgaggatttgtcggacgtggaggagatcgttagcgttcgcggttttagtttggaggagaagtttcgtagttagttgtattagggggatttcgtgtacgttatggagggtaaaggtgaggcgtttttatttcgggtcgtttt

SEQ ID NO: 5057 - DNA, 201 bp, synthetic construct
  misc_feature 1..201: note = Description of Artificial Sequence: Synthetic polynucleotide
  source 1..201: mol_type = other DNA
ttttttcgttttaggcgtcgttaagttttagtattatgcgtttttttagatgttcgaaagcgtttttttagggtagtttatgtttttttgtgtttttttcgcgacgggtcgggtttattattttatatttttcgggtttttttatgtttattatcgtgtgtttttttagtatttttttttttttttaagttttaatatagt

SEQ ID NO: 5058 - DNA, 201 bp, synthetic construct
  misc_feature 1..201: note = Description of Artificial Sequence: Synthetic polynucleotide
  source 1..201: mol_type = other DNA
gttgggcgtaggggtcgtcgttcgaggattatgggtgggttagcgtttcgtcgggttgttagttggcggggatcgtcggcgtttgtgtcgggtcgcgttcgaggttgcgtcgttcgtgtcgtagcggttaatgcggtagtattcgcgaacgttatcgcggcgggtttcgttggttcgggttgcggcgtgggggcgggggat

SEQ ID NO: 5059 - DNA, 201 bp, synthetic construct
  misc_feature 1..201: note = Description of Artificial Sequence: Synthetic polynucleotide
  source 1..201: mol_type = other DNA
gtgtagcgacgtttagttttcgtgcggttagcgcgtcgcgtcggcggattttgtagtttagagagtttagggagtttagggaggggagcggggcgcgggcggggtagtgtcgtataatcgtaggcgcgtttcgcgtcgttttcgtttcgggtttattttttttcgtcgcgttttttttagtttatttacggacgagcggat

SEQ ID NO: 5060 - DNA, 263 bp, synthetic construct
  misc_feature 1..263: note = Description of Artificial Sequence: Synthetic polynucleotide
  source 1..263: mol_type = other DNA
gcgcggtttcgcggggattttgcgggcgggcgggcggtcgggcgcgcgcggggcgggggcggcgcgcgcgcggggagcgtgtgggtcgggcgggcgcggcggggaaagttgggcgcgcgagtcgaggttgttgtttatttgtagtcgcgtcgtttatttgtcgcggagtgcgcgtttcgcgttttttcggttcgtttcggagttcggtcgttttttttttgttatagcgggtaattgcgtcgatatgcgatacgagtagttta

SEQ ID NO: 5061 - DNA, 201 bp, synthetic construct
  misc_feature 1..201: note = Description of Artificial Sequence: Synthetic polynucleotide
  source 1..201: mol_type = other DNA
ggcgggagaggagtttcggtcgcgtggattttagtttgcgcggtaattatcgcgttttgattttaggttcggttgtttagggaaggatagtttagggcgcgtttagcgagttttagggggtacggaagtggttagggtagattttagggtgaataattaatattttatttattaattcgttaaaaataaagaaaataaaat

SEQ ID NO: 5062 - DNA, 201 bp, synthetic construct
  misc_feature 1..201: note = Description of Artificial Sequence: Synthetic polynucleotide
  source 1..201: mol_type = other DNA
tgtcggggtcgcgttttcgggttcgcgtcgttagtatttttttacgcgcgttcggtttcgggttattcgttttcgtcggttttcgttttttttcgtagtcgtagggaagcgagtttgggaggaagaagagggtaggtggggaggcggatgaggggtgggggattttttgacgttattagaaggaggtgtcggggtaggaag

SEQ ID NO: 5063 - DNA, 201 bp, synthetic construct
  misc_feature 1..201: note = Description of Artificial Sequence: Synthetic polynucleotide
  source 1..201: mol_type = other DNA
aggggttaggagcggcgggatagcgcgggaagagtaggtaaggggagatagtcggattgcgttttagtttttcgtgttaagaatatcgtcgcggaggcgcggttagttttttttggatcggatttttcgtttttagggttaggcggcggagttttagttttgttttttttttagtttcgggcggtttttagagttgagtaa

SEQ ID NO: 5064 - DNA, 201 bp, synthetic construct
  misc_feature 1..201: note = Description of Artificial Sequence: Synthetic polynucleotide
  source 1..201: mol_type = other DNA
cgggcgtcggcgtgaattcgcgtttttcggagtttagcgtcgtgtttttaggtttcggttttgattttagggcgtttaggtggaatggtttcgtagttgcgcgttgttttcgcgttttcgttttgtttcgcggaaatcgttttcgatagttaattcgatcgggcgcgcggcgttttcggtcggttttcgttcgatttcgcg

SEQ ID NO: 5065 - DNA, 215 bp, synthetic construct
  misc_feature 1..215: note = Description of Artificial Sequence: Synthetic polynucleotide
  source 1..215: mol_type = other DNA
gattttttcgcgtatacgtatatgtatacgttgcgcgtttttacgcgtatatatacgttttttttgtcgcgttcgtcgtcgcggttattatcgcggagtcgagttttgcggagcgggaatcgaggtcggagcggggatcggaggtagtcgagtcgggggatgtcggttcggagcggagtcgcgcgcggacggcgcgttcgggacggtgagtgtgg

SEQ ID NO: 5066 - DNA, 201 bp, synthetic construct
  misc_feature 1..201: note = Description of Artificial Sequence: Synthetic polynucleotide
  source 1..201: mol_type = other DNA
tcgcgtaatttttgaagtggtcggttagggcgcggttggtttagtcgtcgtaggcgttttgtaggcgttggggtaggttttagtggtatagggtgattacgggttgtacgtttagttttcgtagtcgttttagtaggcgtcggtagtagcgtagtttttcgcggttggggacgttcgcgttgttattggggagtattcgcg

SEQ ID NO: 5067 - DNA, 201 bp, synthetic construct
  misc_feature 1..201: note = Description of Artificial Sequence: Synthetic polynucleotide
  source 1..201: mol_type = other DNA
ggacgggagttgcggggagggcggtcgggggatttcgtagagttcgtttcgttcgtagtcgcggggcgtcgagggtagggcgggcgtttagtttggtttcgtcgtttcgttcgtagtttttcgaaaggcggtcgttttgttttggttagtttggttcgattcgggggcgttgcgtgcgggcggtttcggggttgttggtat

SEQ ID NO: 5068 - DNA, 201 bp, synthetic construct
  misc_feature 1..201: note = Description of Artificial Sequence: Synthetic polynucleotide
  source 1..201: mol_type = other DNA
aatttaatatttttttttttttttttggagttattttttttttcggaatatgtaagttttgggtggtttagttttgtcgttagatttagtttttaagtgcgggggaaggagatgggcgtttttagtcgcgattttttgggaaggtggttatttatttgcgttttgaaatagaagaatagggcgacgttgtagataatttgg

SEQ ID NO: 5069 - DNA, 217 bp, synthetic construct
  misc_feature 1..217: note = Description of Artificial Sequence: Synthetic polynucleotide
  source 1..217: mol_type = other DNA
attggttgaagtttttttagcgatttgtatgaatcgagagggagtgttttttgtcgttttttttttaagagcgttttgattgtagttttttagggaatgcgcggtcgagggaatgcgcgtagtttataggttttgggagtgagttggtgttcggcgatttggtattcgcgtttggatatggggcgtttatatcgttttaggagtagtattagttata

SEQ ID NO: 5070 - DNA, 317 bp, synthetic construct
  misc_feature 1..317: note = Description of Artificial Sequence: Synthetic polynucleotide
  source 1..317: mol_type = other DNA
agtaaaagtttttatttgtagtatcgggtatgttgttcgtttaacgcgtttcggggatttgttggttcgtgtttttaatttaggggtggttatacgtttcgcgtttttgtttttgggtagatttttttatttgtgtattttggtttttttatttagtaaagagatgtgcgaagtgtgcgtttggagacgagtcgtttcggtgatttttattcgttcgtagcggtggttttggtttttcggattcgcgttcgcgttttgcgggtttttcgcgtcgtttttgttcgtcggattattcgggtttagagggtcgttcgttt

SEQ ID NO: 5071 - DNA, 201 bp, synthetic construct
  misc_feature 1..201: note = Description of Artificial Sequence: Synthetic polynucleotide
  source 1..201: mol_type = other DNA
gaggggaggtacggagcgggaggagggggacgcggagaagattgtttggtttcgtcggtttcgttaacgtgacggttagtttcgtcgagcgttcgtattcgtttatatttatgattattcgtatattcgttttaatacgtgttaaggcgcgatcgcggggtttttggtagttttcgttgtatttttttttttataggggta

SEQ ID NO: 5072 - DNA, 201 bp, synthetic construct
  misc_feature 1..201: note = Description of Artificial Sequence: Synthetic polynucleotide
  source 1..201: mol_type = other DNA
tcgtttaatacggagacgcggagttttatagcggtggtagaaagtgagtattaatttagtaatagggggaaggaaggggacgtcgggcggttagtgggacgtgcggtagtcgagggttgtagtttgtttttgtagcgcgttcgcgtttatttgcgattttttggtaggggatgttcgttaggttgaattttttggtatcgt

SEQ ID NO: 5073 - DNA, 201 bp, synthetic construct
  misc_feature 1..201: note = Description of Artificial Sequence: Synthetic polynucleotide
  source 1..201: mol_type = other DNA
tagtcgggtcgagcgcgttgtttgagttgagtcgtcgtaggtgaggggttcgcgttttcgttcgttttgggcgtcgcgtttggtattgattttgtcggtcgtttattgtcgtcgtcgtcgtcgttcgcgggtattatgatagttttgagcgttggggttataggttggttatcgtcgtcggtgttcgggaggttgcggcgc

SEQ ID NO: 5074 - DNA, 201 bp, synthetic construct
  misc_feature 1..201: note = Description of Artificial Sequence: Synthetic polynucleotide
  source 1..201: mol_type = other DNA
agtgtgattgatgtatttattatttaataatttcggggtgaaatttgaggtgaacggttttatttttttatatttaggaatggaattagttttcggtatcgtgtatagtttgattttacgttcgtacgttgggttttcggttttttggtagtgtatttaagtgtatttcgcgtgtgttcggcggattttcgtgtatatcgt

SEQ ID NO: 5075 - DNA, 201 bp, synthetic construct
  misc_feature 1..201: note = Description of Artificial Sequence: Synthetic polynucleotide
  source 1..201: mol_type = other DNA
gcgtagttttatttcggatggtttttgttttttcgcgggttcgagggcgttggaaatttagcggcggcgaagcggagaggagtttcgcgcgttttcgttcgtacggttttaggtttggggtttgcgttggagtcgcgcggggagaggtcgtttttgcgatcgtcgcgttcgttttcgatcgttcgggttcgcggttagttc

SEQ ID NO: 5076 - DNA, 221 bp, synthetic construct
  misc_feature 1..221: note = Description of Artificial Sequence: Synthetic polynucleotide
  source 1..221: mol_type = other DNA
agtttaggtttgcgtttatacgcgcggcgtttatacgcgcggcgtttatttggttgtagtttcggttagggttagcgcgtcgcggttgaagggggcgttcggatttttttggggcggcgcgtagtcgggatagtttcgtatgacgttcgcgttttagcggtttcgggacgcggttttatttttaatttttggcggttttagtttcggtttttgtgtttcgg

SEQ ID NO: 5077 - DNA, 311 bp, synthetic construct
  misc_feature 1..311: note = Description of Artificial Sequence: Synthetic polynucleotide
  source 1..311: mol_type = other DNA
gtttcgtttcgtattcgtatatatttttttcgtcgttgttttgagcgtagcgataagggtttttatattttcgcggttcgtaatgtttcggggttaagtcgaggtagggaggcgttttcgtagtttttgattttataattcgcgcgcgtgtgtatcgagtcgcgggtatatcgcgaatatatatatatatatatatattcgtgcgttttcgtttttcgttcggttcgggtttttcgaatttattttcgaggcgtttcgggcgtagggttcgtttttttttgcgggtttttagcggttgttcggtagtggtt

SEQ ID NO: 5078 - DNA, 308 bp, synthetic construct
  misc_feature 1..308: note = Description of Artificial Sequence: Synthetic polynucleotide
  source 1..308: mol_type = other DNA
ggtggcgggtagtgtggtgatggtttttgaggaggtttgttcggagcgtatcgatttgatttataaaaattatcggaaattttgtaatttgttgatcgacgtggaggagtggggttaggtggttattattagtatgtttattcgttacgttcgtacgtagtttttgagttttatttagaacgtaagtgggtttagtttaggtagagcgggtcgaagtgtgtttcggggaggcgtttatagattcgtcggttttttcgtttaggaatttttattagaggagaacgcggaaaaagttttttacggtttag

SEQ ID NO: 5079 - DNA, 201 bp, synthetic construct
  misc_feature 1..201: note = Description of Artificial Sequence: Synthetic polynucleotide
  source 1..201: mol_type = other DNA
cgagaattttgcgggtttagaacgttcgcgcggacgttttttttacggcgtcggaagtcggcgtcgagtttgttatcgggtatttttttgttgttttgacgacggcgggcgttgtaagagtggagaagttgtaggtgttgaggcgcggtgaaagaaattttgggagttaagagtacgaggagttggtgtttgtgttatatt

SEQ ID NO: 5080 - DNA, 201 bp, synthetic construct
  misc_feature 1..201: note = Description of Artificial Sequence: Synthetic polynucleotide
  source 1..201: mol_type = other DNA
aggtgatttcggttttggcgaggcgcgattcggttatgcgtgtgtgtgttttttttcggagaggatttcggtcgtcgagggtacgcggggtttagttatcgttcgttttttaattagttgttggttcgtttcgatggtgtaaattgtttttttttgttttttattaaatagtaatagtttggttacgtttaagtggaataa

SEQ ID NO: 5081 - DNA, 201 bp, synthetic construct
  misc_feature 1..201: note = Description of Artificial Sequence: Synthetic polynucleotide
  source 1..201: mol_type = other DNA
gggatttggtgattttagtattattttttttttttttttttttttttttgtttttttatcgtttgttgtaattttgtaaagtttcggagtcggagagcgcgtttcgtttttagagttttcggattcggcgagttagcgatcgtcgagtcggttattatgttcggtagatcgcgttattaggcgtttttcgcggtttttatt

SEQ ID NO: 5082 - DNA, 630 bp, synthetic construct
  misc_feature 1..630: note = Description of Artificial Sequence: Synthetic polynucleotide
  source 1..630: mol_type = other DNA
agtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcgg

SEQ ID NO: 5083 - DNA, 201 bp, synthetic construct
  misc_feature 1..201: note = Description of Artificial Sequence: Synthetic polynucleotide
  source 1..201: mol_type = other DNA
gagggcggggcgggcggcggtcgcgtttttaatttcggcgttgcgtgtgggagcggtcggattagggaattagcgttgtaatttcggattagtaacgttcgttaaatgagtgtttaatttcgattttttatgttttttagcgtcgcggttgagttttaggaggttttttggttaggtttttttcgcgttttggttttattt

SEQ ID NO: 5084 - DNA, 239 bp, synthetic construct
  misc_feature 1..239: note = Description of Artificial Sequence: Synthetic polynucleotide
  source 1..239: mol_type = other DNA
ttcgtgaatttcgttcggggatattttatagtagtcgcgtttttatttttttttttttaaatcgtttcgggtttttgtcgtcgttattttttgttaaatcgtttttatttttttagcggagttatagcggggcgcggcgtatataaagggggtcggagggtggagagtatagaaggagggagagatttcgttagggttcgtggtacgggtttgggagtagttatttattcgattttttt

SEQ ID NO: 5085 - DNA, 201 bp, synthetic construct
  misc_feature 1..201: note = Description of Artificial Sequence: Synthetic polynucleotide
  source 1..201: mol_type = other DNA
gacgttagtcgcgcgggtttttcgagttcgcgtcgcgtttagggatttggttcgttttttgcgtttttatttttttattttttttagaaatatagtacgcgggttttttttatgtaggttattttttacggagttttaggttagttttggggcggtgaaacgaaggtgttaaggtatagtattttttcgggaggttggata

SEQ ID NO: 5086 - DNA, 221 bp, synthetic construct
  misc_feature 1..221: note = Description of Artificial Sequence: Synthetic polynucleotide
  source 1..221: mol_type = other DNA
tagttgttaatttcgcgcgcggagtttttcggcggtgtagtttcgtttcggcggcgcgggcggtatgaagattagtcgtcgcggtcgagcgtttttggtcgtggttttgaatttgttggcgttgttgttcgttattatcgttttttttattacgtattggtgttagggtacgtagcgggtttttaagtcgggttgcggttagggcgggcgcgttaattgtt

SEQ ID NO: 5087 - DNA, 201 bp, synthetic construct
  misc_feature 1..201: note = Description of Artificial Sequence: Synthetic polynucleotide
  source 1..201: mol_type = other DNA
gcggggaggggatggggtggcgggagaattgtttttttttttagttataaatttattaggtttttaaattttttttggattttttttttcgcgttttcgcgagttcgggatttaggggatggagaattcggggcggaggagcgtcgagttaggcgggagggaggtcgagtcgtgggcgggaggcggatcggcgtggggttg

SEQ ID NO: 5088 - DNA, 246 bp, synthetic construct
  misc_feature 1..246: note = Description of Artificial Sequence: Synthetic polynucleotide
  source 1..246: mol_type = other DNA
gtttcgggggtttttagttaagtatcgtttggtgttttcggtttagggtcgtgtgagtcggaggttgagtttacgtaaggtttttatttgtatagattacgagttggagaattatagtatgtattgcgtgtaatgtaagatgttcgtgtgttattagtgtttggaggagggtaaatattttagttacgaagttaaggttttgggggttatgtggaaattatataaggtgagttttaagaaaattta

SEQ ID NO: 5089 - DNA, 223 bp, synthetic construct
  misc_feature 1..223: note = Description of Artificial Sequence: Synthetic polynucleotide
  source 1..223: mol_type = other DNA
tcgattatgattatttggatttggataagatgagtttatatagcgaggcggatagcggttatggtttttacggggggttcgttagcgtttttattatttcgtgttagaagttttttaacggcgttcgcgtgtttttttcggttatgtcgttatcggttatttatttgttatcggttttggtttcggtgtttcgtaatttttgtattatttgtttttagtgtta

SEQ ID NO: 5090 - DNA, 201 bp, synthetic construct
  misc_feature 1..201: note = Description of Artificial Sequence: Synthetic polynucleotide
  source 1..201: mol_type = other DNA
ttagggtacggcgttagcggatttacggagaaggagaaaagttttattgtcgtgtagaagtttaggttcgggtgagacgtttgcgaaggttgttagtagcggaagagaaggggcgtttttcgtgttgcgtagtattcgttcgcggtaggtgggcgcggagtttagagttgggagttaaacgtaaacgttggcgagaagttt

SEQ ID NO: 5091 - DNA, 244 bp, synthetic construct
  misc_feature 1..244: note = Description of Artificial Sequence: Synthetic polynucleotide
  source 1..244: mol_type = other DNA
gtttcgttgttttagcggtcgttgttttagaaaagttaacgagaattagatgtggtggttattgtcgaatttttttagagtcggtgattggtttttagtcgagggttttagttaattagtttgttgggtgggtttggagtttcgtttcgtttaggcgttcgcggagatttaggttcgaggttggcgcggcgcggagagtgggttggaggtcggggcgggacgcgttgtgtagcgggtaagcgta

SEQ ID NO: 5092 - DNA, 201 bp, synthetic construct
  misc_feature 1..201: note = Description of Artificial Sequence: Synthetic polynucleotide
  source 1..201: mol_type = other DNA
tttgttcggttcgttgaaggttggttttgggtttgggggtagtgttcgcgaagggttgcgatggtaggtttcgttgttatacggtatcgagggttttttcgtttcggcgttaggcgtacgtttttttgttatatttttcgcggggcgcgtcgttagggttatttgtttttttaagtttcgttaggtagttaagggtgagga

SEQ ID NO: 5093 - DNA, 457 bp, synthetic construct
  misc_feature 1..457: note = Description of Artificial Sequence: Synthetic polynucleotide
  source 1..457: mol_type = other DNA
ttgagggaggggtcgggttttcgggtttgtagattcgttatcgcgcgtgcgtatgcgtcggtcgcgagttttcgggtgtaggtttgggcggtttcggttcgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcgggggaggtatgggttcgggtaggtttaggaggaagttgtatagttcgaggttcgggcgggagtggcgggtcgcgggtaagggaacgtatatttggaaggg

SEQ ID NO: 5094 - DNA, 244 bp, synthetic construct
  misc_feature 1..244: note = Description of Artificial Sequence: Synthetic polynucleotide
  source 1..244: mol_type = other DNA
gcgttttttttgcgcgcggcgaggtcgagacgtttttcgcggtgatagcgtgtaaggcggagattcggcgcgtttttagtttagggaaagtttaggcgacgcgatcgtaagttcgagtttaggtttttcggagtcgttagggcgcgtcgggttgtttgtttttttgtttttttttgtaggaatttttcgtcgttcgcggtcgggatttcgggtttttttcgggcgtagattttagttatcgttt

SEQ ID NO: 5095 - DNA, 206 bp, synthetic construct
  misc_feature 1..206: note = Description of Artificial Sequence: Synthetic polynucleotide
  source 1..206: mol_type = other DNA
gagcgtagcggcggggtatggaagaagagggttgggggcgcgcgttatttgtaaaggttttcgaggtttttttttagttttggtggtaatttcgtttagcgtcgcgtttttttttagatttaaatttttgttgggtttttcgggtggcggcggcggcgacggcggcggttgttggagttaagttttgtcgttcgtagcgtcggggc

SEQ ID NO: 5096 - DNA, 203 bp, synthetic construct
  misc_feature 1..203: note = Description of Artificial Sequence: Synthetic polynucleotide
  source 1..203: mol_type = other DNA
agagagatagtatgagaacgcgtagagttgtatttcgcgggggtcgggcgttagtagtatcgcgttgttttatttacggcgcgtttgtttttcgcgttgcgcgtttagcggggcgtcgagttttagaaattttagtatatggtcggttcggcggttacggtggtcgtagttgttttgtttttcgagcgttttttattgttttt

SEQ ID NO: 5097 - DNA, 266 bp, synthetic construct
  misc_feature 1..266: note = Description of Artificial Sequence: Synthetic polynucleotide
  source 1..266: mol_type = other DNA
cgtgattatttttcgttttattttcggggcggggttcgttagaaattttaagcgttcgtaatcgttttttttcgtgggcgggatggggaaattgaggttcgaggtcgtttcgttggttggtgtaagaattagtttgtaatttaagttttgagttgttggcgtttcgtttcgtgtagttgaatttaatttattcggggttgtgggtagcgtttttttggggttgatacgttatttcgagtttgaggattaagatcggagtgatttgg

SEQ ID NO: 5098 - DNA, 242 bp, synthetic construct
  misc_feature 1..242: note = Description of Artificial Sequence: Synthetic polynucleotide
  source 1..242: mol_type = other DNA
ttcgaatttttttaaatttggcggttcggggcgcgtgggggggacgtttcgttatttgcgcggttataaaggagagatttatggtgtcgttgtagttagcgttcgagttttcgttgttgtcgttgtcgttgcgggttagtcgtttgtatagttggcggggatcgggttgagtagcgagcgttcggagatcgtacggcgtattcggttgtttttgggtttttggttttagatttttattaggc

SEQ ID NO: 5099 - DNA, 201 bp, synthetic construct
  misc_feature 1..201: note = Description of Artificial Sequence: Synthetic polynucleotide
  source 1..201: mol_type = other DNA
taaagtaaaataggataaacgatcgcggcgcgtcgacgtttggcgggttacggttataaagcgggttttagagttttttttaggcggcggtaaagggggcgttcgaggttatcggtaagagatagattattggcgtttcgggaaaatagagtggggaagggcgagattgtgtgtttatttacgttcgcgcgggtttgagtt

SEQ ID NO: 5100 - DNA, 201 bp, synthetic construct
  misc_feature 1..201: note = Description of Artificial Sequence: Synthetic polynucleotide
  source 1..201: mol_type = other DNA
acgttggcgaatgattatggaaataatatttaatagtagtgttttttatgttaggtatataatcgttttggcgtgggttgataattatgtttattttatcgcgtggtattgagtcgatcgtatatttagggtttcggtttttagggttcgtttattcgtttattgcgtgaagtatttattttcgtaggagtcggagtagga

SEQ ID NO: 5101 - DNA, 312 bp, synthetic construct
  misc_feature 1..312: note = Description of Artificial Sequence: Synthetic polynucleotide
  source 1..312: mol_type = other DNA
tggtcgtttttttcgcggttaggcgtattttgtagcgtttagatcgtcgcgtttttattcgcgtttttaatcgcgagcgttcgtttgggtcgggtcgggcgttcgagattcgggagagattaggggttcgtaaagtagaagagtagatttagaaagaaaaaaaaaaaagcgagaagtgcgagaaaaatatattgaatttagttaaatatacggtagatgaaaaaaatattttgtttagaagttaaaaacgagttttcgagtcgtgagatattgttgcgttttcgttaggcgtgtaggtcggatgttaggggg

SEQ ID NO: 5102 - DNA, 203 bp, synthetic construct
  misc_feature 1..203: note = Description of Artificial Sequence: Synthetic polynucleotide
  source 1..203: mol_type = other DNA
gcgttggtagggggaggtttcggtaacgtttgggggttttaggttagtttttttcgggttggaaggtatcgtataggggttttcgttaatttcggttttcgcgcggtcgggatacggttatatttgttcgcgggggtttgttttttaggtcgtcgtaggtttttcggagtttaagaggattttataagtagttaaagttagcg

SEQ ID NO: 5103 - DNA, 201 bp, synthetic construct
  misc_feature 1..201: note = Description of Artificial Sequence: Synthetic polynucleotide
  source 1..201: mol_type = other DNA
tttcggggcgggcggcgaggggcgggagtttagagagtgtttcgtttttgtttagtgttgggcggcgcgtggggggggtagggttttcgtttttttacgcggtttcgcgtattttaaggattttaatttgttaggtgagtttttgtttcggggaggggcgttgggggcggcggcgaggatttagttgcgcgcgcgtatgcg

SEQ ID NO: 5104 - DNA, 283 bp, synthetic construct
  misc_feature 1..283: note = Description of Artificial Sequence: Synthetic polynucleotide
  source 1..283: mol_type = other DNA
gtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtt

SEQ ID NO: 5105 - DNA, 201 bp, synthetic construct
  misc_feature 1..201: note = Description of Artificial Sequence: Synthetic polynucleotide
  source 1..201: mol_type = other DNA
gaacgttttttagttcggtttggtattggcgtcggtgttttttattttggttattacggtttttagggatttgtgggaggattatagtcgttatcgtttcgattataagattaattatttgggttgtttggtttttagtaggtgagttgggcgggcgggcgagcgagcgcgcggtggcgtagggtagggcgtttcgggaat

SEQ ID NO: 5106 - DNA, 247 bp, synthetic construct
  misc_feature 1..247: note = Description of Artificial Sequence: Synthetic polynucleotide
  source 1..247: mol_type = other DNA
aggcgtagatttacgagttggagcggcgttttcggtagtagcggtatttgtcggcgttcgagcgcgaatatttggttagttttattcgttttacgtttacgtaggttaagatttggttttagaattatcgttataagatgaagcgcgttcgggtcgagaaaggtatggaggtgacgtttttgttttcgtcgcgtcgggtggtcgtgttcgttttggttagggacggtaaattatgttacgcgtttaa

SEQ ID NO: 5107 - DNA, 427 bp, synthetic construct
  misc_feature 1..427: note = Description of Artificial Sequence: Synthetic polynucleotide
  source 1..427: mol_type = other DNA
tagcgcgtttcgggtttcgcgcgtcgttagtttttggttcgttcgtcggtttcgtcgcgttcgttagtttcgtagcggagtttcggttcggtttcgggtcgtcgttattacgtcgcgcgtcgtatttcgcgttaagaatggggcggttaagttgtttaagtcgttcgtcgtcgtcgtcgtcgtcgcggtcgaggcgttcggcgtcggcgcgggtatggagcgttcgtagagtcgttttagtttgttcgtttttttcgaggcgttcgttatttatttttcgtgtatgaattttttcgacgacgaggacgtaggtaagcgcgcggttcgttttttagattttcggggtgtttcgggatttaggttcggtagtttttttttcgattcgtgcgtttttttttttatttttaattttttgggaaggcgtttt

SEQ ID NO: 5108 - DNA, 246 bp, synthetic construct
  misc_feature 1..246: note = Description of Artificial Sequence: Synthetic polynucleotide
  source 1..246: mol_type = other DNA
ttcgggggcggttgtacgtggtcgtggttttgaattttttgcgggggtttcgaaattcgtttgcggggaggttagggcgatagaggattcgggagttatcgttggtgcgtggcggcgtggagcgcgtttgttacggttaaggtgcgggttcggtttcggtttattttaaggggttatcgggatgcgaagttcgggacgttcgtcgtcgcggtgatttcggcgggggcgtatttcggttgtgggtcg

SEQ ID NO: 5109 - DNA, 384 bp, synthetic construct
  misc_feature 1..384: note = Description of Artificial Sequence: Synthetic polynucleotide
  source 1..384: mol_type = other DNA
tggtggcggaattttcggggcggtcggaggcggcggtcggggagtcgagaagtaagtattagcgttttaggatcgcgcgcgtcgtttcgcgtcgtttcgcgtcgtttttcggtttagagtttttattttcggtttgtgagtttgcggcgttggtggagttcggttttaggaagaggagtttattcggttttttttgattggatagtagcgaggttttatcgggcgttttcgcggtttaaaatcgaagcgggggcgagggggaggtagagttcgttttttgcgcgtcgcggttgggagggagaggaggtgggagagaaggaagaggcggaggaggtagcgggcgtcgaggttttgggattcgtaggtaagttagatcgacgcgta

SEQ ID NO: 5110 - DNA, 415 bp, synthetic construct
  misc_feature 1..415: note = Description of Artificial Sequence: Synthetic polynucleotide
  source 1..415: mol_type = other DNA
cggggggggtaggggtttcgggtcgcggggtgcgggggttgcgttaaattttcgcggggcgtttcgggcgtacggagggttcggcgtttattcgttcgacggcgttttatttattggcgtttacggttcgtaggtaaagcgtggaaggagttgaacgcggcggagaagcggtttttcgtggaggaagtcgaacggttgcgcgtgtagtatttgcgcgattattttaattataagtatcggtcgcgtcgtaagaagtaggcgcgtaaggttcggcggttggagttcggttttttgttttcgggattagcgttttcgtagttatcgttcgagttttttttcgcggcgtttggttcggttcgcgtttttcgcgagttgttttcgttgggcgtcgagttcgacggtttggggttgttta

SEQ ID NO: 5111 - DNA, 543 bp, synthetic construct
  misc_feature 1..543: note = Description of Artificial Sequence: Synthetic polynucleotide
  source 1..543: mol_type = other DNA
cgttggaagaaaaatttttcgcgcgtcggtagaattgtagcgtttttttttagtgatttcgggagtttcggttgtagtcggttttgcgcgtttttttaacgaataatagaaattgttaattttaataatttagagtaggttaacgaggttttgttttttcgattcgaattaaaggtttttcgtttcgtgcgttgttacgagcggtgttttttggggttttaatgtagcgagttgtgttcgaggggttcggaaggcgtaagttgggtagcgatatggggaacgcggagcgggtttcggggtttcggagttttgggttagtatttacgttgttgttgttcgtcgcggcgttattggtcgtgtcggacgtattcgggcgttttttcgaggaggacgaggagttagtggtgtcggagttggagcgcgtttcgggatacgggattacgcgttttcgtttgtacgtttttgattagtagttggatttggagttgcggttcgatagtagttttttggcgttcggttttacgttttagaacgtggggcgta

SEQ ID NO: 5112 - DNA, 227 bp, synthetic construct
  misc_feature 1..227: note = Description of Artificial Sequence: Synthetic polynucleotide
  source 1..227: mol_type = other DNA
tttagggcgtagattttttattgtttttcgggtttttttcgggttttttttttgatttttttttttttttttttcgagtttttgtttatatttaggttgcgtttcggtttggttgttaaatagaacgacgtttttgcgtagagttgattaggggtggcggcgggaggtaaggttttcggtatcggaaagtaaagtaaagaaaaaggtattgtagttatcgtttttgg

SEQ ID NO: 5113 - DNA, 323 bp, synthetic construct
  misc_feature 1..323: note = Description of Artificial Sequence: Synthetic polynucleotide
  source 1..323: mol_type = other DNA
ttttgtttcgcgattggcgggagtcggagtttttttgaattcggcgtttatattatgggttgagttcgtcggcgtcgagggagttagtgcgattcggttcggcgcgtacggttaaggtacgcgcgttggtatacgcgggcgcggatacgcgcggatatatacgtgcgggatacgttttttttcgacggcggcgttaatttttcggtaagtttagcgttttacgcgatttgttcggtttttacgttggttatagcggttgcggggacggggaggaaggtagcggggtggttttaggggtttattttgtagggttttttcgacgg

SEQ ID NO: 5114 - DNA, 279 bp, synthetic construct
  misc_feature 1..279: note = Description of Artificial Sequence: Synthetic polynucleotide
  source 1..279: mol_type = other DNA
ggcgtagattatttggaaggggttgtggatgtcgtgcgtggtgtagagtatcgggtatatgtagtgtaaagtgtacgattcggtgttggttttgagtatcgaggtgtaggcggcgcgggcgtttatcgtgagcgtcgtgttgttggcgttcgttgcgtttttcgtgattttggcgggcgcgtagtgtattatttgcgtggtttcgggttcggttaaggcgcgtgtggtttttacgggaggcgtgttttatttgttttgcgggttgttggcgttcgtgtt

SEQ ID NO: 5115 - DNA, 261 bp, synthetic construct
  misc_feature 1..261: note = Description of Artificial Sequence: Synthetic polynucleotide
  source 1..261: mol_type = other DNA
ttttcgtcggtggaggtcgcggttggcggagatcgttaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtagtttgtaagttcgcggttcgcgcggcgcggggatggggagcgtgtgcgtcgaggagcgcgcgtcgag

SEQ ID NO: 5116 - DNA, 364 bp, synthetic construct
  misc_feature 1..364: note = Description of Artificial Sequence: Synthetic polynucleotide
  source 1..364: mol_type = other DNA
tgtacgcgcgcgtggttcgacgcgaggttcggtcggttcgggttcggggcgagattgggggtttgtcgttgtcgttatcgttcgagcgtaggaaatcgtcgttatttgatttcgttattaagtttaaggtgttttggatttacggtaagtatagcgtcgttgtagttggtcgtgcgtttttattatcgtcgttaggtttcgaggtcgcgtttagttttagtaagaggaaacggacgtttagcgataaatcggcgtatacggtcgaatacggtagttttcggattcgcgatttaacgtcgcgtttttcggggttgttcgaggaggcgatagttttcgttgcgttttcgtcgtttagggttcgagc

SEQ ID NO: 5117 - DNA, 242 bp, synthetic construct
  misc_feature 1..242: note = Description of Artificial Sequence: Synthetic polynucleotide
  source 1..242: mol_type = other DNA
tagggtggaggcggtgtttgattgtttttttgcgtgtgttttgggaggtgggtttgttttggggatagaggtgttggacgtgtaggagtagatatgtcgcgcgtttcgaggaagcgtcggaattattagaagtatagggacgcgggtgtcgagagtttttagtattgaaaacggggatttttttttttgtaagggattttttttttttgttttaatttatttttttagatttaagggacgtt

SEQ ID NO: 5118 - DNA, 285 bp, synthetic construct
  misc_feature 1..285: note = Description of Artificial Sequence: Synthetic polynucleotide
  source 1..285: mol_type = other DNA
tagtttcgggtcggggtggttgttttattttcgtggtttagggaggaggcgttgggtgcgtatgtttaggggtgtgttcgttgttagggttgtagcggtcgttatttttaattagttgtaagtcgagttgtttatttgggatcgggtcggttcggcgggtttggttttcggcgaaggcggcggcgttggtgcgcggcggttggggcgcgggacgtaggtagtgcgtggcgcggttggcgttttcgggcgtcgttatcgagcgagggtgcggtttcgggcggtcgt

SEQ ID NO: 5119 - DNA, 222 bp, synthetic construct
  misc_feature 1..222: note = Description of Artificial Sequence: Synthetic polynucleotide
  source 1..222: mol_type = other DNA
cgttatcgttgtcgtcgttttttcgcggagtgacgcgttttgtagttaatcggggtagtcgggggggaggttcgggaggggttttgggcggagtcgggtcgtttttttattttacgggttcggggttgtttttttcgaaaattttagttttaattgttttgggaatgttcgaggtagagaaagggagcgagggagtaagtaagaagttggaggattagtgtt

SEQ ID NO: 5120 - DNA, 201 bp, synthetic construct
  misc_feature 1..201: note = Description of Artificial Sequence: Synthetic polynucleotide
  source 1..201: mol_type = other DNA
gtagcgttttttggtttcgcgcgtcgttcgggggtcgttggttcggtgcgtgtggtcgtttcgtcgtttggttggagtttgtttcgcggcgtagggttgcgtttcgagggttcgttggttcggtggtttggggtttgttcggtttagcggtttatggttcggttttcgcgttttagttttcgtcgtcgtcgtcgtcgtcgt

SEQ ID NO: 5121 - DNA, 298 bp, synthetic construct
  misc_feature 1..298: note = Description of Artificial Sequence: Synthetic polynucleotide
  source 1..298: mol_type = other DNA
tcggttttgggtggcggcgtcggggtagcgcgttcggtcgagtcggggagaggagcgcgggagattcggagcggagcggtaggagagcgcggagcgaagcggtaggagtagtttatagttaggagcgttttttcgtttttaacgtcgcgtttttttttttaaaacggtttaaaaaaatttattaattgtatggtcgcgtatttttaaaaaggtattcgtcgttatttggtttcggtgaattttaggaggcggaggaagggcgcggggtgggtgcggtgatatcgtgggaggtggtttt

SEQ ID NO: 5122 - DNA, 272 bp, synthetic construct
  misc_feature 1..272: note = Description of Artificial Sequence: Synthetic polynucleotide
  source 1..272: mol_type = other DNA
tatttatttcgattcgaggttgtttattcggtttggtatgtttcggcgtttttggggtttttgtatttcgttggtttttcgttgtggtgtttcgtagttcgattatttttgtgtttttaggagtttattttgggcggtagggaggcgttgcgtggggtttacgagttttacgttgttatttttattagtttttattttttaggcgtttgttttttcgtattgttaggttttgttttcgtagtatttggtagatttgagttcggtttttgtta

SEQ ID NO: 5123 - DNA, 201 bp, synthetic construct
  misc_feature 1..201: note = Description of Artificial Sequence: Synthetic polynucleotide
  source 1..201: mol_type = other DNA
tttagtaatatttgtagggttggtttttcggtcgtttatttcgttagtttgggtttttgtgtggagtgcgtttttgtgtttttggttagtcgtcggttacgtgtattttttgttaggggttggtaggttttttatttgtttaaattagaaatataaggtatagtggtttttagttgagggatggtatttttttttatgttt

SEQ ID NO: 5124 - DNA, 251 bp, synthetic construct
  misc_feature 1..251: note = Description of Artificial Sequence: Synthetic polynucleotide
  source 1..251: mol_type = other DNA
tacgtttttcgcgttcgttcgcgtttgttttaggtttttatcgcggttttttttgttttcggggtcgttttgttttttatagattttattttcgggggtcgtttttaggattttcgttcgtttttttttgattcggtttttgttcgtttcgtttttttttttcgggttttttatttttttttcgtcggtttcgatttcgggggcgtttcggatttgtttttcgaatatttttagtttcgtttttagtttgc

SEQ ID NO: 5125 - DNA, 249 bp, synthetic construct
  misc_feature 1..249: note = Description of Artificial Sequence: Synthetic polynucleotide
  source 1..249: mol_type = other DNA
cggcggtttttatttggagtcgtatttggggcgtcgagtttcggggtcgcggaaagaatgcgcgtcgttcgtgcgtttcgtttgtcgcgtttggttattcgtagtcgtcgcgttcgtatttgattatggagtgcgtttttttgttcgcgtgtgttttttcggttgcgggttcgggttcgtcgaggggtttggcgggattggggcgcgtggttaaggtaggtgtcgtcgagcggagtttcgagagcgggt

SEQ ID NO: 5126 - DNA, 249 bp, synthetic construct
  misc_feature 1..249: note = Description of Artificial Sequence: Synthetic polynucleotide
  source 1..249: mol_type = other DNA
tttttagagttaattttttagatttggaggtttttaaggttttcgtaatttagtgagtttcggggtattaataaattttcgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggat

SEQ ID NO: 5127 - DNA, 201 bp, synthetic construct
  misc_feature 1..201: note = Description of Artificial Sequence: Synthetic polynucleotide
  source 1..201: mol_type = other DNA
ggtcgcggcggtcggggtcggtgtcggcgtttttttgggcggtagcggcgaggagatgggtttcgtcgtcgtcgtggtgttcgtcgtgatcgtcgcggtcgtcgcgtagagcggcgcgggttcgtattattattattattattattacgtcgtcggttattattattattcgacggtcggcgcgttcggcgtcgcgggtag

SEQ ID NO: 5128 - DNA, 201 bp, synthetic construct
  misc_feature 1..201: note = Description of Artificial Sequence: Synthetic polynucleotide
  source 1..201: mol_type = other DNA
atggtttaggcggtcgtttcgcgcgttttagtttcgtcgcgcgtttgagttcggtgcggcgttagaagatagcgcgtagtcgtttttgagtcgtggaggcggggattaagttggaaggagtagcgattttcggatcgagtcgcgagtgtgcgtcgttcgtcgttcgtcggatttttcggatttttcgatcgtaagtgtcgt

SEQ ID NO: 5129 - DNA, 251 bp, synthetic construct
  misc_feature 1..251: note = Description of Artificial Sequence: Synthetic polynucleotide
  source 1..251: mol_type = other DNA
atcgcgtagttcgcgttttattgtcgatcggattttacgttgttgtttttagcgttgcgcgttttgcgcggattcgcgttgttggacgtcgttatttcgcgtttggggtttacgcgagtcgcgagtttttgtttgtttttgcgttatttcgatttcgcgttttgtattcgtttcgggttcgcgtttcgcgttcgtacgtaacggtattcggttttgtatacgcggttggttttacgcgttgttcggcgtcg

SEQ ID NO: 5130 - DNA, 201 bp, synthetic construct
  misc_feature 1..201: note = Description of Artificial Sequence: Synthetic polynucleotide
  source 1..201: mol_type = other DNA
ggggtttcgttgagttgagttttgcgattcggtttatgtgacgtgagttttattttaatttaagtgtgaggaagcgaatagcgttttgaaacgtagaaacgtgtttattcgaattgttaacgcgagcgtagagtttattgataaagtaaaataagataaatcgggagttagaaaatttagcgatttataggatttatcgtg

SEQ ID NO: 5131 - DNA, 201 bp, synthetic construct
  misc_feature 1..201: note = Description of Artificial Sequence: Synthetic polynucleotide
  source 1..201: mol_type = other DNA
ttttagaattcgcgggttattcgggagtttttttcgtagtattagtcgaaagtttttagtgtcgaggagggcgggtagttgtttttttcgatttcgtttcgttcgcgcggacgttttcggttttacgcggggattatttcgggattttcgtcggatttcgcgcgttcgcggttaatttgcgtgtatttgcgtttcgcgtta

SEQ ID NO: 5132 - DNA, 201 bp, synthetic construct
  misc_feature 1..201: note = Description of Artificial Sequence: Synthetic polynucleotide
  source 1..201: mol_type = other DNA
aggtcgagttcgtacggcgttttcgtgtagttagcggttagtgatcgcgcggttcgggcgtttttcgcgcgttttagttttttagacggggttcggacgcggacgttttttttgtagttttgttttgatcgttagggatgggttttgggtatttagcggttgagggtggggagcggttagcgtttgatgtttagtttttta

SEQ ID NO: 5133 - DNA, 337 bp, synthetic construct
  misc_feature 1..337: note = Description of Artificial Sequence: Synthetic polynucleotide
  source 1..337: mol_type = other DNA
gtggtttcgttttagggtcgcggggaggcgttttcgtgcggggcggagttgttatcgttttttttttaattttcggggattgtggtttttttttaagttcgcggcgtttttagttgttttttattcgtttcgttcgttagtttttttttcgcgcgatggtttcggcgttgagttatgtttttaagtttaagtttttcgtgattttgttcgttatttcgtttttgttgttgttattcgttattttgatgttcgttaaggttagttgtatttttaggtagtttttcggatattcggcgttttgtgtttattaacgggtatcgatttcgggagttttgag

SEQ ID NO: 5134 - DNA, 201 bp, synthetic construct
  misc_feature 1..201: note = Description of Artificial Sequence: Synthetic polynucleotide
  source 1..201: mol_type = other DNA
tgttttcggcgttttacgtgtggcggcggttagcggcggtttaggaggtagtcggtgagcgtttgcgagtagagtggcgggggtcgttgataggtttcgcgtagtttagtttagtttagttacgcggtttataggtggggtttaagagtagtttggagtaattcggcgttacggagaggggtggacggttttgtacgggtt

SEQ ID NO: 5135 - DNA, 201 bp, synthetic construct
  misc_feature 1..201: note = Description of Artificial Sequence: Synthetic polynucleotide
  source 1..201: mol_type = other DNA
ttttttgcggcgaggtcgtttgatgaatttaagggtattagtgtttcgcgagaattttttgtgggttgtgacgagaattaagcggagcgtaatttttatcgtattcggataggatgcgttgcgtaatttgtcgtagtttttttgttttatttcgggtggttcgaagttgtaattttgttaattttttattatacgttatgt

SEQ ID NO: 5136 - DNA, 201 bp, synthetic construct
  misc_feature 1..201: note = Description of Artificial Sequence: Synthetic polynucleotide
  source 1..201: mol_type = other DNA
ttttgtagttttgtttagattcggaagtcgtcgaggaagggaggaaggcgggggtggggagagcgcgattttaagcgttggcgggcggcgaggaggggtcgtagcggttcgaggaagcgtttggaggcgttaggggcgtcgagtttttagggaggtcgcgttttcgggaagttttttatcggttgttcggagtaggatcgg

SEQ ID NO: 5137 - DNA, 2567 bp, Homo sapiens
  source 1..2567: mol_type = unassigned DNA
gcgctgggcgatgagggaccgttgggtaattgggggcataggaccgggcttcgctgggttcggggcagaagcgccgaagctccgacccggaacgcggtgacttcatcaacgcagaagcccgcgcagccgagcagaggagtccctcgtaggcgaccctcggacagacgctcctgcgcggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcccggcggtccaatcctagcctgcggcctctctcgagcctttcgcaaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgcgctcccgcgttggggacg

SEQ ID NO: 5138 - DNA, 573 bp, Homo sapiens
  source 1..573: mol_type = unassigned DNA
gcgcccaagaagtcggggtcctccctggccacgcgcctccgggggcgctcgcgctctccaggccctggctgcctgggcgccgattcccgggacgcgccggccgacagcaggggaggcggcagcagggaccgcagcagcccccgcttccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcg

SEQ ID NO: 5139 - DNA, 383 bp, Homo sapiens
  source 1..383: mol_type = unassigned DNA
ccggcccccatagcggctccgggccctcggatggcgtgacggcttgtggggcctgcggggtgcgctgcccccggacctgcggggggaggcggctgagctggcggcgctcgcgggcccagtggtgagtgcggcgtcctcacgcccagcccgacgcctccggagcggccgccgcgcaggggtgggcgcgggcttccaggagggagggcggctgtgaacgcgccttgctttccgcgcctccgcagtttcttgcgcagttgatgatctttataatcagcctcgtcagctccatcttctgtggacatctgggcaaggtcgagccggacgctgtcacgctcgccgtcacggtgggtgcctgatttcgcccctgtaggagccgacgggcg

SEQ ID NO: 5140 - DNA, 853 bp, Homo sapiens
  source 1..853: mol_type = unassigned DNA
ccgccccaggggcactccgtaggcgagatccctgcagatcctagctaggaaacgccagtgaacggcagcgcagggaacggggcggggccgctggcttcgcccaccgccgcggtgttgggggctgggggtggccctcgggactggtgtggagcctgggcctgacccactgacttggctgagtggggagactggagggtcgcatccggagctgggcccggggacgcccgctggtgggaagggtgtgcgcgcgtcggaggccgcggctgaccctgctccggcgctgccaggtacggcatcagcccggacagcatcatcctgtaccggcagagcatcggcacggtgcccaccgtggacctggcctcgcgctacgagtgtgccgcggtggtgctgcactcgccgctcacctcgggcatgcgcgtcgccttccctgacaccaagacgacctactgcttcgacgccttccctaagtgagcggcccgggcggggacggaggcggggcggggacggaggcggggcggggcccgggccgggcgctaagtctcacccgctccacgcccctcccgcagcatcgagaaggtgtcctagatcacgtcgcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccg

SEQ ID NO: 5141 - DNA, 1062 bp, Homo sapiens
  source 1..1062: mol_type = unassigned DNA
ccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtctgcagcgtccccgccgccgccgcccccgccgcctccccctctccctcccattttcgccgcggcccccgcccctcccctccccgccccctattgcccctcctccttcccctccccactcttctccttccctcccctcccctcccttcccctccggagcggctggggctgcggcgccgctgctgacacggatcggccgcggccgccaccgggcggaggctgcgcggcgcagacccagacgggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgagcgtcacgcgtcacgcctagggtggcttctgcgcccaccttccttcctcg

SEQ ID NO: 5142 - DNA, 918 bp, Homo sapiens
  source 1..918: mol_type = unassigned DNA
ccgccgcctccacagcgcgcctccaacaccgctgtctctgccccgcgccccagagcgctcccagctttctttcctacccttcccatgagtggagccgggcctggggcgccttaggcggtgacgatctgcagaagtctttgagaatgcaagatcttttggagccttcggtccgccagggccgggtccagtcaggacgccccgctcagaccccttcccagcctggggtgggcccaggcccgtctgcccccactgccttgtgttccaggagcccccgctcggagcccagacccggtgcccgaagatgagagtgccgcttctctccgtcgggtgagaagccagcccacgtcccgccggccaggcacggtgtctctcggggcgccccacgggaacccctgtgcctccatcggcgccctcggcggcggggcagtcttggcgctctcccctcgcccctggcccaggcccggctcgcgggtgtagctcttcctagggccccctcccctttccgggccgcgcgtccgccccgcatcgcggcggctcctcggcagtgtttgtttttattggacgcacagtgaccgtgacgggcacggggcgcgagctctcatcaccacaatgggtgtgcatggcgcggggcggggggcgctgccggcctcgagcgagggaggggagaggagggggtgcgcccgtgccctgcccgccccgagttcccgagtccgcgccccaccaccgcagcgagccgcccttctgggccgctcctctgttttcctttcccatccgttccctttgcctcggctgctcggagacatgtctggtggcgatcggggacccagagcccggcagccgctcctgtccctgtccctgcgatccctgtcccttccctttgtctccccgcgcagcgctctccgccgcggaaacttcgcg

SEQ ID NO: 5143 - DNA, 865 bp, Homo sapiens
  source 1..865: mol_type = unassigned DNA
acgtgcgcgcccgccggagaccagggatgaggtcactaaatgactgccccggccaacccccaccccgtctttatccgcaccgccccccccttaattgacctaactttctaaccctagctcttcgcttctggcaccggtcccctcccaagtctccagaccctaaccctggctcccgacccgccccgctacagcttgggaagcgggagaagcagcgcgcgcccttctgcggaccccctcccagggaagattgtggtgttagctgcctagggggaccagggggccaccgggacccagcgcaacctctgtctcgctccccaacccccggaagcgctaacagcacggttcttacgtaatgccgggcttctaagtacccccaacccgcacagcccccggggaggccgcgcagataccggggcccctcacagctcaccaccttggtgcctgaagccactttggagcccctaccgcaggggcggggaccagtgtcaatgggcagcggggcttggttctcccaaccagcaccccagaaagagggcccaggggcgggggcgggtggacagggagggaacgggcctgggtgaaaggggcctgtggagtttaaacccagtgaatagggtcctaagtgccgtgtcaggacgaaaagaaggcggaggtcttgggataggagctggcccgggggccgggggacgcctacctgcgccccgggaagcccctagctccgggcggctccagcgcagccgggcgctcagcgtttattgcttgtcaatcgctagcccggctcttaaagcggcaaggcctctccgcgagggggcggaggtccggaggagaggggaggtgaggagaacgcggaggccggcacaactcg

SEQ ID NO: 5144 - DNA, 408 bp, Homo sapiens
  source 1..408: mol_type = unassigned DNA
gcgctcggctgtcaggcaatccggtccccggttccccacggcggtctcctcggtgtgccccaccaagagcgacagggctggtgacccgaggggcgcgtgcgcggtcgtcagcctgggatttgcacggacccccttctccctagtacgctcgctcgggggcccctcctctgctacgccgctggggctcgcccgccacccacagccctcgcagagccctccgggcacaccgcggctggccgcccggggccaaggatggggcgggagcgcccacccacccccgcgccggccggggcatccaagaggcgcgctcgcagccacacggcgccccgcctcccgctccgaaaaagctcctgctcccctggcgcggtgtggcgtctccgtcagcccagccggattctccccgcttcg

SEQ ID NO: 5145 - DNA, 2245 bp, Homo sapiens
  source 1..2245: mol_type = unassigned DNA
acggccccggggtctggcggggaggcccaccgctgcccagagggctcggccggccgggagggggcgctgtgtcctccccacgccctgcccgcgggctcctagcagcgttcgccgcgctgcaacgcaatgcgcgcccggctttcccctgggcagcgttcagtgcccgcttgtcctgcagggcaccgccgtctccctttcatcctggggctcccaggtccaaagggttcccagatccagcctcttgcctgaaccaaagtggccaggcactcagtttgtaagatgaacaaatgaaggaaagaaggaacgaatgaataagggctcatcttgcagagcgttcgcgtctcagcgcgcaccaggcacatcagtgccaaaggtgctgggggtcgggcccagcgcccggcgcggctggaatgggggcggcgaggagctcctcctagccagccgcagggcgggaactgcccaaacgcaggtcgcagcctcactgggttccgcggcggctccgctcagtagggaccgccctgttccctagcccccaatagcctcgccctcataaattcacctgagcaccctggcccaagtcaccccagatccctgggacttcccaggccccgacctcggccgggcgggaggctgatcctttaccgcggcccccttcccccattcccggcttctccccgggctgcggcggccgccactgctgccagcgcgccccgaggactgccgcaaaccccgggcgcagggaaaggggatcctggcggcgggacacagagagcgggccgggggaaggggagggaacggaggaggcgaggaggagctgggagggagccgaggggcgaggcgcggaggagggaccgaaggggagcggaggggagagggagggggaggaaggggaggggacgagctgggcgagggggcggggagccgaggcgaggagcggcgcggaccgtgggggaggtggcgggggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggtaacagcccgccggccatccctcgagcgctggcgcccccggcccctggcggacgcgggacggggctgggctgtgggtgtgatgggggcgggggcgctgggagagccgtgcttaggtcggggaaggctgggctccggggcagcctaactctctggacctttggagccagggttgggtaggcagggggagactcaggtgagaaaagaaatcgtggcgaagccgccgggatgttggcggaggagggggtccgcccacccgggtagccggctccgcgccaagaatcgctctaggctctcgggcagacgcctaggggaggggaggttccacctcccacgcccttcctgcagacctcggccccgggactggagactctgaagcggggttcccacctcgccccagcgcccccaaacagctccccgactccgcacgcccccgccctagtcttgggagcgcgtcctgccccttcccctccgcggcgagctgcgagtccggagagatgaatgccgcccgcgcctgcgagcccttgatcaatatcgcagtctcgggggaggagacggtgcctctggcggcagttcctgttccccgaccgcggctgggagcgcgacgctcgttctccgagcctgggcacccgcgatccccgcgctgcgcggccgaccctgcgacgcggatcgggcgctggagtttaggaaagtagccagaccgcacgtccagcgtctgcccgctgaagttcgtgggcggtgggggcggcccgcgggttgtgtgagccagggaagggccgggaggccggcagtccggcccgccgctcgtgtcaggcgtcacttgcagccccaagcgctttccagagcgttttggttttgcagggtataggcgcgcccgctgcagccggccggagaggcgggtgggcctctgcgctgctgccgggacaccccgcttcgcgccagtctgggcatcgcctcacccggggctcgggactccgcagggtccg

SEQ ID NO: 5146 - DNA, 2972 bp, Homo sapiens
  source 1..2972: mol_type = unassigned DNA
gcgggccgcagccggagaggaacaggaaccgcagtggggacgccctggtccccgggcccacagcatccgggacggacgcgcagtagcgcgggccgggaactgggtaccagggcgggatgggtgagaggctctaagggacaaggcagggagaagcgcagcggggtgcggggaaccgcacgccctccctttgcctctgcttcccaccccgaggcggcagggcgggcgggcgcggttccgggggtgggcgggctgggcggggcggaggcggggccgcagcactggcttcacccagcctctcccgcccgcagccagagcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgagtgttagccggagggggcccgctccctttcccgggatcagaactccgagaagagccgggcgccgccaccaaggaaacagaacagagcattggggtcccagatactgagggtgggtggtgggaaaggacctctgatgccgggaccacgaaggagggtctagggttcccggagcgcagaggcgactctccagggtggagatgagggcaagaccggagcacggatgccggtcctcaggtaccgcagggggcggtgggggagctgggaggggtctttcaagagggggcatggggctctccgatgcccaggttcttcggaagaggacactcgaatgccgggatcccgaagggactttcccctcagcatctcggtctctggagagtcgtgggacagaaccaaggcgagagaaggagggggaactggacggggactagagatgagaggggcgagctgggctggggcggggagcccgggacgacgggatggaacaatggaggaggtcggagggactggaggcagaggggacccggcaaggacaatggggaccggccagacaatgggggggaggggcgtcggagggagaggttggggagcgggagagaggttgagaagtgggttagggagggcagaagaggggcgacggcgagggcggcagagagatggaagcagaaggaaaggagacagagcggggcgcggaccctgaagtggtcggggtcccgcctgcccgctgagggacagtgagacgagaagagagagcagaggcttggacatttccagcgcctgtccccgcgctcctgctcgcggcctctcccagtcccggaattggggctgcggatctaaggctgggaggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcccagtctggctcaagcgcctcgcttcttccctgggggaccgcgtggggaggcgggaataatcg

SEQ ID NO: 5147 - DNA, 1026 bp, Homo sapiens
  source 1..1026: mol_type = unassigned DNA
gcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgcggctccctcggcccctcaaactgctctcttttctgctcctctcccccgcacccgcgcctgccgccgctgaaagcgcccccgctgctcggacccgggcggtcg

SEQ ID NO: 5148 - DNA, 10207 bp, Homo sapiens
  source 1..10207: mol_type = unassigned DNA
gcggaggcggcacagctggagcccggattgtggcacgccgtcaccgtgctgctccggggaatcccgacccgctccctgcgaaagcgtttccgaacgcgaacccagagcctgtgaacgcgccggcaagccccccactcccccaccgccgcccgtcgcaggtgggcccgtcctaggggtccttcctgcgctctaccccgtctctcaagtcactcagtcgatcgccccgttcacgctcccgtgatcccagacatccataaccacgatctcgcctccatgcacatccaacgcacgacggtgcacagacgtgcacctgacttctgcggaccaggtgtctcaagcgtacagcggccacccgcggaaccgcggcccggggccagtgagtcgtctgcagctccccgggttaggggattccccagaactccgggaaagtcacccgaagtccatccgggatgcggccttggttctcggccgcgtgatctcgcccttaggtgcagaacgacgcccttccagggcccacagctgccaggctgggccttgccctcgcatcccccgggaagaccagggacggggccacacaggccgtggctgcggagacgcttccccgggccaccccgcgaccaggagggagtcgagccgcccgctctccccgcgtcccccgccccatcccagccagttggccccaccctgcgcgggataattgggacgggagggaggcgacgggagggcggcggctccagagagactgcgcgcctgtcagcggcaatttgtttaagtggacgggacgggccgggccgctgcgggctggggtcaccgaggccgcggcccccaccccaaccagacctgggaccgcgggggagcccggtccggccgctaaaccgggctggctggcgccagggctccgggaggtgcggtccggcggggaagccgtgatgggaagcgactctgtccagggagtgtccttcaccaccacactcctcacgtccaggcagtgatcgacggcctggcggcaccctcacagcgggcccatagcacggggccacacacgtcccctgagcttagcctgggcacattcgtctgccaccgagggcttaagccagtctgcagcccgcgccccgtcactcggacgcaagtccgtcgtccgctctgccacgcggccgcacagcccgagcttcctgctgcccactgcccgcggggtcacgcaaccccggccctgcacacagaggaggaagcggcggggaccccctgccacctggaggctcaacccggggaaggtcccagcagtgccccttaaccctgcgagaggtgacggggccggaggacggaagggcagccacgccaggctcaggaccgcggccccacccggcccaggccgtccccgctcccgccccatttcactgttgcgggaagcgcggggcgcacagaccgcgcgccaccagcccaagcccgcccgacgccctggccggagaccgcctgcgagagggaggggcggccgagcgcgcgtcccccgcctgtctgcgggacctggccgatgcgaagtgacaggggccggagctttgttgtggagcctcggccgcctggcgccagccgcccccgcccgcgccctccccctccagccccgggcggcccgcgaggcgccccccggggcctcttaaaggaacacgcacactcggcccccggggctccgccaggggagggggttcctgggaagggggagggggccggcctaggtgggggaggggcccagcggaggcctcacggcgccgctccagggcctcccaggcctccccagcgccagctttcggtgagcctcgggcattcctagctggagagtttggctgggggtcgctacagactcttcagagcggctgcagcaggacctcagggtgatcgcgggaccgcggggcggggcgagtggtgggatcctggcccggacagagccccggaaagccagagggaaggtcggtgccactgtaggtggggtcgccgtccccagatgcagccgctgcactgtcgccgccaggtttctcggtcaaataacccaggcctgagtgtttcaaactcttcaggcctcggacccctggaccagctatggatggactaatgaaatggactaatgtctaaaacgcacacatttagatgtacacatactcttacaaggacaaaagtatgtgtctacacacacacacacacacacacacacacacacgcgcgcgcgcgcgcgcgcgactttgcgaatgtattcacggattcctaggccggtacctgggttcccggctaaggaaagctgccctggttattatctggtcacctcaccggctgcgcaaacgtgtccacaacgggtccctccccgagaggccacatctcgcctaaggtggagccagcaggtatttgcctgtggaaaactgcagtggatcctgccccgtctgcgtagactgcgcagctcggagtcaaagattcgttctggccagagaggaggtactaagagaggtgcgacctagccaagaacgaggtcgtggagaaaaccctgtgggggcggcgctcacatatgcggtgatgaggagttgtgagggccctggggtcggccccgaaaagtagggataacggtcgcagaggccatactgcttccgccggtcccgaatccgcactgccaggagagatccggccttcaaacgctgctcccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctccccgtgcacaccttgagttatagctctcgctgcgcacagagggcaccacacggggcccgacacacacacacacacacacacacacacacacacacacacacacaccatcacttcatgggggggaaactgaggctgccggaagacagaaaacgaagactgatcacagaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggtatttcccctgaacgaatttcggggagattaaggagaagcgagaatatttctagagggcctagacttctctcctgggcatcagctttcatctcagatcagggagaaagagggtccccagatctgagcacaaggcctaaaggaggctgtttaggagagggtctgacaggcagaaatgggatctcctgggagcaacaaccacaggtggggtcgtccgggcagtgatgagagggcagagcagccgaccacaggggaaacagccaggcggcagcggtgtgcgcaacgaggagggataaataaaggaggagtggggtcctggaacctagaacagccggttccaatgggatctcctcccttccctccctcccaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcgtgagtgttggggcagggtggggacggtgcaggagcttgttgacccagcactgcagctgagcaggagagcagggcggcaggatctcccagggggaagcgctgggcaaacccccagagtgcccctgcccgggtcactgccctgtggtctacgtgggctgggcctgggcctgggccccagcgctctcctttgcaagcctgggaaatggtggggtcagtggctggcagctcacaatctcagttcctcaggccgtggagggtcccttgtaccgtcaatagggaggcaggtgctgccaggactgggtctgcagtgctggaccacggaggtcaccctgctcttggcctgtaggtgccgagcttggaagacctgcccatgacctcaacttgtccatcacccttctgccaagacccgcgtccctggccctcccccaagactaggggatttaaaagttaaaccaccctccccacccacccccccagcctccctaagacctttccctcctcccacaggcagatgcccaactaggaggagagggtttgggggttctctccatttatgcctgagcaaggccccagcgaacgggggtggtgtttcatagggtaaaaggaactgcccattctgaggtagggcagttggtgagcccccgaaggttggaatctcctctttgtggggttagggggtttaccagtgccagaaaggaagagagtgttaagagtggaattgtagggctctgttttgttttattttgtttgggtttcttttgtggggaggggttgttttttggttggtttttttgttttgttttttgttttgttttgtttttgctctgtctcatttctgtttccaactgggaaattttttttaatggcaagagaaaaagaagctgtgaaaagagaaaagcgagaggaaaagtagaagaaaaagaaataagggtgagaaaagagcagagacaggagaaaatggggaagaggaagaaccgatagagagagagagagagagagagagagagagagagagagagaaagtggagaggaagaggtcaggtacccaaagaatagaaaagctcgggccggggctggtggctgccggctgacccccaccctccccgcagaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaaggtgcgcgcggcgggcggtgggctaagcccctgcactgacgcccctcaacacgtgcaggcccaaccgtccgttcatcgcccctcgaagccccctgcacgggatccgcgctcttgcggcccgcccccgagcaccgagcctcgcatccatacgcgcagcactcacggaagtcctcaaggcgccctctcaatcccaccgcgcgcacacacaggctcccctggggcgagcgaacagctgggccgtcgttctgatggagatgtttacttaacaattagctgagactccgggcccgcgctgacatttttacattttattcgtttatttcttggctcaggaatgagaatgtaagtgaagagagggcgcccgaggcaatctgcccaggctctaccgatgctcagaacccggggcccagttttcactctctcggggggagccagagggtgggacaggtgacacagccccccaaagcactcctggctactgctctgggtcagtctaggccccagaccccttgggaggcgcttagagaattaccttccaatcaaagggctttttctgcttgcggcttctccacccttgttctagtggggcagagcatcacccctctaggcctgtgcccttgtgcgccactgtcgagtgaaagagagggtacgagtgtccgtgccggtcgttgtggctttgtgaaccaaggtgtacgctgggctgtgcgtgccccgtttggggtgtgttggatacctgtggaggcatgtgaattcgtttggttccgtaggcgtttgttatgtctgtgcacacttgcgtgtgtgcgagcccgtgagtgtgatttggctttgtgtgtacctgcagccttgcgtgtgaactgcagtctctgttcgcgcctgctcgggtgcggagtcgtttaacttgcgcaagcccgcgggcgggtgtgcatgcttgggctggttccgacactgtggcactgctttaggcctgtgtggggctgtctaggcctgtctagggataattcctcgaatgaagcttttggaggacagaccccgtcgctttccgcgaggccctcccaccggcctcagctcggggcgtcccatcccaggcgggtgggtaccaagtggacgctccccgggtcttccctctgcggccagcacccgctgacctcggggtgccaccgaccacgctggaagagccacggcctgacttagcgccgcccccttggtccccgcagatcacacagctgaagatcgacaacaacccgtttgccaagggcttccgggacaccgggaacggccggcgggagaaaaggtgagaggccgaggacagcagccctgtggcgggtgcccgcgggagcagcgagcaggagggatggagggatgggctccccgctgacctggttcatccgctcatccccaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgaggtgagggtcggaccggaggagggacagggaggtggcggcggggggtcctcaggtcgctgggctggtcttttgctgagccacccgctaacctgaaaggccaggaaggaaacgtcggcgagtgtctgggatggggtttccgtcccgggactcccctacgagggcggtccccggtagccagaagatccggccggactccgagcctggccccttgggcgccgtgtaattctatagctgtagggtttcctctccagggctgggttccttccactgtaaatctggggtcttggattaggtgacctgcagctgccctttgcccgactccagcagctcctccgactcggcctccccgagagcagcccttcccgagtgtccctgatcctgctcgtcggcctccgcccaggcccctgtaatccgcgcgccctctccccgcagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcaggtaaggcctgtgaccccgcggcagcgccagcgagggagaaggcccagggagctggcggcgaggccagcg

SEQ ID NO: 5149 - DNA, 2392 bp, Homo sapiens
  source 1..2392: mol_type = unassigned DNA
ccggaccccctgcccttccggtgagccgcccctcctttgccgtcgggtttccctccctcccttttgcccagccaaaacccgaacccaggcgccaggggagaggaccgccgttctagcttgccccactgctgggggcacggagttcttgctcctccaaggctacggcccccgtctccgcggaccccgcccggactccccctggccaccgggacgccccgccccctcccctccgcagcaatctcttacactcgggctgtgaagttcggggtatttttaggccggcgataaataattcatagggaacgtggcatcaggctccccccgcgggaggagggggcgcgagcagcgagagccaccgtcacccgcggctcaaggacactcgcgatgcggcggcggcggcggcggcggcggctccgggcggggacccgcgccacgcctcctggcggccaagctgagcaccacgcacccggcgccccccgccccacgctgccccccgccggcgtccgcggctccggggcccccacccccactcccccaagctgggtcgtgaccccgagtcccgcagtggggggaccaagccagcctggcaggcggccccagtaccatcccaggcccgcccgggggccctgggcgaacccaggtgtcccggacctgcctacctgcccctggcacgctcttattcttcgggagtttagaaacaggctcaaagtcactagcaccgccaagacctggacgggctctgaaatacagccagcggaatggtaccctccccaaataagtgtctttcctcgattttcctgtggcccggggtcagggactgaactaagataacgccaccatccgagggctgggggaccgagccagaagtccccttggacgaccagggctgggaaaccgagtggacgaatggggtgggcatcagggcctggcgggaattcccgtcttgctcacccagcagctccttgcagggtcgcgggacgcacctgggggttcaggttgccgggtgcctttgctccgcgtgtccccgccctgcccgcgtaggcaggaaacaggagactcggggcttcccctccccgccgtcggggatcctgggcgaagcccccagagaccggcgcaggcggctggtgcgcagccagggcccagcgccaggtcttgctcgcccagtgccctctctgcctacccttccctttgcgctctggaagcccgggagccgggcacgggccagcatctgcaagatgccactactctggaagcccactccgattctcccaggtcgcaggaaggagagagctaggctggggcaaaggagatggggcagagctggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcggcggggcgggggcgggggcgggtggcgcggcctggtccgctggccccgacccgcccctgcgccccgcgaccctcccgaggctcgcacggcgcccggctccgtcccgggctgggctgcgcaccgcgcctcctgctcccagagctcgcagccgactgtgcgggagctctcaccgccgcccgcgagggcccgccccgccggggcccgccacctccgccccggcccggcccggcccgctgcccctcgaggcccctcccgccgcattcccgggcccctctcccctctccggaaccgcgtccccagacctgacactcggggcaagtgcgcctcg

SEQ ID NO: 5150 - DNA, 564 bp, Homo sapiens
  source 1..564: mol_type = unassigned DNA
ccgaccccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggcgggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcg

SEQ ID NO: 5151 - DNA, 3277 bp, Homo sapiens
  source 1..3277: mol_type = unassigned DNA
gcggctgtactgctgcggggtgcaagggcgggggaaaccacaccgttaggcgaggcgcggggaccgtgctggaaggcccgcggcgcggtcccctctgggcgactgcgggggcggcctggcagggagctggggcgagtggccgccgcggggcctcgcaggcgcggggaggcaccggccgggcacccgcgcggctgaggcgagggcgggggatgcctggccgggtagggaacggggtgggggagggcagaggggcgagcgagccggagggggaaccggagccgagggcgcgcgcggacctcgaggttctccaggcgggttttgagcgattgcaaagtttgcccgagttggctgagcgtctcggcggccggtgtccgggacaggtcgcccatggtgttcttgcccgagccgggctgcttgcggccgccgcccgcccgggcctcgccggctccggggtccagcgtgctctggctctcgcagcggcccagcttggcggtcagctcgcggatggtctccttctggctcaggatggtctccttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgcccaaggacccaggtcgtcaacacccgagtgcccggtggtcaacggctcggagtggggcctcgcggcgccactaagtccagagcgggggtcaccgggccgccccgcgtttcttagatgtccgtgtgctattgagaagccgccgggcagcctgggtacagggacttcccacgggtcggggcccccggcgcctcccctcccccagctcccgggctctgtggacccggccccgtccccgggggactgtcagtccccaccccgtgcgggcggggcgctggggacttctcggaggcagacctagctgatcgagcctttcctgtccgcggcgccggcccgatcgcgggcaggcggcgtcgccggggctggacgttcgcagcggcgcttcggaagggggccccgcgggagcagccgcccgcgtctccagcagcttccccttgccaggcgccgcgcgcgcccggtatccccgggtgtccacctgtgcgtggggggctgtttcccgtctgtccagccgcgcccacttctcaggcccaaaggccagcaggaagggtcccggaggtggctgggggcgtccacctgagaagctccgctctcgctcagacaccccacccggcacccgcgcactcgcgccttcatctggaccgcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctgcgttctcgttgtctccttcggccgccgcttcctggcgccagagggaccccgcggcccgcacgggcctgtcctcggctccgctcggagggtgtgcgggttcccgctccgctggccccgcttgcccaccacggcgcgcccaaacccacgcggcccgcggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggaggccgcgcccgtcaggcctggagccggaccgtgcccagccgagagcgcgcgggcgcgggagaggagccctgccctgcccagggcaggctgtttagacggggcgggaacccttagcctggccccgcgtctctatccccagcagccgtggagccttcctagccgcccaaggccagggaccctgcctggcttttcctccagggcagcagatctcagcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcg

SEQ ID NO: 5152 - DNA, 5692 bp, Homo sapiens
  source 1..5692: mol_type = unassigned DNA
gcgcgtccccgcagcccgccggccacgcaccgcacgcacgcgtcctccccgcgcggggtggcggccggcgggagccacgtggagcagccgcggtgcctccggccacgcctggctcccgatgccgcgaagggggtcttggggcaggccccgctccccgaagctgtcgctgcggctcctgccagccgggagacgacgaggggaaggggtgggccgcgctgggccttccgtccatccgtccttccccagctctgcgggggctaaatccgtcttcaacaaacctcgcgaaaaagccgagggggggacgcgccgttgctggagaataggtcagaagtgacagcagaatgggccgctgagacccccgtccccgccccggtcctccgtcggcctggcgggcggcgacgtggggaggggccgctcagaagccggggtcgcccgggccggggaacttcctcgcgccgacgcccactccccacgggccgcactcgccgaggggccgaaaggggctccagtggaggacgcggtgggagctgggtcccgctctagctgccgacgccggcggtgcccgggtctccgggagcgcagtttttggcacaaagtagcgccgaagaccctgccgggtgtcccgccgcggctgccgctgtgcccgcgcagggccggctcgtgaatgcgtgcgggggctttcgagggcgcttcctctaccctgcgcgcccgggggagctgtccggtcgccgccggcaggcagaggcttcgggccccatgggtgcccccgagaccccggatcgtgcgctgagaatgtcgacgtttcaaacgagccagcagagcgggccggagccttggtcgggaaccggcgccgcgtgcgcactggccggcgaggcctctggcccgccggggaaggagcccagagcgcctgtctccccggtagaaaccaacacacacaaataattatccgtatttcccacactgggggattgggagtaaggagcaaggataggggaggggacaggatccaacccgctggttttttactttaaaaattatatattttatgtcacgatcgcttttcgttaagaccacaaacatccaatttggcttggcgtaataaaatcagccggagctcccttaaacggagccattccggtgaattaagttgtgaaatctaatctattatatccataaaggagaatgctttcattgtaaattcaggttacaaagaaactatacctgggccgccggcctccctttcggatttactacttgaaggcttatcaaattacttcaaaatgctgggctaccccctccatatctcatggcaacaaaaattaaacgtggcaacatttcttttaatagtaggaaaggtcaaaaacaaccgccacaacaaggggatataatttttaaaagacatccttccccaccccgggatgtcttctccgcgtttggaagcgcccttcctattttcccaattaattcgagtttttaaaatatctaaacgcgccacgacttccttcaggttctcccccgctccacgaggcgtctgaggcgcagctcccggatggatcgcacgtggggccgcagaccctgggcgcccggacgtcagccggaggcgcggggatctcgtggctccgctgcgaacctgcgccccaccgcggcccgcacacctgggccgagccggggccgcctcgggagcccctcgctggctcctgggcgccccactcggctcagcaatgtccgggccagacaaaggagtcgccagggaggggttaatccgcccctcacccttctccgtccttccttccgcccccttctcaggcggcgcggaggagagaagatgcggcccctaataatgtgtttggtttaacctgcggggtgtgggtatttgctgcgctttcttgggtgagggttgggccccttcccttccaccttcctccactcctgtgcatgataccctggctggggcctggggcgtcctgcgctggccagaagtcagggtcaccagggactctccgttctcgctcccgaagaggggacttgcgcggacggcgaggaggatcgatgcgttcctgagttcccagggaaacgaggccgcggctgttgtcacgtcgcgaggaagatttatgaggcgcgggccgagcatggcccggcccggcggaggccgcccgcgcacccaggctaatctttgatttccatctgattattttttttttcctgccatctccaagtcggcgtccggaaaggcgaacaaagggaggaggatgggggatgggggcgccaagcggtggcgagggctcggtccggcaaccttcctcctcagtgggggcccttgggcgccccaggctcgcgcccaatgcggggcccaggagggcgcagtttgaaaggtgaccgggctggggctgtcggagacccgctctgcggggtggcccttctagccgctaggcccacgacaggacttctagggaggggtccctgcaaatgcccttgggcgaagagaggacggaaagaatattctcccttaaattgcaattaagggtgtgcggggcgggggtgcttggggggtgctgcggcaggccgggttcgctcaaccggaggcagcagctcagccctgggccgataaggccgagggaaacgggatttctttgcttcccgcacggaaaagatccatccaagcgggtaagagggaagcgaagcttgcattttttatgttgaaaaaaaaattcaaaatggaaaatcattttattggtcaccacccataagtaaactaaaaacagggataattagagtgtggggatttggagggaccataaatctgcggcgccttttccactggaatcaggagcctttatggcttgttgttttattttgagagaaatgagatccctggctttggtgcaggcgggtgtgcgctccgagcgtctttcggcgggggggaggggggagcaggaggggcgaggagacttgcgcagtcagggagccgcgaaccccgagtctcggtcctcgaaggcggcaggagaaaccgcgcgctgtgccccgacctctctcgccctggccaaccgcgacttgggacgagctggaggagcttcccccgggctccggacgcccgcgccgaaaaccgggccatgggtaccaaacccgactctaggcggtcattcactttgtccccacccaaactctgatgagctatttgggagtgcgcggggactgggaagtgagggacttttataacattcttctttcgactccggcttccgagcccaccacccatcttgcctccttcgcctccgccctttgttctaaactggggaggggggaggggggagagaaaaggacacaaaatcaccgcccccccgtcaaatccttaaatttccaatcttccgcaaaatggcctggaatccatttcactccataggggttctatcccccaccgggtggaggccagctttccaatctcccacacaagcaggatcctttcccacttctgaaagtcttcaaacccagtcaccccaaatgcaaacatcgtgtgaaaccccattaatcaggtaagaaagtagggagagctctgactcagctgcctctaattttgggaggagaaagagaaagtgagtttctctttcatcaagtaccccaaaataacagcgctccttcccttcagcccgctccaaccgcagccttgcctttgttgaaagacccctgtccttcctaggaaggggggcggggaggacaggctcacattccgaagagttctgtccccaaaactgttcgaagattcttttgtttgacgtgcacatgggggaggggaaggagcccgctcaggccacccggcctcctcggaccccgctcaggccacccggcctcctcggaccccgctcaggccacccggcctcctcggaccccgcccaggccacccggcctcctcggaccccgcagaatacccccaaagcccatgggcgtctcctaaccgtgtaagtccggggctccgggggctaggaggggctgctccaagacaagggaagctgcccgccagattggggccaatatcgggctttcccaacccaagcttcctccgaaaacaaccccctcaaaactgagcatccctactagaaaaaatccgcattttccaggaggacggggtgggagagcttcggggaacaaagcccggtcctcccagctctgaggccgaggcagggcgcacctcctcctgggcgaattcaatcggagctgcagaagagacaagcatttccaaactggcacccgctccgagcccaaggtgagggtggagaagggtccctggtggaagctgcaggaacactttgggccggggtctaccccgcgttcggcggctccccgaatcccgcagaaagacacgtttgcagcgaaaggctcttacacaccagccgggattttattcgttccctaccgagagtgcgctctgggagcgcgggaaacaaggaaaacgcacgtacctggcggcgctccgagggcggcctcgcgggccctccgctggcgaaggcccccagaagccactccccgcccggctgctcgccccacggccagtccctccctccccggcgacgcaccccgccgagccagctcacaggaagcgccaggagccggagacctggctcgcctttccgggcgctgcgtccgtcttcgaccgccagggcccgcgtcctctccccggccacggcccaccagagggaccccgcggcgggtcctggctcgggcgcgtccttctgcgtccgagttcccaggttcccggccgagctgcggagacggacgcggagccctcggggaagacgaggcggcggcggccgccgtccgggcaggagccccggggcgggaggggtgcagggcggaggagcgggcgggatcccagcgccccgcgccccgcggccgccgccctccggggcgcccagccccacccacgtggaaccgccccgcccccgccgccccgcccccacgagggaaggcacccgagcctcgccgcacacccgcgcctcccggtcccgggcccgaaacaccgcgcccctcccccagcgccgtgctccccgcctctccagcgcgcggctcccgcccgacccgcgcgcccgcccgacccgcccccaaccccgcccaatcaccgccctccgcggctgctccctttgtctgagcccccggcgcaggccaatggaatcacgcggaggcgcgggcggcttggccaatggaaggcccagggggcgtggctggcgggaggggctgcgggcggccgggttctatgcgctgagacccgagactgcgtcgccggcgggtgcgcccaggtcgcccagctagagccggcaggatcccgccgccgggttgtgggtttttgactctccctccgctgtcgggagaagcgcctgagtggggagggaggtgggaggaggtggccccgcgtcgggggtgcggggagcgggacggcggcttggatggacacggtcagccccgggccggagagggttcggctcagagcagcctgggttctgttcagagccctactgtgcacgtttccgcgaggatctgcggagagacgtgcaggcgacgcaggccccgggaaggaaggagggtacctgggctcggacgagcgataacgctgtgttctgtgactccgtacaaacggatcctggagtccagggaaagcgtcccaggcccccagcccgggcagggttcgtgggattggcgtccg

SEQ ID NO: 5153 - DNA, 7937 bp, Homo sapiens
  source 1..7937: mol_type = unassigned DNA
gcgccgtctgcgaggggcgccctgcgtggacccggggcctcggggcgcgtccacttacccgagccaggagagactgggccccacggtgttagccccgcgctcgggctcgcgcgccgcttccagctcgcgcctcctccatccccggagggctccgcgggtccccggcgacgggtccctgcccagggtccgggaaccttcccctcccctcctttctcaagcgccatttctccggagccgggccggccgtcctcggtgtacgcgggaagcgggcagcctccgcctgcacccgcggggccgggacccggaggcacccgcttccccgacacactcgctggggccgctgctcgctgctccagcctcccgaggccacggcaagagcccgggggtcggcgccacacacccccagccggcgaccgcgcccagggacctaattcaatcgcccccagcctaatgaatagccgcgcgctaatcggatctccgcgcgcttcggggatttacgcttcccggctctccccctcgtgccccgcggcccgccagacgtcgcttccgaaggcgccggcctggggcctggccaggggctcggccgcggggggtcccggccgccggagccgggagacgccggagacgggagccgggcccgcgcgaccgccactcccgagccagccggggtgggccccgcgccttgtcctgcgtccccggcccggcccgcggagcgccggtgcttacctgcgagccccgggctctccggagctcccctccgggccgagccgcccgaagcgggcgccggcgtaggccccgactcaggcaggcgggaaatcccggagtccccgcccgcggcccgcagccccccaccccaggtcggcgtggcctgcgggggggaaggccggccggggccggccgcccgcttcccctttctctccagattcctttgatccgcgggctctccgccgcacctcggctcccgggctgccccggtcggcccgcggggatcctggaaacggtccccagcttatctcctttcatcaagcggccttgggccgccttgaaaccgcggagccagtaattgcttttttcaggaggcccagtgcggactggacaacagccaatcagcgccttgtttacactcggtgatggacagtccactggcggagtgccaaccaatcccagcggtcccgcgggagcgggagtgggggcggggaaacagagagacaacaggctttgagtttaactctttcgtgtccctgccggaatgagacggtggagaatttcgaatgcgtgtgaatctgtcagttggctcctagtttaaatatccttttttcccccagagggggaggcagagattcacatggagaaagaggagcaaaaataaatgtatccatcgccactaagacatcacctcgactccctgagaataaatagcatttgggtgggaaaccaaattctaacagaaatatttgtttgcggaatattttagaagtggtttgcatctgattacgataaaaattgttcagtggcttgctttagttggagtgaggatttagcagataggcagacagggagcagcattgagaaatactatacatggtttaccacaccatacccgcttcccccattaccaaactgaaaatattttctaaatctaggtgtagatgaagaaagggcaatccttgtcttctcaataaatccctgattttcattttagtagctgctctgttgcaaagtgtggcagagggagataaaattgagagccagtaatgtagacggctggagactcagaactcacttcccagggtctgatccccaggtcatggggaggagagagccggacgggctattcaaagcttttgctgcccaagcagcgggcgtgcgtgcgtgcatccgcgagctcgggtccgggcaggcagcagcttcagagcggtagatgggccaggcaacctggggaggcctctgggcttggaggtctggcctacctgccacctgccagacagattccagggagaaaaagcagctacttttaaggggtggtggtgtttcttcccttggccttctgtgcggcagaagccaaacgttagacctgctggattaaacatatatgtgtgtgtgtgtgtctgtgtctgtgtctacgcctccccctccgccgggacacgcgcactcgctcgctccagctccctctcccgccctgcgccaccacattcccattcagcagcaatgatctgcgcagaggagctgcgcagtcgccgggcttgaattaggcgccatcgggcttggtagtagccccgctgcttcctgattggcagttccctggcccggcgccagcctattgggaggcctgtttacgccgaatgagtggcacgagctcccggccgtggagggctgcgcggccaatcagcgcgctggctgttccgggctgagtggcacgagcttattagtatgcagggcccgtggctcgccgcgccaggctgcaggtttgagagccgctctggatgggctcgctagagtcgttgttgtggaagcggtgcatttacagtgcaacagtcagcacattgaaaataccaataggaatacaaaacaaagtcacatttactgatttaattgtattgcattcagttgtatccaggaaacagcctccagtaagtaactgaaattgctttcattttttttttgtttttgtatttttattattattttattttttattctggctttggggttttacattttttttagcaaaagaaattcaggattgtgatgttaagaagtatatatcttcccttttaacaaaatccgttaaaatgttgaggcttttttttttcttaaaaaatatggactatgagcgatttttttttctctgaaaaatcttatcgatcggtttaaaattacccccgtaatgcatccttgctttgctctgagcgcttgttgtctcgatcgacacccagcattaaaaacaaatactcgaagacaggacagggaccgccaggctgcgtctggcgcgagccgcgcgggtggcaccgggcggacagtaggcgaagtccgggcgccgccagcgtgcgcccagttctgggtgacccacgaacgaaccccaacattcgctcccctaccctgctcccctccccggaacagtcctgggttggccctgcccggtcggtccgcggcgaggggaactggccgggtcgtggtacccacggccgctgccctgaggggccttccgggccgaagctaggggccggggaggggaatggtcatggcgagtttttcgggtcttcgttcccaattcagaattttttttttccggagaagtgggggtggaggagggggaccgagcaaggccggcgcagcggggcgttttcaccgcgcgcgttcgggacggcgcgcggggctcgggtcacggcccgtgtggcggggtccgcgggctggttttcttcgggcgcgggggtcaggcgcgaccccagttctcatgactctcccagggagcgggtgcggctgtttcgcagggagcgggttctgcggcgacggccgagccactcgcgccccaaggcgcgcctggtcccagcccggcctgcaggccccaccgcgcccgcgctcccggagacgacgccggagggaggcagacgggccagagtcctggtctccggcaggcgggcgaggagagagcgggtttttagatgcaaaagcaggaaacaaagcaaacttgtagaagctccagatcctggagcgcgccagccacgcctggggccgcggcaagagggaccggcggctccagggtcacgccctgccttcccgggagggagccctgtgctcctaggttcagttccttccgaaatgccctcgtcagcgattctccgcccgcccggggccctctgcccgccgccacttttcgctccatttcctcccttacctcagcccgacctggcgctgcggcgccgtcctcgcggtcctccggcgcggcctctcctggagctgggctgggagtgggccccgggcctcggcactcggcgggtggcggcgtcgccgctgcgggactgtgggactcccagctcgggccgtgtggccgcccttcctcgccccacttcctggccgcctcaggctccccaggcccccgaagcccggcgcgggcagacgcggaggcgcggcgcggcctctccccgggaggagagaacacaaagaaaagctctctccaatccggtcagagccgtggcggcgcaggcaggcgacagtaatccacctcctgtttgcttaaaaagtcgagcaggctggtgagaaaggaacaatcgggcctgcgatccgcccgcagggggtgggagattaaaattgttgcttcgtagccgagcccgcgtcccgagaatcgccggcagctcgcgctttctcaactttgaaatttcttattggagagaaaaaaaaaaaaaaaaacaaccacaaaacaaaagcacagcacacacgactccctggaggccgccaggaagcctggcacccccgcgtgcgcagcccccggcccctctccggccttcggcgcctttgaagctgcaggtttctgacctccctccctttccttctttccctttgtcccgcccggcgccctccggggctcgggaggcgccggccggggctgggggcccccacgtccctagtccagcccgggcagcccctcccctgacccctgcgctcgcagccccctcgccagagcactctccgggccctggcggccgggcgctcgctttgcaggccgggatcggggcttgggagccgagctatttgttagacccggggagagagctggcgatccccagagggaagggagccccaaacgcctttgtatgtagttgccagacaaagagaactctttgtgtagacccatttatttacaatgcaaaagctctccgaataaatattaaaaaagcttatcagctgagcaaatatgtattcacttaatacattatgttttcggttatagattaaatcaaacacaaaatagtctgcaaataagacgttttagaacccggaccataaaatatcgcaatttaaaaaggtattcagtagatggaaaacatcttaatcgctttgttgtcatggtggaatggctacaaaaacacaaggttttccgcaaagttcctaattaggaatatcaagcctatccatctcccttttgttggaggtgataaacattaaaacaatacgtatttagaagatgaggagtaatatgtgaagtgcgtccagggagcgccttcggagggacgcctgggagcacggtggtgcacgcagcttctatcactggctccgaccctccgcacccagagtctaaaattgtccccaatttcgcctgagtggatgctccgcgttgggtgggggtggaagaaaatggaggtgagggttattttaggtggccgaggtccgggcagggtctgctggcagaaggttgtgctgggccgggcccaccttccccggctagagggccgagctgggcgccgcagaccccgcgtacccaggccgcccggtactgcccggagcggagaccggcctctgctcgcggtccccggcaggcgctgaaggaagaaatcccagggccgatttgggccgttgagagagagcattctgactctgaaagcaccccccccacacacacccccaagcccccaatccgcagaggaagatcctgggcgaatttgattggggggcggggtgattgttacagcctcaacaggaagctcccggctccgggacagcaggccgggcactgcggcgtggcggcccaggtgatgccggtggcggttgcgggcctccggggctctgaggagccggcctggggtcctagcgcgatgctggggacaggagctggtcccgctggggctggggaggggggaccacggtggattcagaagaatgggccgaaagatgcatgagggggatgggagtggggagaaaaggaaggttattaaaaaaaaaaaaaactcttgagttacaatcaataaaattactcgcttaattagcatggttattcggttaagcggaatgcagtaaaagctggacctcggcatgaggtggggagagggggagagctagtgtggaccccaggccttttcctccgagacacctttgggcagcgggggaggggagagggtgtgcgtgtgagtgtgtgtgtgtgtgtgtgtgtgtgcgagtgtgcgtgatggcttcgcagatttgggtttttatcacccagcagagccagcagcctcttcgccgcggcgccctagctgcagggacccgcggggacgagaacgggaggcggcgagcagtgcggctgggttcccccggctgccccgggccaagcgtggccgggacggtgcgtgcgcgcgcggggccccgggtgctgggctgcgcgcgcgtgcggcggggagacaccgagcgccccggccccgccacccggcctggccgccgctcgctcgggccggcgggggtggggggtggggggagtgggtgagcgggcggggcggggacccccgggcgagccgagccccccagtcacccgtgtctcctctgcttttgcctccacagaccatggacccgcacagcggccgctggctcggtgcgcggccgcccgccgagaagcccagtcctcccgcgtgctgaccggccccgccgccaccaccgcctgtgaccccggacgccgccgcctctgcgccgcccgcgcgccgagccgcccccgggccccggccgcgctgctccgaggaagcggcggcggaccggggccggggcccggcatggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacaggtcagtgctcggccggggcgggcgcgggacgggagcgttcgagagcggaacagggcgcccacccctccgctcccgggagcagagaagctttggtttcatttcccggccccggccgcggtggctgcctgggcgctgagcggggccgcgcgtcccgccagccccccaagctgcgtcgccgcggcttagagaggcccttccctggccaccctcccccgggggtctcggaggggcagccccggagccggctgaaattaaagcctttccgcgcctcgccaccctcccccgccccctcctgcagatctaaattccacggaaacctcttttctgcattctgcattcacctccctaagacgttccggggctgggacaacgaggcgctttctgcggaaacaaaacggctgttgtggcggggggaggggaccagggtacgccgcggcctcgcggattagagtggtgtgtgcgccgggcgagcgttaatagggactgctggtgtaagacgagcaaatcctgtttctatataaagccttaaagtgtcagggcgagaatgggtttgcagggatgcatttgccttaacgagtgcctctggtatcccgctaaagccggacaaagcgtggccagagtgcggcccagcctctcagcctgcggcccggggaggagggcagcgcgggcgcgggctgggggtggcgcggggcggcgctcaggatttcggtgcaggcgagagtgcggcggatttgctccaagaggagagcgaggcggatttgctccaagaggagagcgtggggcgccgtgctgggcctcgcagggacggatcctctcgggcggtcccctctgactccctgcccgagaggatcagtccttggcagagcgggcccaggcctccagggcagccctcttcccggtggctttgatatgagtgtcgagggaggtcagggtaggggcagctaccacgcctgaagccctagaggtcaccaggcggcgcgggtagattcgggggaagcgcgcagggctgcgctagggacccgccg

SEQ ID NO: 5154 - DNA, 1408 bp, Homo sapiens
  source 1..1408: mol_type = unassigned DNA
ccgaggtctcccgacgtggacacctaacgcccttggaaagggagtgaattggtaggatatcatcgctccggttagttccgcgggagctgcccttcagaaaaaaaactttccagagccaaaagttactttccaagcgccttggggcttcccgggcgcctccctcggacggcaaccctagaagtcaaagcgattgcatcgccaggtctgtggcggctggaagcggggtgaccgcggtcagatggcatttcgcacccacgcagggctgtgttatcctagcacagaaccagcaactctcacacgaagccttgtgtaaacaccacgcgggcccattcctgaacgactctttgatgcctccgctgcggttacttatctcatacataaatcaggattccgctgacaaatctccgtgtttccactaaacagaaggctgccctgcagtccttctcgtgcttctttctaaagtacgataacatctgacacttccataaaccggcctgcagaggacaccgcgcagggggcgactaaccagctgaggtgtgtcaccccaaaacaccagtgggcacaccccaaggcgggcacgtggaagggacgcggaaccgagggcaactattttccagtcggtgaatctgatggagaaagatgccaaatgcacttcccgagccagctgaactcctcgggcacctaatcattgccagatgtggcgagggcgcacggagaacatccccagtcccggagaaaacacccggccgccagcgcggggaccgctcgggccgggaaacggctagaggcgggaggagagaggactgggcgagcgtggggagcgctgcggcgtggaaaagcgaccgggagggatggcgatgcctccactctcctcggcaggttttttcaattaaaaagttggaaacgggaatccgtaaacaacgacttagggcttcaaactacttgcaaagacgcgatggggaggggaatacttgcgcgcttcaaaaccccaacctcgaggtctccagccgcgcctgacccgggagccgggtgcgcccccagtgtccgcgcacgaacccggcgccctggcagccccgactccccgggcccgcagcccaagggaaggttcgcgcgggaggcacctccgtggcctcccgcgcgccccgaagcccgttccccccgcccagagccccgcggagctgccgccgccctacctttcatggtgaccgtggggacgcaccgccggccggggagctccgcgcgagcgccgcgcagccgaggaagtcgtcccgagcggctgctcaccgcacgcccatggtagccgcgccgcgcgccggccgtctgcgcccccgtcctccctcgccgccgccggcccgcgctccccgcgctcccggctccgcgctctgctgcctcggggctgccgcgcgcg

SEQ ID NO: 5155 - DNA, 208 bp, Homo sapiens
  source 1..208: mol_type = unassigned DNA
gcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcg

SEQ ID NO: 5156 - DNA, 805 bp, Homo sapiens
  source 1..805: mol_type = unassigned DNA
tcgccccctgtcccccgcacctccccgggggaggggccggcccgcgctcgcccccagcccgaggggcaacttaaaacatggcgccccgggcgggggatttgtgcaaattggcggagaagggacgcggggaccgagtcgccccttcggccagggatcccagggaggcccccaggccggaggccggggctcaggctctgcgcgccggcccagccactactgcgccgcggcgggcggagcgggcggggggcgcggcgcgcaggctcggcccggtgggggtcccggcgagcgggagggcggttggggaccccggccgcgccgggcgcggggctcgggattcgggagaccgcgcggcgccgaagccacgcgtcagccccactgtcccgcgcgcctcgccccaggcctcgggctcttcctccgcacctcgtaaagccgagaccccctcgcagtcccccactccgagaggcggaaaagttacctgggatcagcagggagcccgggcgcgccgcggcgtggggactaggctcgggcgcgcgtcctcggcggcggtgcgcaggagactcgggcgtggggaggaagccgcagcccagggctgctcgccgctgttccccccgccccctgttgcaggagacaccgaggctccgcggagctgcggcgggggcccacgcccagagaccgtgcgaggaaagccaacctcgtcctgcctgccctcccagccgcgggggagggggccaccgcagtacttcaggacagttacatgggcacagcctcctccgtcctggcgcagggtcaggctccgcggacgacg

SEQ ID NO: 5157 - DNA, 2462 bp, Homo sapiens
  source 1..2462: mol_type = unassigned DNA
tcgcggcccagtcttaatccatcgcacttcagagggaattacgagggagttgcggactggcgggggcgggggtctgtaactaacaccaggtgcctgtgagagagccccaagggcgggggcagcacctcctggctgggttgggtccgcctggcctcgcctcgcctccgggatccttggcgctcagcgccgccctcccgctactgcgctacccgccagagcccggcgtcttccctttccttgtcttgtggacgccgcccttcgctcccgggaggatttcgcctccagcacctcaggcttttctggcgcaaaggtcgccagcccgagcgagcccaggcggcggcttcacttctgcagagggaaagcgaaagacgcggccggcgggccgagggggcggccgaacgcgccgcgtggttgctgctcccgaatccgcagcggcggcgccagggcggtcaccgagccctgcggaccccggctcaacttccagcgccactcgggtgccccgagcccgccgcagctcccggcgcgccctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgcgcctctgcctcccggaggatcgcactcgctcatccttacacaccacacacacacacacacacacacacacacacacactgccgctagcgccccccacgccacaagccggaatgcggaggtcagagccactgtccacttgaaagcaggaaagcaggggctgaaacgctgagatggaggcggaggctctggcctcatctgcgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagcccacaactaggctgccgggaccggggagccagaccccaggtcgctccaactccggcgagggcggggaggggagtgacagcagcaactagcgcgcgctggcaaaagcacagagtctcggaataggctaaacggccggcgcggaggggtggaggcaagagggggcggaggaggagttgcccgagcggagagggatgacgtcctccagggccttgggctccgaggaaccgaagactggtgcgctcgccgggccccgcgcactagctctggggttcgcagaggcgccgcgcccggcttccgcggcagctccaacacagcgcgcaggcggtcgatcccggtcagcttaaaccgggcgcaagccctctgtccccctcaaagcacctctctgctcgtccctagtctccaggtgcccgtctgagagtccctgtcgcctccgggcggacccggccaggcagcccccggtcgggccagcctcgccccttcctcgctttctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcgggcgcctgtgacagcccgcgccgctcagccctcgcgggcccgccctccccgtccgctcgttggctgcgcccggtgcccgggcggtccccgcgctctgccccgccctgagcccgcctcccagccgcgcgctcg

SEQ ID NO: 5158 - DNA, 990 bp, Homo sapiens
  source 1..990: mol_type = unassigned DNA
acgtggtgtgtgtgtgcgcgcgcgagtgtgtgagcgccaggggccgcccgcccgccgcggctccccgtgggctggccgggccaatgagcgcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcg

SEQ ID NO: 5159 - DNA, 2274 bp, Homo sapiens
  source 1..2274: mol_type = unassigned DNA
ccgccttccgtgtactgcctgcggctcgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccggcgcccgccaacttcgctccgcccgcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttgagtccctggccggctgcaaaaggaacagcagaaaactttgcttgaagttcccagttgcagccgccgggccgcctggcgtaggcgctgcgcggtccccgccgaccccgagcagcggccgggcccaggccgctggtgttcggctgcgcccgcagcgatcgccgggaactggcggccgctccggcggcggcgatctcccggtgccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagcgggcaggtccccaggccctggccacggccctgcgccccgctgggctccccctccccaccctcgtccccctagcggagcgccgcggccagctgcaacttgttcatccagcccggctgcccgggggtcccaggtgggaaggagaggcactggcggtgtgcgagcaagcgtgtgagtgtgtgcgcgtgtgtgcctgcacgcgcgcgcgggggcgttctaagcccagaggaacccctcacggagaggatctgtggatcggagtcgggggtccggcgtgggggcgaacccggcacg

SEQ ID NO: 5160 - DNA, 882 bp, Homo sapiens
  source 1..882: mol_type = unassigned DNA
gcgaagtgaccccctacgcctggacaaagcgctcgaaagcccaggcccgcgggttagctccagccgctgggcttgacaggggtcagggaggcgggccggccccacagccaagtcacagctccagggcctggtcgcacctgagcagcgcggcctcgggctgctgctggcgctgcaggctccgcgcctgaccctccagcctgcgcagcgggcactcggccgggaagaacctctccagcaggcggctcagcactacgttcacgcgcccgcgcccgcgcccgcgcccgtggccgcgcgggccccagctccacgcagcgctcacagaccgtgagcccgcagggcagtgtcaccggcttgtgcagcagccccgggcagccaagcaggtcgcggggcgcgccgggcgccagggccggccctccctagccttgagctcgccgcccggcttcctcgccaacagtggccgttcgcgcaggccgggacacaccaggccgcccgccagctcccccagctcctccggccgcagcgcctccagcctcccggctacacggaacgcgcccagggccaccgggaggcggccggcgcgggtcagagcgtcccccagcctcaggcaccggccgcggtcgggctgcgccagccgggccagcatggagcggaagagcccgactgctttctggtactcgctcgcgcggaaggcctcgtcgccctcctccaagcgctgggcgattggcttcccgcagcagcagcccgtcactggggcggcggcgggaccggctcagtgctgatccccgcggggctgagaccgtgcgggcctggagcgaaggcgcggagcaggggcgatgagctgctgctgggaactggccggcgggagcgcggccacagccttcg

SEQ ID NO: 5161 - DNA, 4359 bp, Homo sapiens
  source 1..4359: mol_type = unassigned DNA
tcgtgtttcacggaaaccaccaccaccgcatccacaggctccgaggggcggatacaaagtcttttgggggaagtggggccgcagatttcccccgacccgaacacagactcgtacagggcgcgcttgggcgcagcctcggatttcacgtcgggcccgacctggctgtctttggggaggatgtaagtgttccccagcgagggcggctgggggcggtggtggtgggagggatgggtgggggggtggtgggagtggtgccgtgccgccccgttcagagcctcggcgtagcagccctgcggggcgggcgagcccagcttggtgccaatgcccgcgatgctgttgagcgtggcgatggagacggcgccgatgcagtggttggtgtaggtcttggagagcttggccgccttggagagcatctgcatccgagtgcctagcaagttcttgccgatggctttgttctcgtaccaggtcacatcgccctcgctgcagtggtcccggggccgctggaagaacgccttgcagagagggttgcgtttcgacaggtacttgacgaagctggcgtaggggcagaactcggtgcccgtctcatacatgcggggcaagttctcctcgtcgctgctctcggcgcgcttcttgctccacgacgacgagcgcgacttgtggtagggcccgagggacttgaagtagacgaacttgcgaccgtcctcgtccatggccagcccaaaagagtcctcctccaactcacgctggttctcgcggccgcgggtacagaagtacatgcacgtctcgaaccagaccttgttgagcagcccgaagggcgtgttggtgctgaagacgctggaggtgtacagcttgcgcaggtcggcgcgcgtgatggcttgcttctgcaccaccggcccggcgccctgctcctcgagcttgcggatgaccgcggccagcgtcaggttggcgctgcgcagctcggggtccttggtgaggtcgagcgtgcggcagtacgggggctcattgaggtagcggttgagggagctgcggatgctgatgagcgacgacttgctgtagagctggccgcttttggagcgggcctcggcatagaaggagcgcagcacgcggcacagcgcccccttgtccatggtctcgaagtccgggctctgcgccttctcgctcaggtactcccggaagatgcgcacggcgtagcgggtggccagccgggtgttctcgctcagccgggcccgctcggggcgctgcagcacgtcggggtccagctcggagccgtccccgggcggcccaccgcgggcccggggcgccagcagtcgcggcggcgcctcgggctccagcgcggcgctctggtccatattgatcatatggaccggctcgggctccagctcctccccggccgagtcctcgggctccaggggctcgtcccagtccagccccatctcctcctcttcctcctcctcctcgtcctcctccagccccccacctccgtcctcctcctcctcctcgtcccccgttatctgcacctcctggatctcgtcctcctcctcctcttcctcctcctcctcgcccgcgctgcagtagtgcggacggctgtggcggcggccgcggccccccgcgccgcgctcgccctcgccccgctccccattgttctcggcggcggcggcggcagcgctggcgctgccgcccgcgctggtgttacagtccccgctgccaggcattctcgccatattgccgtctctctgccagtcctcgggcagggcgcatgcgctatattggaccgcagcgctgagagcttttgtgtttaatgaccttcagctaccgggaggcaaagccgggctcttaaaggagccgcgctccaattgtcattcccgagcgcagctccggaggggcagcggcgcgcaggggatggaggggaggggggagggggggacaagttagaccggagagatagggtaaaggacggaggctgaccagaccttcttcctcccccacccggctcccacttctaagaaaactttgaaggaaaaaaaaaaggaaagggagggagagctgtcggtgggggcgaaacactcccaacttaccctctggcggagaattgcgcgggcccgggcgggagagagggagggccggcgagagggcgggacggtctcgtttctctaagtaatgcccgaggagcagtgccccttccactgccccctcattgccccccggagccggggggtcggggcggcggctgcgccgggcgggccgcgggtgctgccgcgggaaacccgtgtctggggccgcccggagcggagcggagcaggcaggttaatgagcagggtggaggaggcacggcgaggccccgcaccctctcggcgcccgcggccagggcgcagcgggcgaggcttgggagcgggatggggctggcggcggcggcggctcccccacctacttgctggcggcgaggcgcgggggcctggggccagccgcgcggctcccaactccctttccgactcttgcaaaggagcgaaacacgccccacgtcagccacatccctttcgacttttccaacagccacatttaagctgtcattaaagacctggggcgctccccgtaggtctggggcaagtccgcgccggtccagccagccccgggaaggagcgaggcagagaagactgggaggggccggtgggaggggagacgagggaagaggcgcttgggaccccaggggccacagggacccttccccacccgcccagggcgccgccctccctgcccctgagcaaagtgacacaactccctcgggcgaggcgctccaccaagctggagctgaagtctccctaaggcccatcgggcaggcggaaaaagcgaacttgtgtctcggccgaccctgccgcagccacaattcggcaattcggatccggagcgcactctcactcaaagtttgccaaccgccattcgttcgccctccgggctgcgctgcctcaggcgcgcgggggcgggcacctcggaaactggaaaagcagccaaagagctcgccgggtctcgctttcccataggagacactgccccacttccagccaaacgcccgcccccggcgcgcccaggctccgggcgcgtccttgcgtcgccgcctcccgctctcccggcccaggggcagcttcccagagccgccggggacctcggctgttctcttaggaggcacagcccaggccactctcggagctcgtgctgcatcctaactttcaccttctcccgcagcccgtgtgtaccctggcgcgcgggccagctgcgagtccctggggtgaggggacacgagggagtcaggtccccagcagtgcgccccggtgccaggccgtcctgctgggaggcagcctcgcctgctcctcgggtgcgtcctcgaatttacctccaagtccgaattctcggcagttaggctgtgagagttatgtcaactgcctgtttcccccttccctggccctcctgtcttgctctcaagggaagcattttacgcatcaattgaaacccatccatcaatttgcattttttttttttaagaaagaatgaaagaccaggtctcagggcagtgtgggcttctgagtgggagttgacgatgtctttttctgcagcgaacgctgctggtcctccgcgtgcctgcccggccctggacgccacccgagcttcggggaaaccgcgccaggtgtgaaacaagttagagcaagtccctgcctcgcgggccgcctccggctccttagggaaacacaagacacacagacacacacacacacacacacacacacacacacacacacaccacgctctcatccgcccggctctccgcggagaaccgtccgggaatcgtccccgaggtgcggcgcgggaggtggccggctttgttcacaatgcactgcccgccgcacccgccctggacacgtgcagaaaggcgtgctcgtttctccgaggctgcggtgagcagctaagttagttgcacactgggacccccacatacgagctggcacacactagtcacacacggctaattccagagggctggccctttgtcctgggacgctcccaggttttcgggccgcggtgcggagaactcaggtgggtgcccggcaagttacctaccaggggctgttcccccgcgaccctcgccataagcgcagggacccgggggccgcgctggctccgggctgcgctcctggcttggcaggggaccaggcccacgctgcagcctgggagcggagccgccccccaggtctccccacctctgcgggcggcggggtccacccccctcccaccagctcccctccctactgggcgagctgctttgaattgctcgcagtttgccggaggcggtgtgctgggttggacgctccg

SEQ ID NO: 5162 - DNA, 2762 bp, Homo sapiens
  source 1..2762: mol_type = unassigned DNA
acgacccgggaggagagcgtggagccgggcagggacaggcgtgccgcaccatggcgcaccatggacagggctccgcgcggcggcggcccacgaccgtctaggggttgcgggagaaagcgcgagagactgcggaggccagccccgtccagcccctgcccccgccccagcagcactcaccccccggcgggccggagcgcgccaggccctgacccgtgaagaccacggagcggggtaatccacaccacctgtctccacccccggagcaggcacttccgagctgcgtccgcacttttcggggctgccagctggcagtagagcacctctccccttgccccgagggcgacaggcagggggaccctccgtggattttcctgccccgcggcgagggtgggcacgcccctttcccgcaaccttcgagggaccccacggcaggcggagaccgacttgggaccagggcactgcacccgcccagctagagggtcccggccgaggctgtgtgaagtggcctccaggcctgggctggctggtcgggaggagcctgggggcatcctcgggttggaggcggcggaaagttgggctgcccccgggctgggaacccgcagcgtgcagtggcgagggaacctgcgcccggactggagcaggtgcttcctgccgcggaggagcctcttagtagagattaaatgaaaaggctcgctggctctctcccgagggtatgaaaagtacggaaggctccaggcaaaggcgcccccggggcgcatatagggcacaggcagccggacagagaaaggagcagccgcgtaacggaacttctcgcccgggggagatactaggcgtgagaggccagactcgttctacaggcaggcgctgaccggcagagactcctccgggcaagagggccagattttctttccaggtgggacgaacacagaatattgtgagggcaagagaagaagaaaaggaggcaactccagactgggataaagacaataggacagtagagcccttgagcaccgggaggcgcacgggtgcagggtggggtaaggtggaggcaagtcccgtaactaagacaccagagtgagaattcctactgtaaactcgcgacccatccctgcagaaataaacaaaaaaattggagcaaagtactatgcgaggggcgaaaggcacagaaaactgcaaaacctgggagttatcctgcctcaccctcctgctgcctggggacaccccccgcgagcttgctcggccccgaagaaggagcagaggggacccgcaatccagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacatggaggcggagaggggccgagcgaagagccggaggaggcggcggcggcggcggcggcggcggaggaggaggaggcagcggcagcaccaacagcggcgcggagaaacggctccaggcagtttccacccccttcccttcccctcccctccccacccccttcttcgctgctctccgctccccgccaatggagagcgagctgatgacaaatagcgggccgcggagtccgcgggactcgcaccaggagtaataaaacagacccagagatcaaggagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggcgctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgccgccgccgccctcgcccccgcctccctcctccgccgagcctccccgcccgcgtcgtggccaatcggaggccaccaagctgcggctgtagccggccggatccgcggcagccgcccgcccccgccccgccgaagcgccccgtattttgctgcagcccgcggggggtcgccggagggaagcctagagtgcgccgagcaccgccccg

SEQ ID NO: 5163 - DNA, 338 bp, Homo sapiens
  source 1..338: mol_type = unassigned DNA
ccgcgggagtcgcgcaggcgggcggccagggggagtgggcgccgcccggcagcgccccgcgccgaggcacaagcgcccgcgccgaggcacaagcgcccccgactcaccggctccgcgcgtttccccgcgcgtctcccggacccgcgcctgcccacccctccggctctgctgcggtcgaggccccaagtcggttatcccgtgtccaggcaaccgcgggggcggcggcggcggcgtgaggagcgggcggctgctgctccggggcctcctggctcgagcccttagcccccgactcccggcgtttcggcgcccgatcagcgctccaggccgcccccgctccg

SEQ ID NO: 5164 - DNA, 1435 bp, Homo sapiens
  source 1..1435: mol_type = unassigned DNA
tcgcggcaacgatctctgggagtgatcgaggcattcgggctgccccgtgcctcccgggcagcgatctaacgataaaacctgacagtgtcctggggaaaaccccacatccaccgctagcgctacattcgggctttatgccaataaggagacactgtagactatcgatcagactcgtctgctctcagagcgtgcggccgggcttccagcctggcctttaggcgcggtggcggcggtgggacacgcgccaggcgcccagagaaggacatgggacaatggcccagcccgaggacgccagacgccgccgcccgacccggggaaggaagctcctgcagccggtccgggaacccgaggcggggagggaggccagctctggaggtgcgctgccgctttaaaataaaggaccacaaagactgtacagtggggaaaacgcgcctggctaatgcgagtggggacgacttggggagggggttgaggaaggtagggggcacacgagccaacggcggctcacggctccccctctctcccgcctctctccttcctccctccccgccgggctgctccggcagacaaataacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactcggagccattgaggagctggacgatccgttcgtattttttacgggtcaccgtcttggtcttgcctgagtccccgtaagtcctgaggcaccagtcctggaactggcggtacatgtcgcgctcgctctccatgttccccgcgctcggccgctggccggatgctcccagcgcacttcgcacctgttcaccctaggctcatgaaaaatgcagccccggccacgttgcagggatgcgaggtcccggccgcagcgggagcctgctttgggtgggggaagggatgggaagaggggaggagggtccggttgggcaccagcaatcaatgccccgtgctaccaagtctggtccattcgtaattgcaacggctgtctcggacgtttttcctgttcccttagcggtcggtctctttaatattttgtgaccaggaccatcccaacaccattctggcccagaggagctgggttttcaataattaaaatcccattccttggtttattaaaaatcccaatattgaattggggtggtccctagacgcctcgcccccgggctgcgtccggggctgggcaggtggagcgcagcgccgcctccccgcgcgcgccccagaagcttccccagccactggccccgtggtccaggagtgagggctgcgcctctcccgaaagcagccgcccgcccagcgcctttgagccccgaagggcacacgggtcccg

SEQ ID NO: 5165 - DNA, 510 bp, Homo sapiens
  source 1..510: mol_type = unassigned DNA
ccgaggcgcgatagtttatcaaagacgagggctggctccttaaataaaccgcggtgatctcacttgcggcgccccctcccacgccggccccctcctcccccactagagcggcccgcgtcgactcgatgggcggactcgatcgcgcacgcggcccgcgggcccggcggaggcagctcccgctccggggacccgggacgcgccgctcccccgccccaggctgcccgcgcaggaacttcacggccacggccaagtggggcccctgtcccggatcccgttgggcccggacggccgagagcccagggatttgggggggcgcgcgggctcccgagctcaggcggggcggcgggcgccctgccgtcctctccccgcgcgccgcgccgccgcccggcctcccgaagtcgccccctgtcggcgcgtcggccgcttgcgccacggcgggcgccacttaccccgggcagagtcttctgctcgtgcagcgcgctctgggccttcagcgctgactcacgctcg

SEQ ID NO: 5166 - DNA, 2722 bp, Homo sapiens
  source 1..2722: mol_type = unassigned DNA
acggcgatggacagcaccctcggtcctcggccggccaggagcccgcgagtccgtccgctcagcgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttatatacatagagaaaatcttctttccttttattctttctcgctcacactctctcgctcctctctctcgctcgctcgcgctcacacacgcacacgcatacacacactcgggttctctccccctcggtttctctacacctcgctctccgctcgctctctgctctctctctttctcctcttctctcgctcgctcgcgctcgcgctctctctctgctctcccccctctctctctccctccctccctctcctctctctctccctctctctctccctctctctctccctctctcctctctctctcggtctgatctgattttttttttctttttttcttttttttttttttttttttttttttacattgaacagacaggatctctgtcctttccgtttaaacaggctggaccggttcaagttcccagccagaccaggggtgggggtggcgagtgtgcgcgcgcggaggagggcgcggggggccgggaatgggcgcgctgtgggggcccgcgccacggcgggcggcggccgggggcagggcggcgtggggcggcggccaccgcgcctcccccgtcggcggccccgcgccgtggcgatggtacagtccgagacggcccccggctataaatagcgccaggcgcatggctcttcgggaggcgctgagattccgggcccggcggccgcggggagcgggtgtccgtgaggagccgggcagccggcctcctctctttgccttttgggggttctttttgtaatagcagcaggtgcaactttttgtattttaaaaatagtgatttttattttcgtgtgggtatgtaggggggctttatccaccaagctatgctctattagggcgccaggcgggcgaagcaaaggcagggatggcgggcggggcggcggcggaggtggaatgggcgcttttttcttccatctggctttatttatttatttagactagaaaagcgagccggcttggagggagtccgcccggggatccgagcgcgcattcatcagtgtcgagagaaaaaaagctacataaatatatattatgtggataaatctatagacaagagctctctcgcgcgcgctctctccctgtctctctgtgtgtgtctttctctgtttttttttcctcctcgcacccccaacctgccagagcagccccacatcttcctcccgcccggcatctaccgccacccaagccacctgccaggatggggctgggagctgtcgggccgcgccggggggcagagggacggggagtagagactcggggtccgacccccgccccaacccgcttccgaaggcggaaggtgggggtccccgtcccgggcggcctcccccgccccggagagcgcggctggtcccccggtggctggcgggaggaaggtaggagtcgggcgcccctgcccgctcgcccgccggagggggaggaaggcgctgggcgcggtggccggtgagccagcgcgggggatggcttgatttgccctcgtctgctttacgggttcaaatagaatatatttttttaatcaccatcaaaagaataaagcccctgaatcgctatctgggttgccgccggaccgagactcgcgcggcgtgcgctgcccccgcgggtttcgttttcggcacctacagctcccgaggtgcgaggctgagtcgttcctgccgtggggaccgggggtcgagccgcccggtccggaccccgccggactccccgccaggcccactggggctggcatctcggctgcgcgggaaagggagtggcaggcgcggagccgggagcagggtccgagcggccccgcctgtaggggtgaatactggtggtgaacttggctggggtagcagattttcacgttaatgatatttacctgcaccccgtcctctctcatgtttgctttttcagggcagcctcttcgcttcagaagcctggcaaattgaaataacgcgcccgctcccccgcgggctgcggggctggggagctggggcggcggggctgagcggctggcctaacccccgccggccctcggctagccactttcg

SEQ ID NO: 5167 - DNA, 1133 bp, Homo sapiens
  source 1..1133: mol_type = unassigned DNA
acgacgcggtgcgccaggcagagagcctggggagtgtgcgtgtcttacctgtgtctgcatcgtgtgttccctctgtgtgtctctgagaatgcgttcttggcacgcgtcctgcgttaacaaggcgtttggtgtgtgcatgtctgtgtgacagtgcctgggtcctgtttgcggctgcttgttcgcattccagcttcccttgtgcccgcagtcaggctctacacgtgcgccagcctccgagcgcacgtccccgagtgacccgtgcgcggtgtgcagggacctcagggtcgtgtgcactaagggcgctcgtgcccgtctctctgcactaaggaacgcacctccacatgtctgagtgcacgtccctctccatgtgtgcacgttccgtgttcacgccgcccatgtctgtgcaggggcgcttcacgcgcgccctctccggcccgcgggcggccagggacccgcgctgggctccacgcttcccgtggggctgacccctccctcgcgccccgcagcgggccgcagcgattggccgccggcccccttccagccgtcacccctccctccctccgccacccgcgcgcccgcggtccccgctgtcccccgcggttccggcgaggccgcgccgcgctgcgctccgctcccattggctgcgcgcgcctttgtgtggcggcagctgcggccccagcgcctttgaatgtcgagaggggccgggaagggagcctttccatgggccatctgtctccccgccagccgccgccccaccgccgcccgcgccccgcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcg

SEQ ID NO: 5168 - DNA, 2401 bp, Homo sapiens
  source 1..2401: mol_type = unassigned DNA
tcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccg

SEQ ID NO: 5169 - DNA, 769 bp, Homo sapiens
  source 1..769: mol_type = unassigned DNA
ccgggaacgaacgtgcgtggggcagttcaaattcctgagctcagatttcgtttcccgcggtcagatggtgcggtcggtggggcccgagggatgcgcacagctgtgcctgagaggtgctgctctcccgccaccgaagtcgctgggaaattctgctgcactgagacattttaatgtcggatgttctaatcctgcgggcaaaaaaaaaaaaaaagtttgaaccaggtactgggcttttgtcacggtgaaccccacccgcgccccgcgccgtcccttcattcactcaggcgaggtggcttggatttgcacctcgttgaagaagcctcccatgcgacatctccgccagcaccccgcgcggacttggctgggcggcggcggggagtcagcttgtcaccgcacggcggccgggaccgcagcccctgggtgcgcagtgcgcctctcgctgcgccctcctagagcgcgggtcccgtgcctgtgcccggcgcgacgcgatctccctgctagtcgggctccgcgtgctccccgcgcttcccgcagcctccgcgcagcccgcagcgccctccagccccgcctcgcggccgcgggaacccggcgcctgcagccccgcccggaaccgaccgccaggcgctgttgccgccggccacgcaacgcggggcctctgcctggcaccagccccaggtgccttgtctcgggtcgtgctgtcgcgcgacactggggacccaacaggccgccggctactcagctggccccgcagcttccctgcggctcagcg

SEQ ID NO: 5170 - DNA, 1169 bp, Homo sapiens
  source 1..1169: mol_type = unassigned DNA
ccgtgctccctccgagtggacttggccccggctccaaacccagccgagggtcggctcgctcctggggacccgcggatgtcgcgagggggcgccgcgccactgaaggctgggacgggggcggtgcgcggggcggcgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagccgaaggcgaggaaggggcgcgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtgaactgggcccgctccgcgtcccgaacgttcccctaaacccacaagtcccggagaccctggggcattctgcgatttcggagtgaccggtggagcccccgcccgcgcgcctggctcccg

SEQ ID NO: 5171 - DNA, 6036 bp, Homo sapiens
  source 1..6036: mol_type = unassigned DNA
tcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccg

SEQ ID NO: 5172 - DNA, 3400 bp, Homo sapiens
  source 1..3400: mol_type = unassigned DNA
gcgtagaaccagtggcgatgggaggaaggggaccggtagagcggggctgggtaagcctccatccagccgggctgagccctggtctccgcagagcctctgcccctcccgagacacccgctacctggtgttagcggtggaccgccctgcgggggcctggcgcggctccgggctggccttgaccctgcagccccgcggagagggtaggtccgcgtggagagggacggggagccgggtcgactgcccccgggcccccagcccctgagccagccgcgtgcccacccaccgcagactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggtgcgcgcaggcaccgggacacggggcaggagcgggcgggggcggcgtggcctcgtggccgctctcaactcctccaattgcgggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggctggggtgtccgtgcgtgttagggggcccgtgggacctcccttgccgtctctcctcgcgcacggcccgggtccgccctgtagcgctcgctgtctctcccctgcctgaagcgccccaccaccgtctttcaggccccggacttggtgccgggtccaggcgtaaaggagcaggtgactctgcggccgcagcactcgctttatttcgccagagtcgcggggcgtccagaaggggcccctggactccggcgcggggccggctcagtcccgccccttgcctgcgcggagcttctggcgactcccaggccgctgctcctcgtcgggacgcctcggggacacccaggcctgcttcttcctgggctcggcgtccctggagtcccgtgcccacggccggtggcccccttcgcgtgactcccagcgctggggtagggcttcccggggctccctggcggcccgtggcctctcctctttccgcggcctctctttcttaggtctctcctccttccgcggcttctccttccgcggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcgcgcaaggcccgtcacttaaggggagatgcacaaaccaactttgggggcgtgcaagacccagccctggagaggaggctcccagaccccaccctggcggcacagcgcctttccttggaggaataggcgcacaggtggaccccagcctcgccccacctctggggagcctgcgctcaccgcggcacagctggaaagccgagcccagcagcgccaccagcgaggcgagcaccaggcacttgttgagcgacaggtctccccagggcagctcctcgctcagggccgggggcggcggcggcggctgcaggggcggcgcggtctgcgccttcttgcgcgcggggacgctccgagggcctgcgggggcaagtgcgcgctgcgctgtggtcactggctctgtgccgcccccttccccgggcgcaggggacaagagacaggcctgtgccctgaacccggctctctctgcctgcctgtgcggccccgggcgcaggtgaacccagccccgggtgccccgcagctgcacg

SEQ ID NO: 5173 - DNA, 1143 bp, Homo sapiens
  source 1..1143: mol_type = unassigned DNA
ccgaccgctagtggctgggaagtgggcggtgctggggggtgagtctcggcccctccaagatgcgcctcccatgaaatcctccagtcccacgtgtactcacacgcatacggatgcatgcacacgcacagaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccactcgggcacgcagggcgctacgcagggccgcgcacacgcttttcggccacacgcgcacagccctccacgtggacgcgcgggtacacacgcccggggctcgtagccgcgcacacccgcacccaggaaaccccagccaccaccacgcggggtccgatcgcctctgagcaccctccgccccagccgcgcacccgctgcgcgcccgggacgcgcacactcgcgcacacaccggcccttcctgcgcacgtcccgggcccacccccgcctagagccctcggggtttccccccaccccggcctcggggtctctccacgtctccccgccgacgtgctcacctgctcagggggcgcccccgagccgcgccccgcgcccgcccccaggagggcctccgcgagccggctgcacaccccgaggcggtcccggctgcacaacttggagcgagttgctccgtttcctcattttgggggcgaagaagggtcggggagtgggggaaagcgggaggcgccgcggcctgggaggcccccgcgggtcctagcgccggccgcactgcggtctcctccgcgcgccgccgccgccgccggcccctccccgccccgcctccgcggcccccggcgcctcccgcgcgccccgggcggggtcccggggcgcacgcgggctccacgcctggccctgacctggccctgtcgggcgtgcaccccccacccaccctgggaagcggggttcttggagcgtggaacgggcgccgccagtgcgcgcggcggggaccgggggtgagggagagtgagctgcccgtccggggagataagcaaggcgccaagcccg

SEQ ID NO: 5174 - DNA, 220 bp, Homo sapiens
  source 1..220: mol_type = unassigned DNA
acgtgccggtgacgcttcgtggagctggcgagcctcgcctgtcccgcgactgagcttgcggtcgccccgattctctagtagaccctggcgtggggcacctgagatctccgccactgaaaaggcgctatagaaatgcaaggaattatgattttaataaaattgtctcatttaggagcgagcttctgcgctgcctctgtcgtcggagcccgggtttgccacg

SEQ ID NO: 5175 - DNA, 1860 bp, Homo sapiens
  source 1..1860: mol_type = unassigned DNA
ccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggaggtggacgaccgggcgtccaagcacgaactttctcgccgaggcacggctgccgggctccgtcctgagggtttggggcggcgaggaccgccggggaggagggcgcgcgagccggaggccagagccgggccgggcagggcgcgcccaggagcaggggagacggcgacccgggccgaggcgggacggggacacgttacctgcccgtggagcgcggggaaggggtgcgcggcggcggcggcggcggagtctggcgcagagggcagcggcagcagcgggagcaccggctcgctcggggccggccagccggggagaccggggagcagcggggccgcgggcggcggggccgaggcgagcagcaccgggggaaccacgacccccgcgctgagccggagcagcccggccgagcccggcaccatccagacccagggcggcggcggcggcggctctgcgtccatcggccagaggagaggctgccgccgccggggctgctgctgctgcagctgccgccgccgccgctggaacctggcgcccgcctgcatcctacatccccgcgctgacggcggcggcgggggcggcgggcgcccgagatgctgggccggcggcggcgcggctccggagcgaactcacttggctccgcggcgcggccgctcgctccgcccctgccccgcgcgggaagctcctcctcctcccgcccgcgccgccgccgcccccggacccggcccccgccccggtccccgcccgcccgcgcccctccccgccggaccccgccccgccctcgcgctccccggccctggccggggtctcctccccgctgcgcccctggacccgggcggccgcggaggacgtgggtgggagagggccgagggcgcgcccggctgggctcccgccgatgccggccccctggtggcctctggccctctgggacccagcgcaccgcgagggaggctccgggctccgcactcaagggcaagcggaagccgaggtggcggcgccggagccaggcatgtcccgctgcccagcgcggggctgagggcgcagacggggaccgcgcgagccgctctctacctggcctcctcggagtccagggcgcggagggtactgggctgcggatccggcgcaggcggccccggacgctgctaggcgcgggcggatttctgttgcacaaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgccggccgagccgagcctgggtccgcactggccacgcgcagccaccgccagacggcgctagccctcccccgctgtagaccctgcttcggaggccgccagcctcctccccatcccgggtccacagcttcagtgcagcccctggcgacgcgcgctgacagctgggcagagacttccgtgcg

SEQ ID NO: 5176 - DNA, 441 bp, Homo sapiens
  source 1..441: mol_type = unassigned DNA
gcggggccttaaacgttatccaatcggggacactgggcggggggccgtccaatcaggcccgcagctggagcagacagggcggcttccgggatttggcgcggcctttgtttctcgctgccgccgaagctccaattttcgtctgtctgctttgtgtcctctgcacgtagaagcccagcctgtgtggccctgcgacctgcgggtattgggagatccacagctaagacgccagggccccctggaagcctagaaatggtgagagtgccggtccgacatcccgagagagggaacggggctggttggaaccggtgggaagcggctgtggcgggacccaggcctccccgcagtcagcttcacaatctgcgcccagagttcttgcccagctcggcctcagtccccttcagccatacgatggcggccgcgctgacagccggggccccggcg

SEQ ID NO: 5177 - DNA, 5587 bp, Homo sapiens
  source 1..5587: mol_type = unassigned DNA
gcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagataggagagacccaaggcgagccttaggactcgcccctatgactatgactacgcgctgcgtccgaaccacatgtccaccccgcatttgccttcggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggctccgggtccgccacgccggacccgctctccccgcgctgcgctgggtcggacgccaggtctgcgcgccgcggctgagcgcccactcgccctgcggaaagagccgcggaggaaccggcgggggcggctgcgggagccgaaggaggtggcaatcgggagcagaaccagaaggagacagggaggcagaagctcgcggctccgtggcacgcactccctcggccagggatgggtcccggcgcggcccagcccctgcccggcccgccgggcagagactgaaccgcggatccccaccgtcctgtggacgaccggacagagagaggcactgaccgatcgccagcagcctcccggtgggaccgcgtctcctgcacaccccgcgcagcgccccccgccggagccgcaccgggcaagccggcgagggagcggggctgattggcggccgccggcggccaggggagggggcgccgcgcggggccatggcaggctcggaggcgtcctagcccgagccggagccgatccgagcccacgcggccgccgcctctccgctcccgggcccccgccgccaccgcgccccccgcgggagatggaacagcggaaccggctcggtgccctcggatacctgccgcctctgctgctgcatgccctgctgctcttcgtggccgacggtgagcgcgggaactttgctgccgctgtggactcgggggggtctttgctggggccgccaccgagaagaagaagaaagagaacgaaccgggaagcttcgcggtctccagcaatcccgctgtgcagcctgggcccggaggggtagggagaggcgagcggcgaagggtcgccgcagcagcagcgccgcgcccgagtcgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcaggacctccagccctcaggggcacagaggggccacttctctgtggccgaaaacaggcccacgctgcctgtctgcctcaaaacccacactctcttacacactctagtgtgctcgcgtgcacacacacctacacacacacctacacctacacacacctacattctcccagggtcccacccagagttactcccactgagcctcccgctgggtgctgtccagacacagcggccctccctccagttcttcacggctcccagtgagctgggggaggattttgagccacgcggcagggcctaaggatgcccagagggaaggagaggggctttccttcccaccctggtgtccatccagtctccccagttcagccggcaggtgtgcaccagggcagccacccgttggtcaggcaccatgctagctccaaagcccgcttcctcctgggaaactcttggaaagccggacgtcctttgtgccctcaacccccatcccccgggcggtttcggtcctagcctgccggaggagggtgcccttgcctaaaggcggatccgagttcccctagccagaaggccgcgagcctcacgtctctctctccctctttgcattttaggtaacaaataaggatgcaactaaaatcagcgtaagtgtggagcccagcgcgggccgcgggagaccccttctggccgcctcgggtcccgcagctccctcccttagcaagccgcggcggccgcgcatgtggggccgcgcaagtagggcagcgatcgcagccttgcatcggtggctgctcggcgtgtccgggcgccatctgtcgccggttgcagggtcgggttctcttttgtgtaaatcaagggtccaaggcttgagtcccctaattcggctcggcgctgacctgtaaaactccccttggtcggactgcgcgcttagggcctctcgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttgctaactctgggaggagatgcgcccaagcttcccacctggagcgtagaaaggcctggagatgacgaagcctcctcgtgggctcggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtgggcaaaccaggatccgggaagtgttggggtgcgcggatgagggggcgcgacggccagggtggccagaagagtaggtttgggagctgcccagcccggcctctaaccctgctctcttgcagaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggtaagggatcgcggagagggggcgcacgcgcggggatggcgcagggctagggctgcgccgggacgccccggggggctccggacccaggacccgccccctgggcgcatttgcatatgcatactccttcctagttaggtcgggagcgccccccccagggccttcttcccgcg

SEQ ID NO: 5178 - DNA, 3643 bp, Homo sapiens
  source 1..3643: mol_type = unassigned DNA
acggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttctcgccccatcgcgattaaaaaatacggtctaattaaatatccgtggctgtgacgttggcgagagaagctgtcagcgggtggggggtggggggaaagaagaggaaaaccgagccggcggctgcggccgggcatcgtatggcgctagagaacttcggcggcgagcgggacctgcgcctgggccgccgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaagagtgcaatctggggggacgcctcccgtccccccagcgcagatgcatgactggggtaggaatgatctttgctgataagcctttttctgtttgcttcaagacattatttttcgaagatgaattgaggaaaacagtcgtaggcgagactcggggtgtattttaggcaaaaaaaaaaaagttagggttgggggagagctttcctttgatgagtaggaaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccccaaccctggtgtccccggcgagttgggcagccccgcgcgccctgaccttgacgccccagtctccagccagggcttaggtgaacttggggtggggtgtgcgtgcgtgcgtgtgtatgtgcgtgcgtgtgtgtgtgtggaaggggtggtgagactgggaacgcgctgttttctttcccagtttgatactagcaactggatttttactttaagaccggctttgctctctgctggggttgggagggggggcgatcttttcccatcactcacatctttgttcattgttcactgagtggaaggcaggcgacttaaagagacgaaagagaggaaaaaggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccg

SEQ ID NO: 5179 - DNA, 808 bp, Homo sapiens
  source 1..808: mol_type = unassigned DNA
ccgggggagctgcgaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccccggggtgttttctggcgcggtcgcggtgcaggaacgcgagccccgccgccgagcctcccgccgcctgcgttcgttggcgcggcgcccggcggtagtgccaccccgaggccgagcgctgcccccgccggcccgcggctgccagccggccctgcccgcgcccgggccccgcgagcggccgcacttcaccttacggaggggagataatgagatcaattagaggcgccgtcaccgcgccggagacagctgccgccgcatagtaatcacccgcgggctgggtgcgcgggggctccccgctacctgcgcgcctgctgctcccaccacgcggcaccgacccgggcgcgcccccggcccctgtccgcagcccacagccacaccgcgcaccctacaccctccttgcgcctctgctggggagctcaccccctccactcgcacagtgcgctgcggcccggggtgtgggaggtcccg

SEQ ID NO: 5180 - DNA, 3415 bp, Homo sapiens
  source 1..3415: mol_type = unassigned DNA
ccgaggggaccggctcgctcactcgttcgcgctccctggctcggcggacaccaggcagtcccccggcggtcggccgctcggaggacgcggaagatgtcccggggaactcaggtgaccccgcccgccacccacagaaagagccaggccggggttgcttcccattccctctgcagccggagagctgaggaggtagggacctggcgcggctcagcgcgctccgcgagcggctccccaaatgggtgcgagagggaagagggcagagcgcggcggggcgtccggggggcgcccggtacccgaggcgggcgcacgcacccaaacaggagagcggcgcccggagttactcagtgcgggcagaagagcggggcgaggagcggggtcgcgcccgctggaggcgcggggcgagcggaggaagaggaggaggagagcagaaggaaggggaagcggctcgtacctgctgcgcgccggggcgcctgctgcttcctcctcggcatgatgcttctccggcgactgccactgccgccgccgccgccgctgccgggctgaggacagggagggagggggcggcgggcccgcgggggggcgaggcgggcctgctctcagcctcccccccggagagcggccgcccgcaggatgctgctgcgcccaggctctccgcgtcccccccgcgccgcgctccgccgcgaaccccgaacgtgcggagggaagaaggagggcgggcgagggaggctcggggagggaggagcacgggggggaggaggaggcagaggaggaggaggtggaggaggaggaggaggaccgcgctgccggcggaatgggaagtttgacaaatcgctccagaggccagaggaggagggggcggggaggagcggcggccctgcccccccccgccccgtccccagacgaggtgcgcggggttcggggctggggggcggggagagggcgggcagagcggtgggaggaggagcgcgggagcggcccggaccggtactgccccggcccccgcccctaggccgggggtcacggcatccggggggacgcgcagccgccgccgcggcccggggctcggcggtccagtcttctgcccgtggcgcggctggagcggcggcgtcggcaacaggcaagcttaaaggaaaaggagatgatcgtgtcaatcgcccgcccgcgggggcgccgcgcccccgcccccggccccaggcccgcgtgggacccccgccccgccagcgaaaggggtgccgcccctccgcctccgccccgtgcgcacacgcgggggcgcggcgccagccccgccgagcccgtcccggggcgctcgttaccccccacccctattcccacccagcgttcgtccccagccaccccccagctgccccacccggctcgcactcctctccacccgccgactccggagcccccagcgtggtccccgggccggggctggcgtcccccggggaagccagagcccacgggcaggccccctccagggaggaggcgggcgcgggccggggcgggtgggggcagccctcagaccccgcgccacccagctcctcccccaggacccgccgtagccacttcccccaattttttttccccggacaaactttcctgggcccgtcccgggggtcggtgtgggagggggttccttcaagtttcctctcctgactttgggatgatcagggtccctccaccccgcccctcgcccccgggagccgggccgcgccccccatccacggcgcgggccgatcctagggcgggacgggggcgggagaaggaaaccgggctcccctgcccatcccccgccaggggctccccccgagagcctagggggccgccgcgccgtgtcccgcgcccggcctgccggggctgctggactagagggattgattattgattggtgatcggggtcgctgaggctccgggccggcccggccgactggccgcggcaagaaggagctggctgggcggcgtgggcggcggggcgacgcgggctcacttacgggcggcggtgagggcgcgggtgggccggagctcatgcgggcgacccccgggcggcggcggctgagcgggagccggagcccgagcggcgcgggcggcggcgcatcgatgcgctgcgggctcgattgcgtctccctgggccagctctcaggccgggaatggggcggccgcgccggggccggctccgggcgctgccgggcggcggctgctggagcgcgggggcggcctccgggcccactatccccgaggcggccctgcgcccgggcgcgccggctggggctctggcgctctcgcaggccccgaggccgacagtcccggcgagggcgggcgccccgcgctccagcaccggctgcctgagcgctcctggagcagcaaaccccagacttcttcctccttctctccttccttccttccccctccccttatctttttctttttttagtctctttctccctctttttctgccctgtgtcctttttattttttctctacgactgtttttgcaagtttgtttcaaaagttcacagcatgctttcttttcttttagaccgggagacagtgatctcacccacacggtaagatcaaaagtctccgctcgcccagcctgcgggcttgggctgggtccagacgtctcccaggatgcagatgcgccgccgctggcctccccggctataaagccgcctccagcgcctttccgcgcgcaggagcgctcggagttgtggggtacggaccccaggcggggcagggagtccgaggcgggctgcggcggggctctcgggctggcggactcgggggctgaggcgccgtgcgcgttgggtgcccgcggccgcagaggccagaaccgctactcctccaggccggggagacgcggccgtggagcgtgaaacgcttcttgcaagcgaggaaacggtgagttggccgacaccgccggcggcctcaccattctggtggccgcgctgagctcctgtcgcctggaggcgggttgcgccgcacggggtcagctcccgccggctcccagctcaccttcgaagctcccacttaggcgcgcccggtgcggcgtgtgcacagcgcggggcgccgcacacggaagcgtgtagttctccctggtcgcgcttttctcctcctttccatcccctcgctgttcttgcaaacctctgttccttcggccccctcccactgcgggccgcggcctgaactcgggtctccgcgtagccggccgccgccgctgggtcgctgcctggccctcccccgctcaggcgccgagcgctgtgcgatccgccctaacatctgtccgtccaaccattggcgcatccatcagtgtcaatgggctgcacattgcagcgacagcccgccacgcacaacacgggctatgcggagtgcacgcagcaaccatactgccatgtcgggacacgcaaaaaggcccccg

SEQ ID NO: 5181 - DNA, 3415 bp, Homo sapiens; identical to SEQ ID NO: 5180
  source 1..3415: mol_type = unassigned DNA

SEQ ID NO: 5182 - DNA, 1592 bp, Homo sapiens
  source 1..1592: mol_type = unassigned DNA
gcgaagcgacccagcgcgaggaccagtccccaaccaacccgctcctagttctgggcgccttccccagcagtcagatgggggcttcagaggccggtgcgcggccacatggccccgggccaggcagggggtcgtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggcgaggagggggcgcggcccggcgcctgggagcttacattcctccgccgcgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggtgagctcgctcggcccggcagttccctgcgcgcatggctggggtccggggttccgagactgcctcgggtaggcggccggatcagcggaggagagcacg

SEQ ID NO: 5183 - DNA, 903 bp, Homo sapiens
  source 1..903: mol_type = unassigned DNA
gcgatcccagaactcgttccccaccccgagcccgtttcccgccgcctcctcgcccctgggagggcggccccattaaccctcgcgacccgggccgctcctggcggtcctgaccccgccaccccgtcccgcggcgggggtttgggggtgaggggcgcgccctggggcagaggattgcgcggcagggtctgccacagggcagaggccagggctctccgggaaaaaggcaggcgcatatatgcccccctttctgggaaaagacggggaggggggcttctcctgggagactccaggcttcgaaattcctcgttccctatcctccggcccccgcacccctcctcctccccgccacgcaccctctcccctccccagccatctgttccactccgcagcgccgcgacaaacacggctccagctcgcttccgcccctgcccagccccctccccaagccccggggagtgggggagtgagcagacgcccttctcctaggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgggtccgctcctggctcgcgctcagcctccccagactattcgcaaattgaggatcccggacacagagtgcagagaccccggcaagcctactgaaagccagccgaacccg

SEQ ID NO: 5184 - DNA, 1592 bp, Homo sapiens; identical to SEQ ID NO: 5182
  source 1..1592: mol_type = unassigned DNA

SEQ ID NO: 5185 - DNA, 382 bp, Homo sapiens
  source 1..382: mol_type = unassigned DNA
acggactgttcgcctagtaacatctgatcacgtttcccattggtcaccgtttccggaagcccgctctcccgtttccggaatccccgcaggcgctgggtctgcagatggcgtccaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaaggtaaaaaacg

SEQ ID NO: 5186 - DNA, 665 bp, Homo sapiens
  source 1..665: mol_type = unassigned DNA
gcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcccgaggactcaccaccaagcccgcggacacaggccccgattccacacttaacgctgccaaagtggcagagccggcgcgggctgggacagaggcggcactgaggccggcgctgtcggtggctgagagcgccacaagtctcggtccgttacaccaggggcgacgcttcccagaggcccccgcggctcacccgggcgggactggcttcactgtttgcgcgtcctgagaagcagaccacggtgttccagggctcacagctccgcgcaggggagctcagcctaggttttgcacgagcggcctcccgcgagcccagctctgagagattgggagcgcaacttggtgctgagaagaatcgaatcgttccgctgcttcctgcgccgaactacatttcccagaggccttcgcggccctacttccccg

SEQ ID NO: 5187 - DNA, 764 bp, Homo sapiens
  source 1..764: mol_type = unassigned DNA
acgcgccactagcgcgttcccacgcacaaaccttttccctgcggccaacctgcgattctcaactccccgccctggttgctaagggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccacgtcctgtgtgactgggtgcgaggaagtcaatggcaccgtggaatgtgaggctgtgagttgaggcgggagcgggcgactgttcgctgcaccttgttgggccgatacccgcg

SEQ ID NO: 5188 - DNA, 1394 bp, Homo sapiens
  source 1..1394: mol_type = unassigned DNA
ccgcgtctgggttcgcagctccgggtacgctgtagttccgcacccggttgcccacgcccgggaccacccactgtgtcttttcggaactgtccagcgtgtcctcctagaccccagacacccaccccaaatctaggtcccagcgttttgcaggggaccttcatcctggggcgttcacctctgacttccctcttgggccttttcgctacggccgagcctaagtggctgaagcgcggacgaggatgcgcggggcctcggtctccaactgcaccacaggccgcacccacgaacctggtccggcacagttactaccgcccgggcctccaggcctcagggctgcagaagctcagtcccgggaaaaaaagcacaccggcctgaggctccacaggaaccttttctccaccttggcccggcctgcaaaacctggcccactccgcgctcttttccctcagaaaagcagcggccacagtggcgcccggctcccagccccagcctcacccgactcagaggatagcccagccctgggagtcagcggcgccagaatacgggagagcgcctgtctccgtcgcgaatgcgctagcgcgcgggggggcggaggcaagtcccgcagctgctccgggccgggaggggcgcgtggggccgggtctcggcggggatagtcgggccggggagacggagccagaggggccgcagtgtccctcgcctcaggcctctacctgtaatggccgccccgtgactgaccagtgccattaaagataatccaggcctgctcccctgtggacactgcggtccaaaatttaaaaaaacaatattccgcctttttatttttcatttggttctcggctcggagacaggcggaggctgcgagccccgccccgcccccagcgacgcctcaccggaacctttggaaatcggcttctgcctcgagtgcgcaagcgcgcggggggcgaacgctggggcccttcagggagcaagggagaagtgtggggccgcacctgccgaggggtcgggaggtttggaggagggtggaggttggctacaggatcccgatggggatggagtgttcaaatctaggcctgtagccgtgaccctggcgtgagttggatggaggaaaccccagtatcgcgagcctggaccaaggcgcggcgcgtgctgcctgtggtgtttgctgagtgacggccgccgcgcccccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcg

SEQ ID NO: 5189 - DNA, 949 bp, Homo sapiens
  source 1..949: mol_type = unassigned DNA
acgtcgtgtttcgttactttaaaaaagaaaagtcacttccgtcaggcccccctttctcctcaccctcgtgtgtgcttcgaggccgagatgcagagagcaagaaaaaggagcgaaggggatccctgcgcgtcccaagcacccaccagcgcctacggtgtgagatgaaggcgcaccccctgggcgcgaagcttttaaagcacctgcccagggagacatttttgaagttgtcagggcccctcctctgtcccctcccagacccgggtcctgcacaaatcctggagggttagcgggcgaggcggccaccgcagcggccgccaacgagcagctgcacggaggtgcagaagaaggaggccactgccattctcctgacaagctgggggcgtgggaggcctcgggagctcgaagtcgcctcgagcgggggtgggcggtgagcggacccccgggtgttgaccaggtgtttggtggtagagcagggaaggggggaacggacgtcgaccctagggatccctcacccgctcacgctccttggcgttggccacacgccgccgctccagcaccaactggaggttttcagtggacgagtagccgcccgagggcagccgcttgagccggcagacagcggccagctggggcagcggcccgaactgctcccgcaacacgtcctccagcacctcggcttgcggggtgcccaggagcgcgggcggcgcggcgcggggatctaggacgccgggcgcggggtccatggcagggccgaggccgctgaggccgggctttcacctgcgcacccggggccgcacgaggcccgggcgggggcggggcgggggcgggagctggaccacctgcaaccattccccggctgcgtattccaatcccggcctcctctctggaggctgcgtccaggcatcgcgttgaataagccgcacaggtgtgactcgggagcgctggagcg

SEQ ID NO: 5190 - DNA, 1365 bp, Homo sapiens
  source 1..1365: mol_type = unassigned DNA
ccgcgcggtcctaggtgaatctggccgaggcttctgcgtcaaggacggcgcgggtcagctgaggccaagaccgcaggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccggacgcttcgagtcccctttctcggtcgaggccatcctggcgaggcccgacccctgcgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacaggtactgcggtcccggcgcccgcacgcgggggactgggcgggggctggagagcctaggtcgccactgccggcgccccagtgcaggagagggcactgagtgtgagaatcacacacggctggagtgggaaggggctctgccaccgtttaccttgcagttgaagccgaggaccgcgacagtcttgctgaaaaagaccccggcgcgaggcttcccccgcacgctgctgaggtgggagagggtgggtgtgagggcggcgcagcgcctgaatgcggtgggcaggaggccagcgctggggctgcaaggggacccagccctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcg

SEQ ID NO: 5191 - DNA, 2638 bp, Homo sapiens
  source 1..2638: mol_type = unassigned DNA
ccgggggtcgcgttggaaccccacaggaaaaaggcgcggaaagccgccgggcattttccggggttccatagatgtccccagtgtcctagtccgtgcatcagctcgcgcactcggagggactctaggcagggggagggccccgcggccagtatgtgcgtccgaggctttcccgcagggggcagtgccgcccgcccgcgcgccgatacggtgggagggggtgggaacctgcgcggagttctggaggttctttgggagaaagttaggggatgcggaggggtgggcgcaagacttccaggactccagggaggccgtggggagggccgccgagggtgcagtgtgaggcgcaggagggggttgggggcggtgcacgttgcagggagacgcagcccctggaagatgcgagtgtgaacgtgtgagtgtgagtgcgtgtgtatgtgtgtgtgtgcgcgcgcaccgcagctctccgggttccgcgaggcgcgcgggtgtcagcttgcagccggggctcctccctccggcccccctgcccagcccggcggtccctcctccctccctccccgctcgcccctccccggcgggccaggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgtccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgcagtgagaaggcctcaggacagcgcgttctttaaaggacccccgtaccctgggtaccccttcctgatgatcccggacctgagcagcccgtacctctccaacggacccctgtctcccggaggagcgcgcaccgtgagtgcccgtcgggcgcgccggggagggtgggaggccgcggcccgcaggatgcgcccccgggcttggccatggagtgggggatggggccttctgcgccgatcccaagcagaacttgtttgcggagttgaactactctctggcggccgagcgcgaggctgcgctggccagtgcctggatgaaagtaaagttactttaacttttcccctcttgcgggttgaggttttggagtccacctctgggatcttccttggcctccagaattcttcgcctgcaccgaaggaaacttggatttgtgcccgctttgggggggtctcgctttccttcttggaaatcggtcagctttctctggcagtggggcaaggggcctagggagctgggttggcgacgttgtcctccgactccgggttcactgggcggctgcaggctggttcctaagaaacccagttttcgtggcgggttattcacagcccccgttcccacccccagccctcgcaccggggcctcagcttttctgcggagctagctccgaattttaaactcgcgtagatgatttcgaggcgacccaaggcattcttcaagttgaggaacttggctttttcccccttttgtcgcctgcttttctcatttaaagcgagcgctgcgacactttaaacctgttaatgggcgcgtattgtgtgctgcccgctggcatttagagcggtgattaagcaaattgaccgggccccagacgacgtgcaaatgagggcggattccttcgccccctctctctggctctaaactcccgccccccgcgttgcgaggggcgcagctgggggctggcgaggcctttgtgtcccccaagccgccactccacccctaggctccctgcccaggtgctgggtccgatgacagatgttgggtgaacgcctacctactgtgtgccaggttcccgcgtgctgctgcttgggcgcgatgtgaatcgtagtagttctttgcttcccgcccagattcccattgcctgccacttcgctgtcgacg

SEQ ID NO: 5192 - DNA, 1531 bp, Homo sapiens
  source 1..1531: mol_type = unassigned DNA
ccgcacaccgacccctgcgccggcccttgcgacccgcgtccgccctccccggctgggaagcacctgccagcggccctcacctgggtcgtcctcgtcgcggggcaccttcttgaagcagtcgttgagcgacaggttgtggcggatggagttctgccagccggccttgctgcgctggtagaaggggaagctatcggcgacgaactggtagatgtggctgagagtgagtttgcgctcgggcgcgctctgaatggccatggcgatgagcgccgaatacgagtagggcggccgcaccatcttcatcaggtcctcgcggctggccatggacagccagcccagctccccgggccccgcgggcgcggcgggcgaggcgggcgcggcgggcgcgggctgcgcgaagggccgctgagagcagccgaagtgccggcggcaggcggtggctgcagaaagggcccggccgcggccccggggggcggcggcggcggcggagcgcccaggtacgcggcggcggctgcggcggcggcggagggcgggcctcccacgccgggcccgttgagccacaggtaggggttggcggcggcggccggcggcgcggcgtagtcggccagcccgtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctcctaaccttttgtgatcgagtcgcggaattcacgtccagtctcaaccgatcggcttccagtcgaaaataatcgatgtgatttacaacgctttggggtatacggtagaggttattaacaggcccgcttggcgtgtccccttctcctcggggattctgtgattggaggaacggaaatcagtgttgagtttttctaaccaaactgtaggttcgctcacattcgggaagcatttattcgttttctgtgcggtttgtacgggctttcg

SEQ ID NO: 5193 - DNA, 2045 bp, Homo sapiens
  source 1..2045: mol_type = unassigned DNA
gcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgccggccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggaggggcgaggacgcgcgggcggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccg

SEQ ID NO: 5194 - DNA, 476 bp, Homo sapiens
  source 1..476: mol_type = unassigned DNA
tcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccg

SEQ ID NO: 5195 - DNA, 455 bp, Homo sapiens
  source 1..455: mol_type = unassigned DNA
acgcgggcggcgcccggggtctgcgggtaggcaggcggcctggccgcggaggcttccccgagtcctgcgccttcctagagagggaggggctcatatcggctggcacagccaccacgggtaccgaaacttggggacgtgcccgaccatgcctcctccggtggcccgggggccaccccgcattgcttagaagtctcgcttcccgttcctcctctctggttcagctcattactcttccggtgaccctgggtatgccacgcttattctccaggcctcagtttccccatctgtgctgtgaggagtggaaggaacgggatgactaggagccttttaagaccgagtattcgaggttctttccggccccgcggagccaggaggtgccagccgagatgcgcgtgccgcgcgcgccctccagtgcccggttcccgcttctgcacggtcctcgctgggcaagggcg

SEQ ID NO: 5196 - DNA, 749 bp, Homo sapiens
  source 1..749: mol_type = unassigned DNA
tcgggcggcgcgcccaggtgcaggctcgctctgcggaggagggcgggggccgggcaagcagagggcgcccagtccgggggcgccggtctgggctgggcgcccagagcttacctcggcgcgcgggccgcgggcgcgtggggcagtggctcctccagccgggaagctgttgctcacgctccggtggttgctgcggtcccgccagggctgcaccggggcttcgcgcagacgttctcccgcgatctgctgcagcccaggcggtggcggtggcggtagcagcggcggcggtggaggtggcgcgggcgacagctcggcccggcgcggcccctgaactgtccaactcttgcccgcgccgggcttaagcgcccggccgctgcccccgcgctgagcgcctgcgcaccgggcctcgcccaggtgaggggcgtgtgcccggagcccgctgggcgcgcccggcccggcccggccccgccgcacgcccgcccccctggcctggccgaggaccccggggtttggacgtgccaacgccactctcgcgcgccgaagctgtgacggtttactaagcagagacttgcgaggcacacagagagggaatgaggcggaaccgttcgggggctcgttgacactgcagagcctcccgcagcatcgctgccttaaatcccgcctttccaggcgtgcgcgcacagcgagccagaggaggctccgtcccgacctggggtcccccgcggtcctcagcccgggggctcgggtccccg

SEQ ID NO: 5197 - DNA, 1134 bp, Homo sapiens
  source 1..1134: mol_type = unassigned DNA
ccgaaaaacacgttctaggcgccgggattccagatacctgggaaatagagtgcacgcagctgttgagaggcctcgcgcttggcttctcctatcactgaggcgcagaggtgctgtggacagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcctcgctcccagtgccccgcgccccgcgccccgcgccttgccttcaccccgggccagctgcatcgcgcccgcgccgcaggaaccgtggagttggaaagtgggggcgccgcggctggggggctgcttcagctgcgcctcggccagcgatcggcgggccgggctcaaatccagccaggctgggcaggcggtggccgcgcgactggggaccgggcgccccgccctcctcg

SEQ ID NO: 5198 - DNA, 1645 bp, Homo sapiens
  source 1..1645: mol_type = unassigned DNA
tcgcgcaccgaacccgagccaggtctggctccagggcagatctaaccacctactccgaccgagcttccgaggccggcgctctagccttcatgcccacctcccggagacgccccgtggagaccctggcgcctaaaactgcgggagcccatctactgcgctcaggtggccagctcttgagccttccctatccgtggctccttgccggcatgcaggcatgcacaagcataccgccgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccg

SEQ ID NO: 5199 - DNA, 4698 bp, Homo sapiens
  source 1..4698: mol_type = unassigned DNA
gcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgcgggggccggcgggttccacgtgggtggaccccgagctgagggcagggtagggtcgcggatcgctgacctatgagctcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtcacttcaagcccacagcgagttgctcgtgtcctcggcttctgctccgcaaatctcggacgatgccaccggaggacgctgaaggcaaaggctggtggggccaggcgccggcgagactgccgcgctagcacagcttccgcgggagccgagtgctgacgggcctcgcgaccccctcccgagggcaaacggctcggccctccagggacacttggtcagtgtcactctctccctaccgggtgtcgcgcattttctcaacagaacgtgaccccgtagacggatgaactcggaatcggcaaaacccgcctgcccttgtctagtctctctgccccaccacaccactgcccttcactgcggactgcgccgtgtgcgctccgggaccgcccctgcacctttgcccacagcttcccattaccaaggcagccggaggaagacctttccgagttacctgtctcacgtcagcagccacaccgaggcggtccccctcgcaccactccccaagtgcagagcccctgaaagtccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagacctagaaatgaaaacgtacccacctttcttattacaaaggtcgtttgttgttgttgtttttttaaaacaccaagtaaccccccccccccccccccacggacttatactttgtttatgagatttctccaaccttggtggtttggagaaatgaggtgggggaggggaggaccaagggcagcaagacgtccactacgaaaataagatacttactaatttaatagggccgttcctttttacataagatgctcccccaccccccaccaatttacaataggtaaactttgagcttcctcaaagtttcgctatctagcgtttatgcccgaagctttacgaataaactccctttccaggtaaacctgcccaacccttgtcctatgcccagcgaagcccaggtacgatgggtcaaggacccctggcttccacattgtctgagtcacgttccagttggaaaggccatcttgggcgagggacgtgttgcccgactggtctaaataaggaaagaaagtggagtaccaaagaatcaagggcctctgttcctccccatcccgccaccaccaccaccggtccccgggctctgctgagcgctgcggcggtcttggctgaaaactgcgtccccgcccaaatcgagcgcaaaactcccttggacagaagtttgaaagaatccagtgtagaaacagacttctccgtccaatttggttttaatcagtaatcatataagtatacccacataaccacctaagtggagagcagacgcccagattcacggtccccacgtgttgctggagttggcgcagacgcgtgtgcgggcatagcggcggacgtgacaccgcattttctccgaattcctgccatctagggtggtgccgccccaagagggggccgtggggaggtggggtaataggctgcgcaatccacttgctctgggggagcttagggttcagagcagagcgcaactccggggggctgtcgcacagccccattctcccacaccagaagagcaatgctccttatggatgattaatagccgggcttctcctgaccatgcggcgcgtccctgccggcaccacttagttgttttaatttgacctttattagcaacgtgctcccagaggctgcgagttggattcgcaccacgataacggccctctccccttccacccggccggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcgagtccgtgcg

SEQ ID NO: 5200 - DNA, 462 bp, Homo sapiens
  source 1..462: mol_type = unassigned DNA
tcgctgggatcctgtgcgcggggcacgccagcgattacaaacgtgtctcaattctgttgagtcaaagccctggtgccaggcgctgcctccttcctgctcgctcgagtcccgcaccccctggcccccctctagttggtgctgtgctcagtccctcctgggtaattcactcaggaacccgctgcggccaccctccgtcctctccccaacctgggccgagcaacaagtggagccagaattaattccatgggcgagaggagcacggaggcgagtggagcgcgctgccgccagaggctgccaaggaggcggggtggccagcgcggggggtggaggatgggggcaggacgcgggagggaagggcagggggtggggggcgaggccccggggaccagcgcgcgagagtgcccagctgggaaatgcagctccgaattaacatcgtatgtttcataatcagtttacgagccg

SEQ ID NO: 5201 - DNA, 300 bp, Homo sapiens
  source 1..300: mol_type = unassigned DNA
tcgaactggcttgcccgtggcgggcttgtccaaagcacaggggcctccgccttcggtgcgcgttgttctcaggattagtgctgttgggagacaaagagccccagatacccgaggctgggagcgccggagagctcccaggtttcgggtaccctcccggagcacgcaagcacagtcccaggcctttagggacagatgggccagagccgtctgcatctgcccgcatcctttgggaggctgcgatgatcgcagccagggtggccgagcgcccggcccactgcacccggcggctgttttgcagcg

SEQ ID NO: 5202 - DNA, 554 bp, Homo sapiens
  source 1..554: mol_type = unassigned DNA
ccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctacaaggtaatccccgccccggcg

SEQ ID NO: 5203 - DNA, 1153 bp, Homo sapiens
  source 1..1153: mol_type = unassigned DNA
ccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccg

SEQ ID NO: 5204 - DNA, 1603 bp, Homo sapiens
  source 1..1603: mol_type = unassigned DNA
gcgatacggtttccttgacgcgcccttaaccaaggcgttaagtttagcctgacagcatccctccctcctttcggttcctggcctgatgagccgcctccacctgcgagcggtgcaggcatttttgttgtcgactaaccccctctagcgccgaactggcggcatccgagccgcggctgccaggccgggagaaggctgggcttggccgggctctgcagcgctccgggctccgtccctgccctgggcgcccgcctccgccgcggggcgaggtggtggagaccgcggacgccgagggtcctcccagtcagcacgccgcgttgccccggccctggggcgggggccgcggagtcccaccaagtggcccgcgcctcggcttccgggagacccgagcgcggggagggagtgggtgccgcgagggggcggctcgcgcggggagagccgtcagcccacggcgcccctgcgctgctgtggatgtggccacgcgccactcggcccttggactgctaggagagcgcggcccgacgccaccacgccgtggacgctcggggacccctgaatcccagcgtcaaggctgcgacgatgctcgtgacctccaccgcgaagtcacctccgcaaggcgacgcaaggacctcggcgatcccgggcgccgtacacccgccactttccagcctcatgtaaccccccctctgctgcttcctcccggcgctttgcttttctacaactggaagccgcgaaggcggctactgcgctgagccgctcgctctgctggtcaagtttgggcgacccgcgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgtgggactaagggcggcctcagagatgcccggaaaatcgctgccacggccagagtgcggcgcagacgcggcagagttggaggtgtccgcggtgcaggctgctgcccacgccgctcaggccaggtgctgagggctcagcccgcgcctcggccgaaccactctcagccccgttgagccacctcgtccgcccggctttcatcgcaccggccagaggaaagttcccgcggcccccacgcctcttcacagctgcagcgcctcccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaaaccacagcccgagctcgctcttgcgcgcgcgcgctctctccggcccaagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccg

SEQ ID NO: 5205 - DNA, 1411 bp, Homo sapiens
  source 1..1411: mol_type = unassigned DNA
acgatcagcgctttcggtgcgaggatggaaagaaacttcagaaaaactctcgccagacaacccggcagcacttggccccggaacagagaggagagaaagacctgaccgccgcactcagggccacccgccgcactaagtttgagggttccctctgcctccaggcctctgtcgcccgagctcaggctctcctaggtgcttcagggccgggctgcactcgagccccgaggaggccctgctagcgctagcgcggcggtgataaccgagggaggtgggtgagaggtgcggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccg

SEQ ID NO: 5206 - DNA, 2629 bp, Homo sapiens
  source 1..2629: mol_type = unassigned DNA
ccgccggggcccggaggtgcccgaagcgacgggactgatagcggaggaaacgcagcctccctccgcgcccgcccgcggtgtaaaccgagtacaggccgtggagccaggctgccccggctcccgctgggtcccaacccccgccccgcctagtgggccccgcggcaagcggcttctgaacagcttcaagagggttcgcggagcaaacacacgtattggtccgtccctttctcgggcagcgcggtcccgccatcagtcctgtccggcgcgtctagccatggactgcacggcagtcgggcggggaacgcggagagcgagcgcaccgacctgtgagagaaggccaagaggtctgcgctgccgacgcccggtcgcacctccgccccgggccctttccgcggtgaatttgggcaggagacgctggggctccggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgtcgcgcgtccctgcatcctcgcatccgtctgcaccggcatgcggtgggctctcagagatcgaggcgcgaatgcagcgcgccggtcttgctgtcgtggtcccagtaagagcaatgcatcatggcgagctcgggctgccgggcacaagcgaactgcaggcccggcgcactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggggtgcggccggcgggcctcccaggccattgtacgagttcactacgccggggggcagcgccatgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacagcgtgagcctcttctccgcgctctcgcggatcgccatggcgatgagcgccacgtacgagtacgggggcttctgcgccgggtccggcttctccggggctgtcccgccgccacccccaccgcccttgcctgggctcggcggcggcccttctggctccttgactgtgcgaccggtctctggggccagcagggcccccgccgcgtcctcgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccg

SEQ ID NO: 5207 - DNA, 1686 bp, Homo sapiens
  source 1..1686: mol_type = unassigned DNA
ccgcggctgcccctgcttctcggagatgacgcggagccctgccattgccatccaggtccaaggctatctactctgcccgacaacccctagcaccactaggcgctgctctagtgtgcgcctggcgccctccccagaccagtcgacgcagaacgcccagagacccagccaagggcaagacccttagcgacgcccgtcagtcctctccgcccagatatcagttcaaagggcatggcaggtcagggtccctcgcgccaccccagatgaccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagacggctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggatcagcggcggtgctttcaaggagggagccgagctgtgacttgtctcccagctcggggatggagtggaaacttgtaggctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtcaggcgagcctggaagccggcgaaccccggactttgacagctgcctgggagcgtcg

SEQ ID NO: 5208 - DNA, 1686 bp, Homo sapiens; identical to SEQ ID NO: 5207
  source 1..1686: mol_type = unassigned DNA

SEQ ID NO: 5209 - DNA, 2132 bp, Homo sapiens
  source 1..2132: mol_type = unassigned DNA
ccgagaaagtgggtgcggcaggcggcgcctggaggaactggcgcaggccctcttctacgtagtacacctggtcgtagatgctgaggaaggtgaagatgtggaagagctggtggctgtggccgataatgtcgaaaagacccggctggatgcgctcggggatcttgctcacgttgaagaaggcggccaccaccagccagaagtagcggcggtagaagtgcacgaagagtgtggggttctccccacgcaggtcgaagagccagctctcgagcataatggggcaggccatgctgagcggcatgacgaagacgaaggtgcgcagcgcgaacgggtaggtacaccagtcggtacggctcttgcagcaggccacagtgcaagccaccgccagcacgaaggccacaggcagcaccagggcgcggtaggcggcgataaggcgcgtgcagtccacgtgccagcccaggcgctgctgcaagtatggagtcatgactctggcatccagcaagctgaggcctggcaacaggtagtagtagtaggccaccgtgctgccgaagccgtagtagctgatggacgcgtagtccaggtagaagaaggcggcgcgcagacgcagcgacaggcagctgaacacgtgcgccgtgcagctcatggcgaaggtcagcagcactcccgacgcgtagcaccacaacggtagcagccacgggtggtggaagggcacgtcgccgccgctcaggaagaacagacggcagaacttgctcaggaacagcagcagcgggatgaagtgcgtccagaagttgagcgtctcgttggtaggcttcagcaccgaggctaggcactcctgggccgtgcacggcagacgccggtagcccgacaggatgaagcactccacgaagtcgtcgggcacctcgtcccagcgcagcagcggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgccctgtggtcgcgctcaccagctcttcgagccg

SEQ ID NO: 5210 - DNA, 2954 bp, Homo sapiens
  source 1..2954: mol_type = unassigned DNA
acgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcg

SEQ ID NO: 5211 - DNA, 2954 bp, Homo sapiens; identical to SEQ ID NO: 5210
  source 1..2954: mol_type = unassigned DNA

SEQ ID NO: 5212 - DNA, 885 bp, Homo sapiens
  source 1..885: mol_type = unassigned DNA
gcgcacgcctgcgtgcccattctccagagttcctggcctcgcgatcgtgcactgatttccttcagaaccccaggcccgctctggacgtggaaggcagccgtgccgtctgggaaagtggagccgagcccgggacgctgtcggcctaaatggaacgccggccccggggcccgctccccggcgggttcccgagctaaatcctccaactgttccatgacgtcatcgggccccctccccctgctccggcccgcgcggccccagcgtggcgctaaggagtgtggcggtccccgcgcgcaccgtgggccatccctaacccaggacctggctagcaggctgccctccgagccgaggctgcgctgggcggaaccagggatttatagcccggagtggggctgaaacagagctcctggcccgagcagagagcgtgcacacgcatgaaatcgtgctcctgggtgcgccggcggccaggtgcccgatgtcggtcttggaagcagcgccggagtccgtctgaacccaggcccgggaggccagaggctgccggccacgttcaactgtgtcccccttgggaagacaatccccccagttctggtttcttcctgagccacgggtggttggttggtttggtggaaggcaggtgcacaggtaacagagacaaggttaggaggcaaagcacatttatgtgcaaatgagacgcgctagggaacttgtaatcctctgcacccccgcccttgatgtctcgatccctacaatcacagaattctaggcagaggccgccgacttctccgccctcgccaagagggacccggagcaccgaagcttcccagccggtgccggcgtttccgcgccctccttctctcctgcgccgtgacctcaaaagggcggcgggcg

SEQ ID NO: 5213 - DNA, 2174 bp, Homo sapiens
  source 1..2174: mol_type = unassigned DNA
ccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctcagctggagtgctagctccgcaggaaactcggggcccgggcgagagccaccgagatggcaggtgggacgcagagcccgcggcagccagagttcctcccgcacggcccgccgacccacggaagagcgaaagagcgcccaggtggggccgagctgggggccgggcccctggagcgctgggaagcacagcgcg

SEQ ID NO: 5214 - DNA, 873 bp, Homo sapiens
  source 1..873: mol_type = unassigned DNA
ccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccggagagcgcacgcctgccgcggtcggcatggaaacgctcccgctaggtccgggggcgccgctgattggccgattcaacagacgcgggtgggcagctcagccgcatcgctaagcccggccg

SEQ ID NO: 5215 - DNA, 2174 bp, Homo sapiens; identical to SEQ ID NO: 5213
  source 1..2174: mol_type = unassigned DNA

SEQ ID NO: 5216 - DNA, 510 bp, Homo sapiens
  source 1..510: mol_type = unassigned DNA
gcgggcacctcgcacgccacgcaggcgttttcccgatgagctcctcctcaccccacagcccagggaaggtgcggggctgcgggcgcagagctgcacaagtagggctgcaggctgggccaaagccgccttgcggggaccgacatgaacccgggtccctcaccggaagggaccaaggactgagggctgagcggcggcagcggagactccgttcgcagactccgtcccgccgccgccatttcccgccggttcggatgaggcctccccagccttgggacgccctgcccccacactcaccatttccccacttcaggggtgtagcggagtctcagctacgaatcatccaatacccgcaggtcacagagcgacggaggctgaggctgtgaccgaatcaccgacgcctccctgaggggtgaaagcacggccgtggagaccctaaccgagctcacgctggcgcaaaaggcaaaagccgcgccagatcccggatgccgccccctcctctccggctgcgcg

SEQ ID NO: 5217 - DNA, 511 bp, Homo sapiens
  source 1..511: mol_type = unassigned DNA
ccggagcctggggtcgggccctccttacctgcgtgctgctctcgggccccgccccgctccgccccggagggatcctcaggccgggcccagacctaggagccacctggggatcccggggtggctgcgcgccgagggggcgccagcggggacgtgagctggcgccgagacagcctcggccccccagcgccagggccactgccaggagacccccggccagcacccacgtggggcgcccccgggagcccgaggggtccatcgcctgtcgggacccgctacctcaaagcggcgggtgccgccgagtcgctggagcttccggaccccaggcccgccccgccgccgagcatgctcagtgcgagccgccgccgaaagttttctggaacaaacacccgcatctggggcttggcgggccaggaggtgccggacgggcgtgggagggggagagcgagttggcgcggcccaggcgcccggcggccaggcctgggtttgcttgcgcccaaaccgaatcagagcg

SEQ ID NO: 5218 - DNA, 417 bp, Homo sapiens
  source 1..417: mol_type = unassigned DNA
ccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccgagcagacagcggcggggcggggagcgcggggcgcgtggcttctgggtcctgcgggcccggagccccggctctgcgactccttgagcctggttgggaacttcgcacgcaaccgcttaggcgtcgggttccccttctgctccaggagggaggtggcggcg

SEQ ID NO: 5219 - DNA, 1748 bp, Homo sapiens
  source 1..1748: mol_type = unassigned DNA
acggaaatatccgaatcggtgaaatgtaaatcgtgtctactgcataagggaatcgtgcagggagagccgctctctataaggagttaaccagcgcctgccccggacacccccgcggggcctccagcggggctcaaactggcggcggctcagcagggggcgaggggtgctgggaaacgccggggctgcgaacttacggaagaaaatgtactcggtgtagctgctccagatcttgtcgtcgcggtactggttgacgaaggcggcggtgcccgaggagttacacgccaccatgtggaagccggcctcggacaggcgatcaaaggcctgctccaagtaggtgaacttgaggtagaagcgggacgtgtacttctccggctgccggtcggggtcgcggctctcgttgagcgtgtccccgaagacctccttggccagcgcgatgcgcccgcacaccatgatgcgcgccacacgccggaatttggcgtcggcctggttgtcgcgcacggtggtgtaggagccccggtagcccagcgtgaggaagcccgagcgcttgtcctgcgcgccgccgccgccgccaccaccgtgcgctcccgggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttgaccaagtcggtgagctggaaatactcggcctcgcgcagcagccgctccttctcggggaagtgctccggcagcgcgagttgcttgtcccgcagataatccagcacgtacctgaaaaggaagccgtcccggtcgatgaagaagcgcgcccggctgtccctgggcagctcgccccggcgccgggcgccgccacggggactagagggcgagaacatgctggccaaagtactgtccgggacgctgagcagcgtcgagtgcttggtcacataaacctggccgcctacgttcagctccactacttcagggaagggcgagggtgcgcagggccccggggcggcggcggccgacgcgccgggcgagctggacgaggaaaccatctcgctaatgggcaggatggtgctgccgccgctgcccgtgtccttcagagccatagtccccccgccgccggcccagtgacccgagagagctgcactttctcgttcccggagcccgcgccccagccctccgcgtgctcctggcgctctgcgccctcggactgggcggcgcgttcctccgaccggggcggccccgctcagggttcggggcagcggcggcgtcggcggcgcccgagctccatcggaggagagacgcgcgagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtcatttaaagagataggctgcagccgcggctcccgggctccgacgctagggggcggggccgagagccgagcctgcaagaggtgcagctccccgacccgcg

SEQ ID NO: 5220 - DNA, 1748 bp, Homo sapiens; identical to SEQ ID NO: 5219
  source 1..1748: mol_type = unassigned DNA

SEQ ID NO: 5221 - DNA, 648 bp, Homo sapiens
  source 1..648: mol_type = unassigned DNA
acgaaacgctgccacaccgagcgaatgcaacgcgtacacacgtccacactcgaacagcacaagcaagagaccggctgggtgtggaatagaggcgcacatcgcgcaacgcattcacagcatgcacacgcgcgcaccccgaccccgtccctccccgcgcgccctcacaccccggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccagcgcaggtcagctcagccagccccgccgtgcacacggtgcgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagacacgcagggagggagggaagagaggagggaaggaggagggagggggtcagccggggctactgcctggatagttgggcgccggcttccctaaaggtggggtcacccgcgcccgcacgcacactagcccgaacctttactcccgacacagccg

SEQ ID NO: 5222 - DNA, 863 bp, Homo sapiens
  source 1..863: mol_type = unassigned DNA
gcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcg

SEQ ID NO: 5223 - DNA, 1288 bp, Homo sapiens
  source 1..1288: mol_type = unassigned DNA
gcggattcgagagcggcgatcctcgcctggaggtcgttggttttcacacccaggtacaggcaagacaccacggccaccactgacaggagggccgccaggacggcacacgggggcatggtccgggcacaatgctgttcggcaggggtcgggtcctcggatctgggctcccggccccctcctttccctgcgtgcttcttcagcagcatcgtggcggggtcggccgtctcggcttcgcttcccaccctctacacctcaaataatcctaaaaggaaagaaaaaggtcgattcctccaaagttcagtccctgtggctgcacaactagttggtggagtcaagcccacgagcggatacggacccctgccttgctcagcgtccagacccgcaggcgtgcaccatccccgctttcttctctcctcccagctggaagtgaaaagcaccctccgtccggggactgggtggcggtggggtaaaaagcaagacgaaacccacccagacagctcttccgactcccagaggaccgacacctctttcgagggccccaacagtggccgctcagggtccgagggcaacggccgaggcgccacgcggggccgcggctcgccctggccacggaggaccggacctgttgcgcctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaatacccttcgcgatgctcgcgtgagtgtgtgtgtgagtgtgtgagtgcgcgcgcgctccgagcacgacgtccctcccccgaccccctcccggcgcccggcgtccggcctgccgctcccgctgctgcgcgccccccttccgaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcg

SEQ ID NO: 5224 - DNA, 1275 bp, Homo sapiens
  source 1..1275: mol_type = unassigned DNA
acgcggagcaaaacttaatcggtccagggaacccagacacgtcttccgcgccgcacggacttcccagaaggagcctggaggcaggcgctggatccctctaggcacctccgtccccgccggctcccctcccccgcgcccgctgggccactcacccgcgtggggcatggtgatggtctcgttggtgttggagcccacgttgaagatgaccacggctgaggcgttctgcaggaacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcggaggagtcctgctgccgagcgtcctgctccttcgcccggcttcgccttctctcataagggtggccgggggcccacgaacttgcagggtggcggccctgcgccctccagccccggcggggacgggcacgattgctcgtagtctggggtgctgcggtgcggggtgctgcccagggtgtcccggccgccgccactgagcgctggggcgcgcgaatccagctgcagccgctgctgccctgcgccggttccctcaggctgcgggcgctgcgctcctgatctcgccggtggctgcgcctgggcacgcacttgccgcgggcggggcgggcttggggacagtgggagcgagcaggcagagcggagtaagcg

SEQ ID NO: 5225 - DNA, 1071 bp, Homo sapiens
  source 1..1071: mol_type = unassigned DNA
gcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagccggacgatcccgggaagccggacgtcgtggccgccgccgcttggccacgtccgagtggagagcgggaccgcggctgcgggcgctgctggtcaccgctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccg

SEQ ID NO: 5226 - DNA, 694 bp, Homo sapiens
  source 1..694: mol_type = unassigned DNA
acgttcccgaaccccggaccttagctgtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcg

SEQ ID NO: 5227 - DNA, 694 bp, Homo sapiens; identical to SEQ ID NO: 5226
  source 1..694: mol_type = unassigned DNA

SEQ ID NO: 5228 - DNA, 1424 bp, Homo sapiens
  source 1..1424: mol_type = unassigned DNA
tcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccaccgggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcg

SEQ ID NO: 5229 - DNA, 1215 bp, Homo sapiens
  source 1..1215: mol_type = unassigned DNA
ccgcgcaggttctcgggtccgccgcagaccctaacgcaaactctcgggttctccgcaaaccctaacgcagacctaccgtggcctcgcccgcgtcgggctccgcgtccgagaggtcgagtccggactcgaaggcggcggcggcggcgggcgcctcgcgaggacccgggagcagcgcagcggcgagcagagaacacgccacagagaagaagcccagcaagtgcatggtggaaggaccgggggtgggggaccggtccgctggcgggggcaggggtgggggcgcgggcgcccctgcgaggccgcgggcccctcctggtccctctcccccgggctcctcccggcgaccccccctgggcgagccggaggcggcgggagcgggtccggggctccgcgttcccaactttgcagggcgccctcccagccagtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggcggccccacctcccccggcccccctctggatctctccctccccgcccctgtcccctgcggggagcgggcggccggaggggcaagttcagtcccggggctggcggttggcgggaccggctttagaggtgatgcgaccaccctggaccacgtgcagcggggagaaactgggcaccgtggggtggagggagcccccgctttatcctcggccactcccgagttcttgtcctccctcccgcacg

SEQ ID NO: 5230 - DNA, 1184 bp, Homo sapiens
  source 1..1184: mol_type = unassigned DNA
ccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcctggggcgggctggcggagcgcggctcccggtgaggctccccgcgcggcagggtcgctcgctcgctccggggaccgcggcggtggcggtggcggtggtggcggcggcggcggcggcggctccgctcttctcccttgtggtgtcggaatgggaggaggctcggcgcgggtttgaatcggtgcggaggcaacattcg

SEQ ID NO: 5231 - DNA, 5820 bp, Homo sapiens
  source 1..5820: mol_type = unassigned DNA
gcgagtagaaggcggacgcctccgagccgtaggtcacgtagttgccatagccctgcgatccgccatagggacccccatagacgcccagcgccgcggccgagttgagctcgtggcgcgcggtggccagcagccggctctcgtagaccgggcagtagaccggcgcctgggccgaggcggcgggcccggagtccgccagcgtgcggcctccggactcgcagcacgtgctcagggagttggtggccatcaagaactgcagagagaggccgcgaggactggcgggaagccgggctggaggctggggccctgggccttgccaatcccgcgcgccgcccacgagggcgtgccccgagtacccccgggcctcccgccgtccacaccaggatgctcgcccctttccactagcttgtgcgcgtctggcctcctccgccacgtggggcccagccgagcacctacacccttccccggagggtttccaaggcctctgacgccatttgcgcgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtcttttaagttcccgctcagcccaccgcccccacctcgcctccccgactttcctccccgatcccctttccgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggccccactactcattccaggacacagggtcaatccagcctgtggattggcgaccaccgggacatctcactgaaaccctgtagcctggcctaggcccgcctgcccaaaccggggattctcactgggccacccttctcccatagataatactggaatattttccaagtgccttcaccaaaaggccaagcctggagcggaggcacccagtgtccctttcaccaacgataggacgctcagcatctcaggtatcagctgaacgcgtctgcatagactcggagtgctgagccttcctccctctagggacccccggtactaaatacacccgtgagcaggtgggccagaagtcagccggctcccggagtacacagcaccggctcagcttcggggagatgaggtgctcccgctggcctggagcgctccgaagagcggaggaccagggccggagcaggccgcaggggaggcaggggatggtcagcccctaacgcgaagcgcaggcgggtcgcctattttgacggggttaccgttggccgtcggaaccatggaaggcctccggggagacaggccgggccctgacccttcttcggccagcctagccctggtgcttcaggagttaccctgggggccaccagttccccgcaccaagagctcgtccggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcccgcgcaccctgcttcccgcaacttgcagcaaacgcagcggcctctggagagcctagcgacgggtagcaaactttgtccccttaagcgcaagagcaatcctcgcaaagtttgtgcggcggagcccactccctacctgagctggggaagctcccgcccgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccggggcgggggcgggagcgggggacctcacctacctgcggtggcgctgggccgctcccggcagcccgcgagggctccgcgcggaagctcggcgcgcgcgctccagcggggagccggcgacaactaatggagacatttccaggcggagcacctggcgagcggagcgcgccggcgtccccaggcgccgcggtcgtcagccgagcccgcaccggcgtgacgtgggcgagcgagcgcgctgctcccacccggccgcccattaacgctttctcccgcgggcgccgcgctcttgccaactttcccctccgtccggtctgcgcgcggcgcgccgggtgcaggagctggggtgagggcgccccgggtgccagcaggggcgctgggagctgtttgggcggggacgtagggctccgggaggtcacacagccctaacaggacagtgggaaggcgcgcgagccagatttggccaaacgctaagctcgctgcggcctcgggccctcggcccacggggcccctctccccgtttgggctgccccacccagggacgcttgggccgggcgcgaagagcccggaaatagccacccttgtcgtcggcccggtttccctccg

SEQ ID NO: 5232 - DNA, 1233 bp, Homo sapiens
  source 1..1233: mol_type = unassigned DNA
tcgcgctgggctgcgtttctgcaggagccaggcctcttcatgctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggatcgcccgaggctggtgctcagcctccttcccccatcccacctccaccacccggcgacccccgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgcgccgcgtccccgggcctctccctccgccgtggcctggtctgcctgctccagggcgcagctgcgcccgcttcagcgcctcccgggtctgcgtggcctgctcggctcagaggcctccaccacggtccgctccctgccggacgccgcgctgctgtggccgcggtggttctgtggctgtgagggccgtttctgtccgtccacaccgccttccctctgcaggtgaggaatggggtctgcttcgtttggaatgtgcctttgccgggtcctgcctgacctccaccttccagccgggacgcgcgagcttttccgtttggctgagtcaaaaagggatcgcgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcg

SEQ ID NO: 5233 - DNA, 2865 bp, Homo sapiens
  source 1..2865: mol_type = unassigned DNA
gcgagtctcagttcgctgctcgctcagagccgcccaggtgcgagggcgtcttcaccagaaatcggtgctcccgcgcgccccaccctccggggccctgcagatgccgggtcgggggccgccagcaggccctttggctcctgctggagacactggaagaccaggcgaccaggacagcgggtcgggccagtgcggtgtgacacgagggctcgagcggcttcgcagtttaaacgtgtcctcatcctacacctcccacggctgtttcggattcggtgccctcgtgcccctcagcttgcccagcggcacgtgggcctcaagcctggtccccagcggctgcgccagcctagctgtgttcaccttggggccgcgagggcctcccaccggctggcagctggtggacacgctgtcaagatcgggggaaaaaaaggaaggaaggaggctagggggacacagggctggtggcctccgcagtctttgacctgcgacgggcgcgagcgcacctccgcgcctttgcgcagagaccttcccccaagattggctcacgacgcctcctaccccgaagtcaagggctccctgtggcaaatcctcacacgccctcctcctccccgcccatccccggcgccaggactgacggggagagggcaaggccgggccagaggggctgtgggcctggactgcggctgtcgcccgcggccctgctcttttgggcagccagacgtggggtcagcgcccagtcgcagcctccgggggtgagtccgcagatccccgcacgtgacacaggccaggcatggggacggggagttcctcgtcgtccgttcccactcagatgctccctgaggttccggaacaccccgccccccatcccaggatctgaccaaccctcaagccacggccggccccggttccgcgagacgggggactctgaggattgtcctcccttccgggctgggactcccccacagcagccgaccgcccccagttcagagtggcccggcccgcagcgctccccgggcacaggtcccaggtggacggctccgctcccgcgcccggctcctctgcccgccaagcgccccggggattccccggcctccaagcggccgcggccgggtggagtcagccccgaagcccgggatcccccgaagggagaaaacccgctctgctcctctgaagcggcgggagaaaccggccccacccaggtccgggggcccgacgccctcggcggaggccggctccaggggtccgaggttcccgaagctggaggccggctccgccccggcgtccccccgccgccacctccgcccccatcccgcgggccggcggagggaggggcggggccgcttgccgcccgcgactcgggttcggcttctttagtgattgcttctgcttctcccgcgccagctgtccccagctctggggcaacgctgccaggtgcccagtccccgcgctcgagagagcgcctgcctggctctgaactctggccaggaaggggcgcgaggggaaggccccgggggaaggcgtgtccccgcgccccgccccgccccgcctcggaaagcccccgcggtcccgcccaccccaggggctcgctcagcctccggagacttttttctttgagcgcagccgcctggtgccggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcg

SEQ ID NO: 5234 - DNA, 1154 bp, Homo sapiens
  source 1..1154: mol_type = unassigned DNA
ccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacg

SEQ ID NO: 5235 - DNA, 1154 bp, Homo sapiens; identical to SEQ ID NO: 5234
  source 1..1154: mol_type = unassigned DNA

SEQ ID NO: 5236 - DNA, 396 bp, Homo sapiens
  source 1..396: mol_type = unassigned DNA
ccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccg

SEQ ID NO: 5237 - DNA, 438 bp, Homo sapiens
  source 1..438: mol_type = unassigned DNA
tcgcgtggagagaaatgagctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccgcagcctgggctggggatccggcacctgggcagggtgagcttggccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgcggcccccggggaccgcgagcaacaaaagcccggcccgcagcccctgctcctcg

SEQ ID NO: 5238 - DNA, 438 bp, Homo sapiens; identical to SEQ ID NO: 5237
  source 1..438: mol_type = unassigned DNA

SEQ ID NO: 5239 - DNA, 411 bp, Homo sapiens
  source 1..411: mol_type = unassigned DNA
gcggtggtgtcgatccacttgagcagctgccccgcgctcagctcgccgcgcgcagtggcgtgcgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaagtctgggaagtgcgcggggagggggctcccgggtagacaggtctggaaggcggctccccgagagccggagcgcg

SEQ ID NO: 5240 - DNA, 1137 bp, Homo sapiens
  source 1..1137: mol_type = unassigned DNA
ccgcggccaaaacgcccagcgccgggtctgggtttgcgaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgactaaagagaggagcctttcctccccttttgcctgcgctccggcgcgcggaggtgggtgagctccggggagccgccggcgggctcagccctccgctgcgggtgggtcccggcagaggcgcggcgggcggggcgcgggctcccgcggccgccccgggtctgctgcgcgggcaggcagacccaccggcagacaggcggaccgggcgctcggctgtcgctgttctccgcgcggcggctgcggggcttctgacttggagaacaatgaagcgtgagctggaggggagcgagcgggccgccgggagcgcactgtgtacaaacagaggcggcgtgcgtgtgagtctgagcctggcaggcgcg

SEQ ID NO: 5241 - DNA, 2383 bp, Homo sapiens
  source 1..2383: mol_type = unassigned DNA
ccgacgtgtcaaggaaagcgcgtcgcaaggtggagcgctcgggttgacgatgagaaggtgagctgtgaaccctgcacacgtcctcaaacaaaaggctcacgagcggcggccccgacgtggggagcaagcaggcttctctggcccctgcagcaggcggacccaggcccgcctgccgccggacattcagaacctgttcccgcagcgcgagctctgcacacgctctgcgatcggcacccctggaccccctaaccacccgccgcccaacccccggagagagggctttccgcccgctgagctgcggggttgggaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggccggggcggcttgggcggaggaggctgaggctggccggccgtgccctgcgcccagagcaccacacagcccagccacaggaagtagagctggagacacagcctccgtcttctccccatcgccggcgccgaaagcgcgcggccgtagacccgcggagagggagtgatcaaagacaaaatctgcgcgcctcagaaaagagtcagggtctaataagcccttcgtcggctccggggactccctcgggctcgggctccctgctctagctggagacctcgacagagcgccggccccctgactgcccgcgaagcgagacgcggggcgccgggtctagcgcagtgagcggcgaggcgcggcggaggtgcagccggcagccccgagcggtacacgttgcataaccggcctaaagccccgagcgactccaggaccgtcagcgggcgggggaggaaattacaaaagccctggcgtaaaatttcaaaaaatgtgaacctcaaaagaaaaaagggcctgcacgcagagctcggcggattcccgtgcgctccgaagacggatattggaaagctgcaaaagtcaccagaaagaaacaggcaagcaaacaaaagtcgcccccagaagaagaggagggttccctccgggctcgctcggagtcccacagggcaacgaagcgcgggtagcggctgcggagccgggcggaggtgcgcggggccggggcgtgcggccagcaagagagagggcgggaggctgggcgctggagaagatgcggcggtggagggcgcggcgcgggggttttagaggcccggcggggcgcggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggcgattagggaccggatttgggaaaggaggcagcagccccttcccctccccctccgtcctcgcccggccgcggaccagggactagggtgcctaagcgcgccaggcttggccggacccgcagctgaactgacccgcagctgaacttccccgccggacagaggccgcaaggttgaggatgagaacgggtctttctgtagggtcccggcccctgacctgggatggggggattcgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccg

SEQ ID NO: 5242 - DNA, 2367 bp, Homo sapiens
  source 1..2367: mol_type = unassigned DNA
gcgatcccggctttggggccctgcctttgccgcgggagaataggctccaatttacgaagctggtcaatttcagaaatccgagacccggttcttgagaagcgactgcgtgctccgggaccctgcgtcaacaaccaaacctgggagaagccgcgggaatgtctttattggacgttacgaagggaattggggtttctctcctgggaagaaaaagcccgacctgtgccggcgagagcaggctgccttgggctgggggcacctccgagcgctgcggcgggacgtcggggtccggggcgaagagagccagggcgcggaccgacgtctgctgcttttctgcggcattgctgcccgaacgaacgaacgaacgaacgaacgaagcggtttcgtttaggaaaaataccctcttgacgcgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggttttgagattggacctttcttctttctgctcagcctgcgggagggagctggtcttgcgtgttggcagggagagtccgctgcccagagcgtggcagccagggaggtttgaggacagaccccaggttttctgtgtttgggggtagggggtgttagggtggggcaaccgcccgacctgccctggttgggggaattgccttcttccctctcctcaggggctgggctggtgaggaaagggcacaccaacccctcaggacagacacttctggggccccttgtccaacccctatgcctgcacatcccccagcgaccatcctgctgcgggcctgcgaacggtgacgcctccacccctgtggccccgcaggccgttcctggctggctgccgctgggagacgggctggacgcaagggaactgggagcctgtcctttgcccaccctcaggccacagggctccccagcgttgcctcgtggccagataaccctgtgcgcgaagcctcatggtggaaaccagttggccgaacctactcctggtaccccgaagtgcccagcctgagcctgcttgctgttgggattatgggatgggaccacagggcaggtcgggctgtggcctgcctttctcagggactggagcggctaagcctgcccgccgacggccacgggctccagagcgaccgtttccggcgcaaggtgccgggagatggcagcgcggcagccgggcctgaatctttcatgagatgcagtcagcagcggcgcctccctgcctggttctcgccgacagctgctgcgggagaggccgcgacccgcgccacctcggcgtcctgctagtccgtgcctccagggccgcttggcctgggaacgcagagacccacgaccccctccccaacctccgaagcgggaagccggcccg

SEQ ID NO: 5243 - DNA, 1235 bp, Homo sapiens
  source 1..1235: mol_type = unassigned DNA
gcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcg

SEQ ID NO: 5244 - DNA, 3043 bp, Homo sapiens
  source 1..3043: mol_type = unassigned DNA
gcgagggtctcggggtggtgggggtgccggccccagcatgtggaggcgacaggatccgtaagaccccacgcgccgccggggcaggaccgcacagggccgccattcactcacttggggcgtccctaatgggcactcgtgcattccagctcgtgcggtgagcgcacgcacgccgccgctgccgcgttcacacggccccccaaagtcgggggaggggtcgtggagcgaaggagctgtaggcagattttctttctctttccgagctgggaaaagggccagccccgtgccctgcacgcctggctctgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaagagtttgcgtggccctgggtgggcgcctggctcccggcgaaacgcctggggcgcgccgcgtgggtgcacggtgtcctctcccagtagctcccggctgcgggggcacatgcacttacctgtattctgcagggacaggcggcctttctgctgggagctcctgtcttggggaccctcgggtgggttggtggcgtcggtcccccgcgccgggtcaaaggtggccaacaccaaagccagggtcatgaactggcccagccgctcggcacacatggttcttggtattaacctcccgtcgggagacctggatcctttgtgctcccctcttcctcctcctcctcttcctccttcgccgcttcccctcctcctcccactcttcctttttgctcgccttttccctcctcctcgcggccgcggctcggatagaggttacccagcgccctcccgtagctctccggagagcatgtgaccaggccgttagcagcgccgcgagtgcccggcaatggcagggatggtgcctcaaatatccctggaagctctggtgtcacttgaatgaaggagtcgagcaggtgttgtcccggcggctggaccaatccgagaccccggcccttttgacaacacggccgggaggcggggcctgcgctcaactactacaggaggaagccgagcgccgctgggagcgccggacaaagttgccgacctggcggcggccacgcgtttgcgtgcgtgtgtatgagtgtgtgtgagcgcggccggagatgcgtgcgcgtgtgcgggtgctccagggcaatggtcgaaaggactgtacaatataagagcgaatccaagctccagttgctgttaaagggggacggtgtgctctgggacagtgtccctggggcccctggctcgcgtcacacccacatcgggttgggaaagtttcctctttccgccgtttggaattcagtgagattcccagcccagaggacttgataaattgaagcagtttcctaggcacaatgatgctgtgggccaactgagcacacatgggaattcctggccttgtgacactttgcattaaaaagaaccccacgattgaagataggagcagaagcactagatacagtatttggtctgagcaactgccctatcttcccgctttggtgggccgtgcaacacctggagtgtcgtttctcgtctttcccctaatccagacgcattccaggctgggctgcagggatccaggtgacagtcaggacttgcatcatttccaggagggtggcagggaggcccaaggcagccctgagtcagcccgccgcggagcatcgcgtgcccggaggccagagcttgaaaggcaactttacgcgtctccaaacacactcctgcattttctcaaagcgctgctcgccaccccgctccgggttcccttttactctccagtcatccgatggaagtggtgagaacaaaaacaaagacaaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccaggatggccacggctggccgcagctatccggcgtgtcgagctctcctgagtcg

SEQ ID NO: 5245 - DNA, 864 bp, Homo sapiens
  source 1..864: mol_type = unassigned DNA
ccgcaggcgcggagctgcggctgcagccaccagcctagacgtggcgcgcccgcagcaagtggctggacaccgcagaccaggcccgcgtccccagcagcgcggatcccggggccagccgcccaggcagcaaagtcaggcggtcggcttcgccagcagccgatgagtctcatcctgtggattgcccagcgccagggatcaggatccggagaggtgtccaggaggagcagaccctcagaccaggtaggctgtgcactcggtgaccctgacgccatccaagggaagctccgccatcccgcgccagtgcctgagctgcaactgcaaactgcgcgtcctggcacgagcagcggtgggggcgggtgggggaaggagcgagtgactctccaggcgtcttccgctacctgacaccagccaggcagcccccagggccagagcgtcagcgccgaagccaggctcatccgggaagccactccggtggccgcggggtgcccatgccagcaccagatctctcttcggaaggaggagcggggcgggctacacggccaggcgggccctccccttaaggcggggtgggccgcgcgcctgcgattttccgtccgtggtcctggggcagcccgggccagccaggagaacccgcgagcccagcggcgcctgcacctgcggcttccgggagccgggcggctttgcgaggctcactaggtctgagaggtcggaggccgccagtgtcgctgctgaagggtggaccaggcgggatcgcggattctgggctagatcgcagacttggtatcgcggattgggatttggatcggggattttgagttggatcacggattgggggttggatcgcggattgggggttggatcgcg

SEQ ID NO: 5246 - DNA, 2071 bp, Homo sapiens
  source 1..2071: mol_type = unassigned DNA
gcgagagcagcggagagaaaggagctagagaagtgcgtactcaccagcccatcgcagttgctgagcgccacagaggaggcttcggctaggccggccacgtctccgacgtagagacagctcccgagcaggggctccacgcgggtggtgcccttctcgccctgccactccatagtggccccgggcgccacgaggcgggcgttgggccgcagccgcaggtgcaggtctcggccaaagaccgtgacattgtagaagaggtgactgccaggctcctcctcgttgcctccggggaagctcggggtccggaccggggcggccctgcgggctcgtacccctgctctggacgtagctgccgacaccacgtgggacaccaagcggccctgggcgtcagtgcgcacgggcaccgccaggatgcgctccgctccgtgccccaggggcccgcctgcaacgggaaggggcgttagatcggcggagaccacggagccccagtgcctcagagacccgccggcaagccacgcccccccagaccccgccccactgcgaagggaaggggcattccgccaggcgaccccagaagccagcctgcacctccccggctttcctgcaaccgggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggagtctcggcttccccgagcacgagcggcctgtcctgcctgtccagctcccgctcagcccgctgccggccccgtctccccgagcgcccgaggactgggaggggtggaacagggtccctccgatctccggggattccctgcggggcgccccaaccaatccttagggcccaaggctacgcgctcggcagccggctcctccggagcgtccccggacgcgagccccggcgccgcctcgccctggctcccccctcggacccgctggggctgactctgcgctcttggccgcggggcttttcccggccctccgtccccaccctccgcgactcaggagccgccagtgctccgaggctcccccggcccaaggcgctcgggggcggtgcggggcgccccctgcgcgaccaacccggccccgaagttggccaacttggccccgggcggggcgcgcggagtttgcccaagtcaggctggacgacgcctggggagggggcggcggggcacgcgggacagggccaggccggcgggggtcccggggagtaggggccgggccgcacctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggccgggggagccccgccgccagccaccccaggggcacaacctccgaggagcggcgccggccgaacg

SEQ ID NO: 5247 - DNA, 1170 bp, Homo sapiens
  source 1..1170: mol_type = unassigned DNA
tcgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccgcgcgcacgaaccgggtagtgtgcgcgtgtgtgtgctcgcgtgtgtgagcgcgtgtgccagcgtgcgtctccgcgcgggcgtgcgtctgggtggatccttgcgtggcttgggaggcaaatcgggcgtttctccaagtcgtcttaacatgatttaggctctcaaatacgtgaaagcggtagacacaacagggatgcgaaggaaataaaaaacaattggggaagtggtgccaagtcactcaggctttgaactgaggacgagtagtgcggtcgcgcctggggcgcgtccggaaatcatcctcagcctgtggcggccactgccccacttaaactcttctgcggggagagttgagcggatccctggggggttggtcctgggctagttttaaactctccggttgcatctcgcgtggccccaccgacggcgcgtctcggcgtagctcttggcgcgggctcg

SEQ ID NO: 5248 - DNA, 2168 bp, Homo sapiens
  source 1..2168: mol_type = unassigned DNA
tcgcgctgcagtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgcgggaagatgcctggtccttgcctcgcggacttggcagccgcgtcctgcgggtctgtccactgaactgctgaggactcgcccgtgtgcggggacccgagtgccacttcccggagcgttaccttgcgctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaagtccccgtttgtggcgcg

SEQ ID NO: 5249 - DNA, 2053 bp, Homo sapiens
  source 1..2053: mol_type = unassigned DNA
ccgacgcacgattcgctcacacggaataagaactccacgaaggacacttggggaccacactggtcgtacccgagggggcgggaggcggaaaaagtatttccaaacgcaactctgccaggtcttacccttcgcatcccctggtcctcgggacagaagctcccttggcacctctcgcccagctcaggggctggttgtccgctagaacgaaatatcccccactgactacggagagctctgcagggagccgaggcccccgcccgggccaagggaaggcgctggcgccgcgggagacaagaagaggcggaggcggaaaagaagtggagaaggaaggggtggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgccgcggcgccagccctggggccagaggggacaagcctcttcggcccgcgtcacctacttctcctcttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttccgcgggggtcacgtctggggcagcgggctgagccggaaggggaaggggagcgggagcccagaggccgaggcgcgccgggcccgggggtgcggtctcgcgccccctccctccgcgcaaggccgctcccgtggcaggcggcagcgagctgggcccggggccgggctgagctttgggaccgcgctgcgcagcccccgagccgttcgctacctggctgcggtcgcgcggccacctgtcctccgccctcggggcgccgcccagcttcgcgccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggactcgggggcggcagcggcgggcgcctggggagccgcggtgtgctcagcagccgcggcaggaattaggggacatgctcgttaattgtttccactatcagccgccgtctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgcacggtttccacctgacggagccacgtcacgtcggccacaagggccccgtgctgggcgctgggttcggttcccggccgtcctcttgtggccgccttggcgttcattttatgacaccttgccggtgttcccagacatcatcccgcaccgctccgttttaccgacctccaggtcttcccg

SEQ ID NO: 5250 - DNA, 1679 bp, Homo sapiens
  source 1..1679: mol_type = unassigned DNA
gcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcg

SEQ ID NO: 5251 - DNA, 1474 bp, Homo sapiens
  source 1..1474: mol_type = unassigned DNA
ccgttcccaaaggctcggggaaggaggttgcgggtgggtggcgcggacctcgggtccccagccatcggcgctctcccggggccctctgacctcgctccttaaaggaggagggtccgtggcaacggtcctcctcggccaggcgctctcgggacgcgggggtgaggagtgagcgccgtggcccaccctactctccgagcggggacggagtgggcgacaccgcgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggtggggccgagggcccggggacgctggggctgcctgacctgagcggcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagagggggaagaggccgcgcgggagggacttctgacacgcg

SEQ ID NO: 5252 - DNA, 675 bp, Homo sapiens
  source 1..675: mol_type = unassigned DNA
tcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcccgctccgcagcccccgagtggcgtcagcacgcccgccgggcatgggctttaaatgcccactagcgggagctcaggcgcttctgccctggagcgcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccaggtacgtgtctcctctggggactttgggaaggagtgcgcgccccccgtttgcggcggcatggcctgtacgccaaggtctgctgtgcctccgcgcgtctcgggcgtccgaccacgaccggcgcagccgggatgcggggattgccggagccg

SEQ ID NO: 5253 - DNA, 1133 bp, Homo sapiens
  source 1..1133: mol_type = unassigned DNA
tcggctccgtagctctccgcgctccgacccttcagatcctcgggagcccaggggagccaggtgctgggcggtgcgtccggtgccgccgcgccccttctcgccacctctggcctctccgccactcgggctttccggccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgcagggaggcgggcagcggccctcgcgcgcttctgccgcccccggagccggcgcgcggcgagcgcagggcgagcgcgcgtcgggcggcggccgcgctggggggcgtgaggcgagcggcgcggagagcggcaggggcgaaacttcgcgggccagatgcccgagggcgcggcggcgctgccaggctgccgctgctgcccctgcgggccccgagcgcgcctccgcaggcggcactgcccgcggcgcggcgtgtgcaccgagcgagtgaaggtatgtgtggcgggcgcggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacg

SEQ ID NO: 5254 - DNA, 1808 bp, Homo sapiens
  source 1..1808: mol_type = unassigned DNA
gcgcgccggcgctggggatggggtgggggcgctggggcacaagggcgcaggggcgcacggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttccccattcttctggctggaattctccggccgtcactgcagtgtccagagatgctgcgctgtagacccgggaccccttaggcgcctcttcccgtccctctgccaaagcgcaacgcctgtacttttccagctccctctttccctcttgaaattgaaagttattgaggtcgctcagggttgttgctccagcagtttccttccccgcccccgagctcccccccgccccccacagccatcccccctcctctccccctccctgccctcctctccctcccccctccctgccctcctcctcctcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagccggctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatccccgacacgcaccagcggagccaaagggcgcgcgaggcgatggggttcgcgtgtctgcgcgtttgcagagctgccggacgtcccccgcccg

SEQ ID NO: 5255 - DNA, 1323 bp, Homo sapiens
  source 1..1323: mol_type = unassigned DNA
tcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccg

SEQ ID NO: 5256 - DNA, 1501 bp, Homo sapiens
  source 1..1501: mol_type = unassigned DNA
tcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacgcgagatcgcaaaccatgacaataggcagtcacccgaggtcaaataaaaacggagtgggtcccccgcgcgccgccgccccccgcgtccctggcggcctcccccgaggcccccggcggcctcacgagcccgcagtagccggtggcgacgtcgcccccgccccacctccctgcgcaagtgcgaggctgccggcagcgcggcgcacgctccggccgttcccggcttccgcgcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcctgagggcccgggccgctcggaccgcagcggtgctctctgccctagaagacgtccccaagccccaagggtcccttccgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcg

SEQ ID NO: 5257 - DNA, 1744 bp, Homo sapiens
  source 1..1744: mol_type = unassigned DNA
ccggtgggtcgggggcgtggcgagaccctgtttcagtggagggagggcttatgcattgccgagacgccgattatcagaccttgaccctgtcgctttcagaaaaaccactggcagaagatccggaccatggtcaatctgccggtcataagccctttcaagaagcgctacgcctgggtgcagctggcagggcacactggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttcccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttcccttctgggccacgctgggcggggccctgggtcctcctcctggcggcatttgccaagcacagcgtgggtcccggctcctcatcgttagcaggggctcatttggcgtttagttaatttgccctcctctcccaccccaccctctgcagaggcggtatctgaaccgcctgcagcagatccgggacaccctggaggtatccgagttcttcaggaggcacgaggtaagcggcggctgcccgggtgcccgggccgcgagggctagggcgggaacccggcaagggcgtctctgggcagggccgcggcctgacggtgcggggctcgcaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacg

SEQ ID NO: 5258 - DNA, 1801 bp, Homo sapiens
  source 1..1801: mol_type = unassigned DNA
tcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccagcctctgccgcagcactcgatgagggacagcagggaggctggcggggaggcagagattaaactatgattccatcgatcacggaaagaccaccatcacctacagcaaaggaggctccgatgcgcccacccgggcagcgactcgcggttggtgggcgttcctcgtcctcgccccctcggtggctgtggaatccaccccgcgccgcacacgccaggactccctttcctttgactaaggggaggggaaggaacaaaagagaccccccaccccctatacatacatacacatacacacacacacacacacacacacacccctccggtattttactgctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatgggcggtcgcgctctccgccccctccttccttcacctcccccctaccttgaaaaaaatccatccattggtgcaaagcagacattttgatgtcatttacttagcaccgcttgttttggaggcagcgtcttacccggtcgcctggaggtgtgggcagcgcgccgatgggtccgggggagcggggctgggcggctcggtcctctagcggagccggtttgctgccatccgcccaacttcagcacccagcgggcgaggagagagggagagcggcgaggatgcagaggagggggagggggaggagggagcggtgggcggggagggagcgagagccgctcggcagcgcgcatgcgcctcgcgggccggcgcagcccctcgcccggcgcggccggaggggcagcttcccagcccctgcgcgcggccgcgagagtcccggccccgccccctccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccactcgcccgtagcccgcgcgctgctgtcctgggctgcgcg

SEQ ID NO: 5259 - DNA, 1801 bp, Homo sapiens; identical to SEQ ID NO: 5258
  source 1..1801: mol_type = unassigned DNA

SEQ ID NO: 5260 - DNA, 1684 bp, Homo sapiens
  source 1..1684: mol_type = unassigned DNA
gcgctgggcggtgagttcagccaggttatctctgcgaggacaccggtcggcggcggacagcagcacgcggcgtccaggacccggccttcctagagcttaggtcactgtagcctccaggggcgctccgagtccatctggagggccgcgaggcttccaggctggaaggaggaatagggagaaggaggaatagggagacctggggcagtgttacaattacagaaaagggagaggcgaggtccgctgagtccttggcctgggcaacaaggcacactgaaaactgggttccttttcgacccgcatcgtgcgcgccctagaaatgacagccagacggagcagggtctaaggacgctgaaaacccctgacgtgggcgcgccgggtgcgggtagggacgtggaaggactgggctagccacaggaactacagcgctgcggaccgggtgaggggtcccggcccgagtccccacttggggcgcagaggtgtttctgtaaggggacaaagggcactcctcggcgcgatgggcgacttccccagccagaaaatgagagggttagacgaggggaggaacttcctcagccacttggcccggcacagcgaccgccccaagttcagaaccgctaagtcagtccggggcgctccggccccttcgtcccgcgccccgcccgcctccagcccgggccccgccgcccccgtcgcccctgtcgcccgggtcgcccccgccggccctggccccggccccgcacaccggcagggggcgcccgagcgcagctaaaaggctcggcgggaggtcggcggcctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcaggtacgcgccgcgcccgggcccccggcgctcctcagctccccgcgcaccctcctgcgctcgggccccgtcgtcccgctcagtgctggctacgggtcgtgtcactagcctgtgcgtcctcgtcactcgcgggtcggggcacttggcgccctgtgtgggtggcgggagcggggacgcctcggtgcccggggaccgcagcgcgctggcgtttaactttgccgtcgcccgccttggagtcgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaagcgctccagtgccagctcggctccaggcggcaggaggcccgcgcgcccggggggaacg

SEQ ID NO: 5261 - DNA, 6657 bp, Homo sapiens
  source 1..6657: mol_type = unassigned DNA
ccgggctcggcccgctctgtctccctgttccctggaggtctgggcgcccccgcgcagggactaagggctggacagccgcaggcaggggctccgtccttggcctccacccttcgtgtccagcaatcccgggagcaggcggcggcacttcctccatgccccggcctcaatcacggtctcagtccccccaaccccgtcctgcaggaacaagtgtggtagaggctcggggtcggagggcgggcggccgtcccgcgggctggacggagtttctgggctgcggagaggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctcccggccgaaaggcggggggcgacgcgcaacggggagggaagggagggaggggtcggcgaccttaggggagggcgagtctctggggacgcggggccgccaggggcccgacgaccctctcgctccacctccccgcccccaagtgccccgctctccccccgccccgcaaacgcgcgtcctgcgggctgtgctttggccctcgcggacgcgcgcgctcacagagggtctgacttggggtcaacttccacgaggttgccgggcgcctgtgagcacagccgtgtccccacccaggggcccacctcccagcgccaccagggtcccgacccccagaccttcggacgcttctcttccaaaccgaagcctgggagcctctgggtggcctggggcgggggcagggggcgagcggggcgggccaggaggagggggcgaggccgccactcggcttcccacgccgcccccgcggctggctccaacttcccctccggagcccccctccggccaccccccagcccaccgacgtgcgggcagcgaccccgccccccgcccctccggtcgcccccgccgcggcccccgccccctccccatccctccccgcgcgctctcccacatgaaaccttccatcacgctcagaaagaatgtgctacaacctcggcgctgccgcggccgccaccactgcgcccgcgcccgagcccgagtcggagccggagccgccgctcccccgcctgcccggccagccccgggctccgagcgcgcggtccccgccgccgccgccccgcgctcgccccgcgcttgacgcagtgagcgccgcagcctggctcccgccggctccgctgggctccgggtcgcaggccgagtccagccgggcgggctccgggaggggccggcagggcgggagggggaggagggctgtctggagccagcgagcccggaggaggaagaggaggaggaaggaggggaagccgccgccgccgccgccgcgctcggggaaccggggtgcgcgcgctctgctcgcccgcgacagtgcctccagcccggggcccgcaccccggcccaggtaagaaggggcctgaggggcagggggctgtccggggccgggggacccctctgtcgccgctgcgggatcggagggtccccgcccctaggggaggcagggaagaggatgctctctggggggggcggcggggggcagcgcagggtccccagcggctctcgcagcccgggccaccccatccctggtgccctgacctcggcgtccgcgccagggccgagtctccccgcccgcggggctctggatgcggcgctcggggcccgcggctcccgggcgtccccatccacccacccaggttcggaggcgggcgcacccgaagttagcggccgccgagcctgggccggacaaacttccctccccgacgccgcggctggaagggccaggactccggacccctagggctagggaggcgccgcggggaccccgaaactttccggagcgcgctgagagcaaaaagccggctgggcagaaagagggggagggggctgggcgcgccttcgagtgcgctggggtagccgcggcgccccaagttgaaccacagacgaacccctcttcatctgaaacctggtctcggagtcggaggtggggagggagtgggctgtgggtgcctcgacttcgcaaagccggcgtgggggggcgcagcgccccgccccgcgccgcttgaacctccggagggggtgttacgggacccccgcccccaccccagccggtggctgggctctgccgaccgctgcggagctcccgggaaggacccgctcgcggctattaataggcgtcggtgaccctagcctctcccggtccgggaagctggcgcggcggggctgggctgggctgggctgccgagtggggcgggaccccggggcccagagcggacccccagctctcctggtccctcttccgccgctcttccctccctgccgcctgctttcctcccattttccctcttcgatctcggggtgtcggcccccccccgaactttttctcttcccaaactgcacggtggccacccggtcacggccctgggccgtacccgcgcaatctcagcaccattcccgaccgagtcctccgccgcgggctgagcgcgagtccccggggccaggctgcccagggaggagcagggacttcctacaatccgcgcccttcctcccaacccacggcgagcgcaacacattcgcccgcccctgcggccccatctgagggcggggagaggtcgctgggggcagcttcgggggttgtggagggcaggggggacccgcgaagctcctggagcgtttagggatgcagctcgggcggcgtgtgcagggaggaagcagcgtcccggcgtccccccttcagcgtcgccttcgcgcgcctcgagggcccaggagggttcggtctcccccaccccacctggacactcaggtctgagcctgagtggatttgaggatctgggggacggggaatacggagtccttcttcctgcctcggtgtctgcagagcccagccctcaggcagcgtggggatctttgtccccagggccagcgccggccccgccccccgccccgttaactccgggactccgccgccctccaggttccaacctcccagcttcaccgccgcgtcctctccccggttctgggtctgggggaggggcagggggcgtggagcgcggcgttgggccccggacagatgtcctcgcggcggcggcgccggcgtccgggtaacagcaggccgccaatcggcgcggccacgggggaggggcgacccggccgggactccggggactcggtcgcagccggacggcgcagcctccgctcggggtggggggggggggcggccgcgaggactcgacccctgccgtgcagcccggcctccagtcctctgccgtcccctcccccagctccaggtttcgctctctgctggggtcctggctcctcaggttgcgggatctcgcctcccacggccccgcgcgcgtacccctacccgcccctcaagttgacctctgaggttctccgtggatctcagaccccgagtgaccgcagaactgacctctggggtcaggcagtaccggtcaagggcgctctgaagaggccctcggcctcagtttgcaccccgaggaaatggactcatcatgcctgctcctgggaagtagcaggacgtcctggcgcggctcctccgggcaggcgcccagcacagcgcagggcacacgggggacacctgcgaaggcaaaggaggctcattccagagcttcggctgcacttggccagcacaggcctgggggaacctgctggaaatggggatccagtacctctcttggggtttatgtttggcaggcggagtggataggctggggcccggagcccggtggtcatcttctgcacaaggctggccaggccagaagctggagggtagcttactgggaccttccaagcgtgaccaaggaagctctgggggccgaccagcttctccctagtggagctgcagctggggagacctcacagacaggcagggaggagagggtgccccgctcaccgccggcctcgttccacaggcccaggcctggcacatcccaggcttgcagtatctatctggtgggtaaacaaggacctgctcttggcctgcggcctggctctgaccgtggtccaggtcggggcagagggagaaaggccacagcttaggtgttccaaaccaccggtgcccttcctgccggcccctggggctgtgctgggtttccagggcccctgccccccagtatttgcatgaaatcgtgggggcgcactggctttcgtcctagcactccccttcaaggctctgcacccctatcacgggagccccacccagccagccgaaggaggccacaagctctaaattactaaattcgggccagtgctgggggcctgggagccaaggcagctcagagcccactctccgattctggctcctggagaaccctaggacccgggcgtgtcaggccctgcagccgggctaggccggtccatacaggactgaacggcgtcgtgggcgttcattcacattccctctccggtccccacacactataggatttatcttgatttgctgcctttgaattgagtcaactcttttgtatgctcgttgaattgcccagctgctggcggcgagcggagagcgtgccgggggtactgaggccgggaaccagaggcgggcgggggacaggaagcggggagggggcgccggcggggacgcgcgggctgcgcggggactggagagggtccccaggcgccggccgttctgcgaacgcgggcttgtccaggcaccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggaccgcgaggacgccccctgcgctttctaggacctcccctccttccccagcccctgcgcgtcgccgggagagggaaggagcgggttgccgcggggagccgaggagagcagggggctcgggaggccagggagagaaggggagggccagaggctccgagccggactcgcggcggaggaagagggggtggaagggagcgcgcaggcgggcgagggagcgagggagggagagaaggagggagggagggagggaaggggggcgggagggggcagggcgagcttgaattcccccccggccgcgcggcgaggggcggggccgcgcgcgcagatcgatgggcgaagctggggaggaatttcaatcccgggagcgaagttagagcttgaaggacggcggcggctgcgggcgcagccccggaaccgaggccgggcgggcaggtaagcggcgagcgcggccgggcgctgaacctgggggacttgggacccggaccacccccggggagcggcgcggccaagccccccgccacctcgaaccccgggcgtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggtcgctgccgcagcccgcacgctgccccgtgcctccgagaggtcccttccccagcgcctctctcccttccgtcccccttcgccgtccgcaccctgcccggcgccccccagacgcggccccctgcccttcccttcccggaaattagggggctgtcctcacctcctggccgagtcgctgacccctccccaggctcgcatcgccctccctgctgggccgccctccccccgacgctgcgagcctcctcgctccgcgcggggaccgtccagtcacgcacg

SEQ ID NO: 5262 - DNA, 546 bp, Homo sapiens
  source 1..546: mol_type = unassigned DNA
gcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccgcggccgccgctcacctcgcgtatttcgtcttctggaaatccagcagccggggggcgaacatcgcggcgcttccatgggaatctggccccgggctcagagcgcgggtagctggcagagcctggggggcgcggcggcggcagcagcaggttggagggcgcgcggcgggggccaaggggacctggtcggcgcccggagccggagccggagcccgagccggagctggaggcgcccggagccgccgacgccaaatcccgagcagatggtggcgggggcggggcgggcgggggcacgggggggctcccgggctcgcgctgccaatcgcctaagcccggccccctccctcccgcgaccccgccgcctccg

SEQ ID NO: 5263 - DNA, 288 bp, Homo sapiens
  source 1..288: mol_type = unassigned DNA
tcgcgagaggaagagagctgagccgctgtaaccctgggcctgggattgcggggacgggacgggtgggaagcggccaaaggcgcagcggcttctggtcagagccgcagaggcctgagacgtgggccgcgccccggcccaggagaccccgcggccgcgccctaaccctcagtctcccgactgcgactgcgacccgggaaaacgcctacgtttttggaaaggaagtcccatcacagggagctgacccggtgtcagcgcgcagcacgttcccggcccgcagtgcgccgcgcg

SEQ ID NO: 5264 - DNA, 947 bp, Homo sapiens
  source 1..947: mol_type = unassigned DNA
ccgtatctgttccgcggtccgcctccctgcacacacgcccccgagccgggagagcctccgcagcacccagagaagagaccggaacacaaaggatgaacgaatggggagggggggtttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctcccctaggaaggagcgaggggagggtggcccagagagaaagcgccgcgcggcctcggctgcccccggcccgggacacccaaacagaccaaagaggatccggagtggagcccggagcggatcccgcagcccgcgcccgccgcgcacttacccgcgcgcccgctgctgggtccccggcagccgcgccccctgcgctggcggagtcggaggagcctgcgctgggccggcggggggcgggcgcttggggagggcggagagagggcccgcccgccgggacctttgctcggtccgggcgccccagagccgcgggactggccgccggaggctgcgggaggggcccgggccagacctcccagaagccccagagagagccgcttcccctccttcgtgtgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacg

SEQ ID NO: 5265 - DNA, 1313 bp, Homo sapiens
  source 1..1313: mol_type = unassigned DNA
ccgtgtcacacggcgctgggctctgcaagctgttgcttgcgcagtcgcccccgccgctgccgctcccgggcgggtgcaccagggtccgcgcgggcggggcggggtcggggcgggaccggggcggggcctgccccctcgacgcgccggccccgcccctcgctccgtccctccccagcggaccgcaatgatttagaagttcaggaatcccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccccgagtgctggtagactgtggaattcggctgtgtcctgaggccaccctagagaccccgcgccgcgtgagtgccggagcgctcggtggccgccgcgccgcgcgcctggagggatgctaacgtggagccggcgccgagtccgcccggcgtgcgtgcgtgtgtgggagcgcgcgagtcccctgacgcggggaccagttatgaatcgggggtgtgtgtttgcctccagagacctggcaaggtgcggagccctccagaagtgcggtcaagcggcagcggagacggcgagccaggaacctccccccgcgtccccagcttcccagcgtggcggcggaacccccggagaaagtttgcaaacttccagcgggcgcggcgaggacgccgggtcacctagggggcgggtgggcgcgcgcgcagggggctcgctctccccggtgcggagctgcagctgccacctctcccgccgggctgccggctgcagcgggtgggcgcgcgcccggggaggggaggtcgccctcggagggcgcttggctttcgctccaggcgctccgggctggagagcggcgaggctccgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcg

SEQ ID NO: 5266 - DNA, 848 bp, Homo sapiens
  source 1..848: mol_type = unassigned DNA
ccgtctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgggctggtgtctgggctgtcaccgcgggcgcggagggaggggcgcgcgggcaccgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcg

SEQ ID NO: 5267 - DNA, 2406 bp, Homo sapiens
  source 1..2406: mol_type = unassigned DNA
gcgcagcgctatagccgcgactgcggcggcggcggcggcgcagggggcgggggaggagagaagcgcccacttcgtcccgctgcctccgcagcagccctggccctagccccggcgcatcagagcggtccttgggaatctttgggcttgttgctccggcggccgccagctgggagcccaccaccgctcgatggtaccgaaccgacccgtgtagccccataaccccagcccaactccgaggagctagcgcagaccgctctccgccctcagctgcggcgaggcaagggctggcagcgctcggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgccgagccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctccccctccccagacacacacacacgcacacgcacacgcacacactcaaaccctgccctccctcccctcatctccccttctctccctcggatgttaaaaagcaaatcagatcaattttcgtttaacccaatgaaaccccgaaggctcgccatcccgggagtttgcgtctttgcgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgcccgcgcagccctgtgaaggaaagacaccatctttccgcacggaaactgcgtatacccctcccccg

SEQ ID NO: 5268 - DNA, 1218 bp, Homo sapiens
  source 1..1218: mol_type = unassigned DNA
ccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgttcgaagccattcgcgcgggcagtccctgcgtgtccccctgcgtgtccccccacgtgctccccagcgcgcgcagcaccccgcctctgcgcttccccgagcgtgcagcttccggtgagggcagccccacgcacagcccccaacaccctccccagcgcctgcagccttcggtgcgcgcagtccccaagcccacatgcgcagttctcaccttgcgcgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcccggcattaggaaagtctctacgatcgctgaggtatcgggcagtcagtgcccgttgccaacgcggagggaacgggcggagactgcgggcaacacgtggcagagccggcgtgagtccg

SEQ ID NO: 5269 - DNA, 1848 bp, Homo sapiens
  source 1..1848: mol_type = unassigned DNA
acgacgaaggcgcgcctctctccatccgctcacaccacacccccgccctccgaagcatagcccgggctggagaagccccagcggcggcggcccccgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtccgcgggtcggactcttcggaaaggaccttccaggaggagggagcgaatgcaagccttgctcggacgcctcaccggcggctctctaaatctgggcgccttttgacagccattttcactccatcccgtccccacgctggggaccacctctggccccggaggcgcgggcgcggccgcaggagcgggctgcggggtccgcgaaacaaagaacttcgagcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcccttctgactcacaagccctgagtgacagttctgatttggttcaaccgcgggagggaggggaaagagaaagaaagaaacccccagccgtacgcctctcctggcatccaatcgactttctggaaaaaggtcccatcccggcctggtgccccgtgctgggtggagaagccccccgccccgacctggcaccgcctgcactactcacggggtggaaaagttgtccctcggctccgcgctcccctcccgcgcgctccctccttcccttctctcctcctcttcctcctcctccccgcgctcctcctcccccaagttttaacagatgttgccggactctcctcgctccctcgcactctctcttcctccgccccggcccccgcccagtcccttttctttcagccactctcgggctcggaggggacgcgctgagcagcaggacgcctgccgccgcagggggcgaagttgggaaaacttggagtgctgctcgccttacttttgctttctcgctccttccaggccgcgccgggagcccccgcttctcccgcccgccgggtccccaagcccggagtgggtcccagctgcgaggcgggcggcggcggctgggaggcggcgcgtcgcgggccggggtcgggggctgggggggagcccgggcgccgcgagccacgcgcgcgctccctccccgccctccgccgccgccgccgccgccgccgccgcctcctcctcctcctcctccttctcctcctcctcctcctcctccgcccctccccggtcttcacacagacacattcatgcctgctcctcctcttccccctacttgaccccgcgccctcccggcgcgccgaagccccacccacccggcgaggggaagggggcccgggcgtgatgtcacccgcgccctctctcttctctctccacaccgccaggacaccccccaaatgcgcgccctggcactcgtgctgcg

SEQ ID NO: 5270 - DNA, 2119 bp, Homo sapiens
  source 1..2119: mol_type = unassigned DNA
ccgccgcctccccagcacagctcccgcagcccgcacccgcccacagggtctccgcgaccctagagcttagggaagaattgccgaggggcggggggtccctcatgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccggcgggcgggaacgcaggacgcggagttggggcgcgggctgtgcgcgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacggtaagtgcagccgcgcacccctcatctggtctcggacacacttgctgggacgatgctgggaatgcccggagtcgggcgcgctttttcctatgcggcgggtggggacactgaggctccgagtgggggtgtgttcaaggtcactcctacgagttggggacgcagtcggggctggcaccctccggccagggctctcttcagagttacaatccacgaagcgcccctggcgtgaagtgtggagaggggagacaggtgtggagagagaaaggtttggccaaggtcagggagctgatgagcggccagacggcggccagaggggtccgccggtcttttgccgcacccatccccacagagggactgaaagtgggcgaggagagcagacccccagggcaagctccaaggccggctctgcgcgcagcgctgggctcttcccctgcgcacctagagcgcgtgctgggctcgcctcccaaccctgcggacccgagggtggtatatgggtggtgggaaaggacttcggctcttccagccttgctggccacccttctgtggacatgcctccggcccagaaagagtggggtttgccaaggtcaaacacagtctagtccctgccgctgccactcggcggttgccctgaccctgccttttctgcgcccgaactttgtcactgtcttcccagtcgggcgggcgagatggttgcaaggacggggacgctgtctgcctcccgcg

SEQ ID NO: 5271 - DNA, 562 bp, Homo sapiens
  source 1..562: mol_type = unassigned DNA
ccgtagggcgaaggggtgcgctgtcagatgtggcattcccgttttacggagacacacggtgtcttacacgccagggagaggtctgagacgcaaagagccgtcgagcgggctgcgggattgcttcgctgtcacctccgcctgcagccacccttccgcacgcacttgtgtgtgcacccaggccaacatggaaggcgccatcctaacttctgccgtgagcaggtgggagggaagagagacgagaggtattccattggttgtctgggaaaatgaattgcaccttcccctcccttgcggaggatcaacttttcccaccccctcgggtgggcactcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccg

SEQ ID NO: 5272 - DNA, 1404 bp, Homo sapiens
  source 1..1404: mol_type = unassigned DNA
ccgcttcgctcgaggcgaaatcgctgaaagttcggctatttaactcctgtccccataactcggaatcccggacaccagcggccccagctgctggcgcgcggctctcttccagtcccctggatcccaaagctccctgccacagcgcggcgtctcctcctcctgtcaacttccctccttgcactgtgacggaggcaaagcaactcagcccaggaggttgaactcgagtcatcagagaaggagaaacagtgccgaaaacggcccgtgcgctaccagggtagcccattaacgcattaactccaggctcgttgggcagaagccgggaggaaacaccctggggaccgcactcctggttaaatgcccagcacgagtcaaatccggcctttccaaagcgagccaagcccactactacaaagagatcccccgagtgttttgccttaaccacatttcagacagccagctttgtggctgctgtttgactccaactttccctctaaatctaaaaggatgcacacttccatcagacggaacgtcgcgattccccggcgaagaaaaaggcgtcgcccattcctcttccaaaacgctacaacaaaaaccaccacgcttcccttccttcttccttgcccctttcccttctcccagaccaacaaggaaaggagcgagcgagggcgcagatgccctttggtcaagtactccccggatgttcccgactaaagcgtctccaaatgaacctgcagcctgcggaagccggggacacattcatagacgctctctgctgcccagaccaggaggggtggtgggggaaccaggaagccagggagagagcaaagttcctggacgcgtctcaggaggaaaactttgtgcagtgctgccaggcggaggctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccacccccaaatcccggctatccccgcttagcaccgcggtctccagcacaccctcccactggagtagcaggtgacccaaaccagacttacctgctgtgaactcttctctccctctctcttttcctggtgccttttcagggagaggggaacgggatgcaggctgaggtccagcggcgcggcaacccggggcaccggcgcgcgttcctctgagccgcagccctggctgagcaagcggagccgccggcagccctggcagagccgggaagctgcggccgcaggggccaggccgggaggcagggggcgctgctgcctcccccgagagccgcgctaggacaggcg

SEQ ID NO: 5273 - DNA, 819 bp, Homo sapiens
  source 1..819: mol_type = unassigned DNA
gcgagacgtgggaaactggcgaagctgctaccagccgccggcgcaaggagcgcgagagtcctgggtgcgcgcagggcacttactttctatcctccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggagcgagtcccccctgccagcggagcgcgcggcagggacctggagaaagcgaggcttggagggcgcctacacggggccccatggcccgctgcgccctctccgccggttggggagagaagctcctggagcggccagatacctgttggctcctgagcagcatcgcccagtgcagcctccgtcaggaaaagcagcagaatcgacagccccagggggcgagcggggtccatggtgcagggggtcgggcggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcg

SEQ ID NO: 5274 - DNA, 1128 bp, Homo sapiens
  source 1..1128: mol_type = unassigned DNA
gcgctggcgggcgcacccggcggcggcgagcgcggaggtgctgcggtacctaccatggtattcttgtcccggaacgtagtaggtggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactgcgctccatgccgccgccgccgccgccgccgccgcgcgccctacgcgccgctcgctcattcagttttggagacgccgggacggaggagccacgcggagagaaggcgagaagaaggcggacgggagcggaacgggctcgggagcgggcctgggagcgggcccccgccgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccgccccgctccacaccttcttaaagccccgggcgccgcgtcccccccgccgccgccacacgtgtcccggccgctcccccgcccccgcgcgccgccccgcccgccccccgccctctcgggctggctcggcggcacctcgcgcggcgaggggcgcacgcgtccccggagtccccggccagcgcccggttcgcacccgggaggacagggaggggcgcccgccggggagcgggacggggacgctgtcgaggaccgctgagcccgcgactcttctgcgagggacgtcaaagccccgcagagggcacctcccgtccagctgtctgaaggggaaggccagcccctttggccgtcagtgtgccctgtttttcctgggaggatgcgtgagggaaggagaggggcggcagggacggccgctggcgccggtttctttgtctgagccggctgcgtcccgcgcccctcggggctcgcagtctgccagtccgggcggcccgcactcgttctgggaatccgcccgaggccgcgaaccgctaggggccctcgcg

SEQ ID NO: 5275 - DNA, 1128 bp, Homo sapiens; identical to SEQ ID NO: 5274
  source 1..1128: mol_type = unassigned DNA

SEQ ID NO: 5276 - DNA, 1128 bp, Homo sapiens; identical to SEQ ID NO: 5274
  source 1..1128: mol_type = unassigned DNA

SEQ ID NO: 5277 - DNA, 1921 bp, Homo sapiens
  source 1..1921: mol_type = unassigned DNA
ccgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccg

SEQ ID NO: 5278 - DNA, 2872 bp, Homo sapiens
  source 1..2872: mol_type = unassigned DNA
gcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgagaactccttggcccaagtgagacaggaaccagggcaacaatgaagagaaagacactcggcctctctccaccccaggccgcagaggcgcacaccgtgaaaagaaaggccaatcagcgctttaacgcacgctcgggtctccctttccgactaccatgtacttttaactccctgccaccgagggctttggatcccttcgaggctttctgcacttcaagtggaatcccctgtttcatttgccagcagctccgtctgctgagaggacgtactttggggactgccaagaagcagcagacacaactcggctttgccaatacagcatacggttttgttctcgcctccctccccacccccttccctgactcgccgtctggggcgagctggagaaggcggagcaggaggtggggagaagggtgggggtgggggaaggtctggcgtagcacaaacaagttctccagcgggttgtttacatagcaggtggacctgacgtcagccaggaggctccgctgcaaatccgaacaatattcttccccgcgtttccccctccttaaagaagttagggaacggggggagataggtggacgggggagaaaggcatcctaaccagctggttccaaacctatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgctggctgcggcttcctcggccccccccctccccgggcgcgccccccactcgcggcagcagctgcccggactcgcgcgtgggtgtgttgtttgggggcttctgcctcgccgccgcgggtgccacctcccgggacgctgcccacggcgtccccggtcgcggtaagtttcttggccctcactctggcgcgctacacctccgcaccccaccctgtcccagccacctccacgctgggccgagctgcgactttactctgctccgcgctcctcccgcggtggcgacaaagtttcgccccaaaggcagcgccctgcttgccggggcgagtgtgacatgtgtcaaatttgggctcggcgttggggtcgcattccggacccagcatcaccacttgttgttctctttcattttgctttgtgatgggggaaaaaggggtggagaggggagatttgctgttggctcacggatgatttttagtttggataatgcaaaatgttgcttcgtccggagagacctcggctggaggagaatgtgtgtcgaaacaccagatgtgtgtttgtttactctcttctttttaattgtttgttgtcttttccccttcctccccgcacccccacccccaacctcgggaggagaaacaacagtaaaaacatctggcggttagaagcacacactttattgatccaactgctgacctttatttactcagttgggcaagtgcacgcttctcgcgtctaagttgggcacttcagcgttcatctcagaagtacttctccaggaaggagagagatggaaaggggacactcctgtttctggagtcaagaaactcctgggccctactgacgcttcgggataaccgtgcacagggatgactgctgccttgatcgcgttcctttccctgtccacgcgttagcacgaccggcttcccccggtgtctggcctggttttacttttattccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcgggcgggcagagcgcgggtccgaacgcccttcgcgctcgcggcggcgcacgtgcggcggcggcggcggcgccggcggcgcgggcgggacccactgggtggccgcgcgcgccacccgcgcgttttctgcgcgcctctgcccacccgcgaggccgcaacgcgccctgacacccg

SEQ ID NO: 5279 - DNA, 2906 bp, Homo sapiens
  source 1..2906: mol_type = unassigned DNA
ccgcgggggtgcggttttgcgcaactgggtgactcgcgtgtccctccgcatttcatttgcaccaagggagcgcgtgtcagacgaagggaatttttttttcttttttggtgattctgttattttttcaccaactgtacgaagctcaagggatatccgagctttctggctgggcggatgggcttcgcgcttggcatggctgagcggtccatctctacctctccgtttctatctctaccataacagcgaccactcagcccgccaggagcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggccatctacttgtgctcaggaaaaacaaatcactagagtgatatgagaaggaatggtgcacctggctgtccgctgaaaggttttagagaagaaaacggaaaggggaataaaacggggggattctccttttccaacaagcagggcgttttggggaagtttgggggccaggggctttttgtcccgtggttcggcacttgctttcctcggagccgctttctgctgccgggcggcgagtcttaccctgctccccgcagagggcgcggtgaggaagcccgccgggggcccgcagctccatgtcagcgccgccgccgccgccgccgccgccgcgtgaggcgagcacagcggccgcacttgtggctgatctctgggctgagggggctgagctggcctagcaggcgccaagtctcttccatgtgaataacaaatactcccaccggcggccgcgattggtctgcgcccggcgcctcccgatcctccgcccgcggccattcacccggcgcggcgcggggagccgcggccaggatcgcgcccgggatcgccaatcgcttcgcgccaaccagtcacctcgggaagcgggaggaggaacccccgaggggcgggagcctctggatttcggtgtcacccagcggccctggcgcgggcagggagggggaccctcggcccgcggatccccctccgctcttcagcctgaagcgacgaggagaccagaaatgtcaatagttctgatttttaaaaatcatccccccttccccgcccccaagaaaaaggggaggacccaactacagagtgagagggtgggaagaagcgggagcggtagaagaaggaatatggttgtggaggagcccagcggctccggctgcctggcgagcccgggaccggcgcggggaggcgcgacgcccgcccgagcacagcgggcagcacccgcgagcccgggtccccggtgaacacagctccagaaagcgtcaccgagaataacacatggtagatgacaagtgtcccgccacatgctttcttttcgggaatgcttaaagtagagccggcaagccgcgcggttcccttgcaaagtttgcctggcgccgcgcggcggttccgccatttgtcccgccccgcggctctggcgattgtctccccactccccgcccccgagggtctgagggacgcgtgcaacagagtccccagggctcgaggtaccacacagcgcggtccgctgcgggcactgcgcaggaaggggcatgggtggctaccgggacggtcattttattgagatgattcaaggagccgcagacgcggggcaggaaactccgggggagccgtgctcgggttctgcagggaaacctcgggattcccttcgcatgccgcatgcggaaacctgccgggctcgacgtgcacagtccagcgctcctccccactagttactgcccaggccccccgatcctgcacccgccggaatgagagaaagtagcccctcgccgcccagctcccgggtagctgctccggccgggccttgcgttggtgagaaagttccatctagaggcggccgcgcgcaactgcaggcggcgccctaggcccgggcgagccagggagagcggggcgcg

SEQ ID NO: 5280 - DNA, 2906 bp, Homo sapiens; identical to SEQ ID NO: 5279
  source 1..2906: mol_type = unassigned DNA

SEQ ID NO: 5281 - DNA, 1696 bp, Homo sapiens
  source 1..1696: mol_type = unassigned DNA
ccggagccggagccggcgaagccgcggagttgaggcgcgcctgggagagccaaggcccggcgggctatgcaggtgcatgcccccccctccgcccaaggagcggcgccaccagcgcttcccggctttgtccttggaccctggcaccggctcgctccagccgcgggggaaggcgcttcatcgccaaagtgcgctccggcggccccggcccgctctgcgggccgccgccggagggagtgcgggggcgccccgaagccgcccaggccgcactcgctggatgctgcgctccctctcccggcgtcggccgctccgggccggcggcagctgattgcggtcgtgagctcgcggagcggcgagagttaagaggaggtgttcgcggcgccttcgccctccccagacacacaccccctttctcctcgcctcttctcggagggtggaagagacaaaaacggggggtcagttctccagtccgccggctgccggcacgcggggcggcgctccgtccggcccccgaggaccagcggcgtggcggctgcgctcggacccggtccgccggccggaggagcgcgcggcgcccgcggtcgcgcccgcaccgcaggccccttcagagagtccgggggcgggcgcgggtccggcggcggcggcggccgcagcccccggcggcgcgcaaccgcccgtcgccgcccgccgctgcccggcccccggcgcgccgccggctccggctttgtgcggagggagcgagttcgcggcttcggctcccggcgccctcagtggccgcgccgccagcggactgctgcagcggcgtgagcagcgggggtcgcggctgcgggaaacgctccggagcccaggaacatagtccccgctggctagcggcggcagcagcagcagcggggcccctgcgcgcggcgcccaccgtctcctcctcgcgccgggctcgcggtgttgcaggcggcagccacgcagactgctctctcatccttttgtccttcagtcagaacgtgaatgtactgctgacgcatactgttctgggagaagattagcgtgatgcagtgctcttatgtattagcgccgctccccctccgtcgcctgcctcgcggggttaacgccggcgccttccagcgccgcgccggccggcgccgcgcagccccgcgcctccggccgcccgtcttcctctttcctccttccttcctcctctcttcctctctccccctcccccctcccccctccccgggccgcttcctccccgccccctctagacgagcggagcggggccagggcgagcgggcgagcgagccggagtgagcgtcaagtgaggggccgcgcgcaagtcgcaggcgttcgcagctattttgggccggtcggagggagcagttgggtggccgctgataggctggagcggcgcggggctgcggcgggagagcccgcgccggcccccgccctccggcccgcacccggggccccctggctctgaagagcggggctcaggggcccggcggcccgcggcggggctgctgcatttggcctgcctctcgcccggcccgcgtcatcctcacccccgctgactgctgacggggcgcggactcgcgttcggagttcggaactgcgtggtggggactcgggggacggcggccggggccacgaggctcccaggaccgagagcccgggcttcgctgctgcactgccgccagcccctccttcg

SEQ ID NO: 5282 - DNA, 2054 bp, Homo sapiens
  source 1..2054: mol_type = unassigned DNA
acgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcccgagcagcggcggcggctctcgggggctgcggtggcgacgccgggctgccccccttcgtccccacccccgcgggctgaatgtccttgatgccaagcgggcacagcggcgtcactccgcgccgcccatgctcgcccggtcgggccgctgcccgggcgcggcgagtgcgcgggggacccgccggggagcgctctcggcgcctctgcgcgcctctctgggtagcggcggccgccccccggcagcccgcggccggccgcgccgcggcagcccccacccttgccgagacactcgccgggcagtgccctggggccggggctggggggccgcgggagccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagggggcagggagcggggccgccgctggctcggccgccgccggagctcccgggctgcctgctgccgccgcggctcgctgctgctgtgcattgaagcccggccaagcgctgcaaaaactccagctgcctggcgctctctgggtcctcctctcctccctcccgccctccctgcttcccttcctccctccctcgcctcgcctcctctcctccctgccgcccgccgcccgccgccgctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctgggtcccctcggcccgcacggagctaccctggcggtggcgatgtggggcggagagaggggcatacatgggtgaccggagcgcacggcgcgcgctcagagggaggcgctcagccgcctcggaatttgcagctctgggcgctggccgtcg

SEQ ID NO: 5283 - DNA, 1258 bp, Homo sapiens
  source 1..1258: mol_type = unassigned DNA
ccgcggaagcgccccttgctgggtagaagagtgggtctcccgccgcggcgcacctgtctcggctgccggctccccgcacctacctgtacgagacctgcttccggaaagttaagttcctcagcttctcctccagcgcttcgtccttctccttctggccggcggccgcgggctcgtccagggcagcggcccccgccgccgcggctgaccctgcgccccgcgggtccgcgccgccctcggcgcccaggcagcagctcccggcgccgcttccgctgctgctgctgccgcccgtcgcccctttctcctctcccgccgaggagctggggttcatggcgcccgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtccggggaactcgagtggccgcgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcccggacccctgcgtccccaaactgcgtccccgccttgctcgtcgcccggtgccttccttaggcgcagcagaccctcggtaaacagcggttaattcgatggaatcggatcacagggccctcggtgaagcagaaaggcggaggaaatccaggaggcagaagtgaggaccctggcgcctggcgccgctgcgttgttcg

SEQ ID NO: 5284 - DNA, 628 bp, Homo sapiens
  source 1..628: mol_type = unassigned DNA
gcgtggaggctgcggctcggcggggcaggcgctgagcgcaccgcggcggcacccggcgcagaggctccagcgcggggagccgggctcagccccggcctgccagcgccgcggtcctagcccacccgaggccggcctggggggcccgcagggcgcgcggagcgccgagtgcgcgtcgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcggcgatccgggtcgggctacgagggcagcaccagctggaaggcggccttggagggtaagcgcggagcggcctccctctcctggcccagggacccctgcccaggcccgacccgcgacccggaggcggtcagagtcaccttggccgctgtcccggaggggagcgctgggagcgcggcgccgggacgcggcggagtcattcatttcagggcggccagacgccggttcgtggggtggggtgggagggaaccgggggccaccgcg

SEQ ID NO: 5285 - DNA, 1075 bp, Homo sapiens
  source 1..1075: mol_type = unassigned DNA
gcggtccccagggcgagcactcccgctcccagcgcctcctggccaccaaagaaaaaccagacgcctgcgacgggctctcctcccgcccgggcttcctcgctcctcgcccctcgccggccatcgggcgccaccaccgcgggtagcagggcggggcgctctgggagccgctgggtgtctgggctggcgtctgcaggggccccgcgggatcaggccggctgcaggggcgcggcggcgcagcccaccttgttgctgaagagccgcgagaggctgcgcatgggcggagggggccgcggggcacctcggagcccgcgcacgtcccagaggcgcagggcgccgtcgtgcgaggcggtgtagagcacctggccgtgcacctgcgggcgcaggggcgggcgtcaccggtgacgcggtaggcgggggggacaccgctgcccgcgtggatggatcggggcggggcaccttccctcccacgggcggcggccccgagaagggcagagggacctacctggatgcagttgatgatgaatgtgtggccccggaacaccctccgcagctctccagactgcgcgtcgaaggcccgggcgcaagcgtccccgctgcccgtgaacactgcggacacacagcgcgcgctgggcctccctccctgctcggccccccgcaagcagggatggggcggcgagagcgtgacctggggcgtctccgagactccgccccacgggggtatcctgaggctcatatgggaagtggacagtgcccctccagagaaacgggtccccacggttattctgctccaccctgcagatgcctgcgcgccagctggccctgcccctgccctgctgaacaccgcccgggcccagtccccactccgcggtttggtgaagttggtttccgtgcctgcttgggaagcccctgcctggggataatcgtcaggtcctcgagtcgcttcccccctaccttccgctgcgtcggcaaccttatcctcccgtcctcattaacggatcggcactcaaatcaaagcccagccctctggggttcatgatcacgcacccccgggacccctagcgggggcgagcctccg

SEQ ID NO: 5286 - DNA, 5566 bp, Homo sapiens
  source 1..5566: mol_type = unassigned DNA
gcgcttctccagcgatcggggcagaaccaggacgtgcaatgcgactgcccccccctccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttattctgaagaagtctcagaccctagacccagcctcccagaccccgtccccgagctcgcccggtgggcctgtaggccggtcctccttcgcccagaggagagcgcagacacgcaatgtccgcccgttggccccgcccgccccacccctgctccccgcgccccttcgtttcggcctttgtctacaggccgggtcggaacgtcagccccaggagccgacggtggctctctgctcgccccggggaaggtgttgctctcctatcggccccaattccccgcccggcgcctggggcttggctgcggggctcggctcccagccgagggcgcagggctggccaggcctgctttggctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggctcgtctgatccgcacagaaaggccgaccttgagggcggcggtcgttcgggggagaaagcggaggctctgggctcgcgggagcgcggcagccggggctggcatcgcagaggagagacacgccactgccccgcatccccagaaagcgcgaggcgccgtcccagctggggcaggcggccgaggccggtcctcatgcgcgcttctcgaagcttcctgaaacaccttgcggagttccgtgtgtatagaactcagcaccgcccagcccctgggcagctcaactttctgcagccccatcccagcttccccggccctttgaacggtgacccctcttaccgctttcccagagttgtttcgtgtttgggtccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggctttcatgggacaggtggagccattaacctgggatggttttgcaggaaccaaagagctcagggcccctcctccccccaatatcatgttcaggagacccagagtcgttggaccctccctttcctgactggtgatcatcagagtttccagagttgcagaaaattctccccccaaaaaaccaagtaagcgtcaataagacttcccacaaactctcaccagccctattttcccggggggcaggtagactgtggggtttgattttttgagactcggggaggacccctggcagatgtgtgcctagccagaacatttggtaaggactcctccaatgaagaaaaagtggaggaatccagccccagcgagaagaggcttccccaccctgccctagacacaccggacagagggcacactctgaccagagccacgtccagtggccaggaggccagcccagcacctcctcccccaccattcccgtcctgggtgggggggtaattttcctgggagcagctgtgggaactgtcgtttctcatcccagcccagccagcactctgaagcctgcaggggaaggacagcacgtgggatggacactggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgcatactgcattcccccgctctttcggatcgctaagcatgtttcatgagggtcgctgtccccgggtggaatgcggccgtatgcacgcgcctccctgcacacgcacacacacgcacacttacaataagtgtctgcaggaggagtgtcctgcgcgccagctctgcgtttaagacaggaagctgccgggttaccgagtcaaatgggagtgacactattcctctccatcagcaaggaaagcggaccacaaaagtccctttgtatctcggcagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgggttcctgggctcccgcacccggagcgggggacgcggccgctttaaggggaggaggggcggcgggctgctcctgtcacccagcggcggccggagcgtcacgtgggcgcgcggcgccgcggccattggcccgaggcacgtgtccaggagaccggcctgcgacgtcactcgagggggctctgttaaaaataagaacaaaaatccagagtgaaagtgtctcaggttgcgccgagtggcctggaaatttccgagcccgcgcggaggccgaggcggcgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtgagcccgcggggaccacgcgtcccggctcgccgcggggaggcccgcggagctggggggcggtgctggcgcgggaacttaccgggaggaaaacatctcgaacctcccccgcgcacacgcacaaagactcacgcgacattgtgtgaagctgacgccggcccgggcagcggccaggagtccagcggcaggactgattcg

SEQ ID NO: 5287 - DNA, 5566 bp, Homo sapiens; identical to SEQ ID NO: 5286
  source 1..5566: mol_type = unassigned DNA

SEQ ID NO: 5288 - DNA, 1164 bp, Homo sapiens
  source 1..1164: mol_type = unassigned DNA
gcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccgtaagttttgcgcgcaaactcccctccacctgcagacccggcgggtggccactgccacccgaactgaggatgagaagaaggaagttggaaggggcggtggatgcgcccagggactctcccagcctgggctctagccccgaaacggtccccggagtgggatccaggaggggccgggagggaatctcctcccgatcgtgaagcggcggcgcccagttcccgctttttctctctgccgggttcccgcgctatcccttccactctggctgggaccgcgttcccgggctcgcaggctccgccggggaggttccggggtgtgggggccgggacggcggaggcggggagtaagggcccggctggcggtgacctgcagtcacctctctgccggaggggccctggaatgaaaggcgcgcgggccaaggtgacctcgccttggttggcactgcggctcagcccccgcccggggactcgcgggccgactgtggccccttctggggaagccggggcgcggggaggcgttccgggcatctcagccgcacggggtacgctcgccctcggcggggcccctcgctccgctgtgggagtggcagtgggtgtcggggtggagaaagtacgcgtggcgcggagtcctggggacgcggcgtcccacccgctctggggagccccggactctctccagcttccaggctcgcatgcccctcttttcttagtgccctgagaacccagcgaggggctgaccctcccgaaaccgtggcgcagccaccagcaatctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcg

SEQ ID NO: 5289 - DNA, 1495 bp, Homo sapiens
  source 1..1495: mol_type = unassigned DNA
tcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccg

SEQ ID NO: 5290 - DNA, 352 bp, Homo sapiens
  source 1..352: mol_type = unassigned DNA
gcgcctctggcagcagccgcccacgcccccggccctgcgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcg

SEQ ID NO: 5291 - DNA, 1141 bp, Homo sapiens
  source 1..1141: mol_type = unassigned DNA
ccgcccagcccccagcgctgcgctgtccccgcgctcaccggatgatcacgaacatgaccagcgagttgcccaccaagcccacgacgaacactacggagtagaccgccgtgatgatgaccgggatggccggggagatgtgcgcgggctccagctgcgcgtcctccgagccggcgctgccgttgctgtcgggctcggcccagccgggaaaccaggcgctgctgttggggggcaggcaggcgctcggggcgcaggtagggcccggctccccgcggaagatctggatcggggagtccatggtggggcgattgcagcaggaaggcgaggacaggcggcacctgcggcgctgcgggagcgaaagaaccggctggacgcggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctcccccagcccctgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgctgaaccgcgcgctcacgagtcccgctcagctcttggcatcacctgctctcggaccccggccccgctctccgcccgagggctgctgttccgccgagcgcagcccccgcctctcagcgcacgtctcccactactggcggcggctctgcggggcggggcggggcgggaccggcgggacgcagccgggacgcggctgggcgctgggggcctgcgggcggagagctcgtctggtgcgcccgccccaggccggcaggtccctgccccgccccgcccgcccggagtcagcccccagctccccagcctcccagccccgcgtcccctccagccccgcaggctcgcccggcccactaactgcccgagcggcacaccgcctggtccccg

SEQ ID NO: 5292 - DNA, 3297 bp, Homo sapiens
  source 1..3297: mol_type = unassigned DNA
tcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccggtgagtaccgtggtctccactacgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcg

SEQ ID NO: 5293 - DNA, 2213 bp, Homo sapiens
  source 1..2213: mol_type = unassigned DNA
ccggctttaaacgcctctccagccacctgtgaaccgcgaaggagccggctttcgcggcggggaccttgccaccagtaccctcgcgggccgaggtcgttctcccggtcggcttcccgcctcacccgaaaaggaattagagcatctacccaagacggtgactggcagggcagatcaaggtgtcctggtctcggccccagccccgcggtgcgccccgcccgcttaccttgaccgggtgcaggtagccatcgccgcgcagggcgcccaacccggcgtccgccggcgcctcggcgtcgtcctgcaggctgcgggtgagatgcgcgatgtaggtggtggccagcagcagcacgtccagcttggacagcttggtgtcgggcggcacggacggcagcgtgcgctgcagctccaggaaagcgtgccgcagggtctgcacccggctgcgctcccgcgccgcattcgccgccgccggccgcccgctcccggaacgcgagccgcccccagggcccgccggccccggcccggtccgcccgggacgcgagtcgcggatggcggcggccaggggcgcgggctcggcgctggcgctgagggggctgcccgctgggcggccgcggtccatggcagcttcccgcgccgcgcgcgctgcaaaggaccgaaggtgcggtgaggccggggggcggtcgggcttaacccgagaggcgcagccccctggttctccccgtgcgcccaccagcagcccaacggggctaagggcgctctcaagcgagctcgttttgcctgggacgcgatttgcttccggacgtctggggagagttgcggaactccggagttcttgggcttcctagaaggataagaagaggcgcagtgccggctttgcttttcaggggcaaattaagcaaaaggtctactctacccgggaagaaagatctcggaagcacagctcaggatcagcactcgttcgcgcttgggtgactttatccaacccggcacgcacgagaggtggcgcggctccttctcgccgacgccgcggaaaaccacggctcaccagccgccctcggcctttcacgccaggggggatttctgcccgaggagcgggggacccttagcctcacctcggggtacggcacccgccaccgttccgagcccgagagctgcgcagtacgcgtctgacgggcccctcacctttcctggagcggctgagtggagctccgctccgtcgtgagggcgggcgaggggcgtggagcagggcctgtgtggccagggccgcgctggtcactccatcctcgtccggccgatgcccaagtcgacggctgtttccaacctccgctggctgtgacttttatgcgggcgccccgcggccaggcgtgtgtgctccgaccggctaaggcaggtcgggcggaggacctggcccaccggagaggctacgccgggggctgaggcggcttagagggtcattaatcaaaccctccggcggggcgggctcgggggcggggcgtcctcctggccccgcccctcggctcactgcctcacgctgctttccccgaggcgcctcgctgagggcggcgtgtggagagtttggggtgtctgccgccggctgcggtggggccgggctggaggccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccgaatgctctcagtgtctgtaattctttaagaagttcctagagcagacagcccttggatcgtgggcacttctccccggggacggggaccctgctgaccgcctccgctgcccccgcgggggccaccgctctttaattatttgggcgaaacattcttttctggttttgcacttgtggactcacgggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcg

SEQ ID NO: 5294 - DNA, 363 bp, Homo sapiens
  source 1..363: mol_type = unassigned DNA
gcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcg

SEQ ID NO: 5295 - DNA, 960 bp, Homo sapiens
  source 1..960: mol_type = unassigned DNA
ccgtcccccgacgtcccaatcagttaccacctccccgaaggaaaacaaaccggcccttgacacatccctccacgtgcagcgcccgacgccacgggccttgggcggctgcacctctcccctgccggccacggctcaaggccccattattgcgcgcacccagctcccttccaggtgactttcgcgtacctggcggcggcgccctaggcctcggaggctgcccgggcgggctggggctcgggcggcgctcgctgagagtcgcggcgcccctcagccgcttcccgggcgccgatcgccgccctcctgccccggggtggggcccaggggcatcagcagccgcgggctctcggccgccgcctgggaactcagggtcagatttagtttcacaacaacgtctcctcgtcacggcaacccaactggaggcagaagccggcggggcggccgagcggggcggggcgggagcgcggccgccgcgagccacggtggggagcgggcgcgggggaccctggcgggccccgggcagcgcggctgcacttacttgtgtcacaactgcggcgacggggggctgaggaaccggttcttccaaaagcaaaccgaaaatgggtaacagagaggccggggcagcgctaagaggggttctgcctcggtgtttagggcaaaaaacccggctccggcttccagaaattcgagccagcggtggctttttctttctttcctctctaaacgctcctgtgcctccgggtcgaggggcgcccttcgcgcggctccgagtgcacagcgacaccagggctggcgctggagaggggagccctcttcccagcacccctcgggtctcccccgtacccccacccacagcccctttcctgggcccgacgcccctccgctctgcagccggagcctgggcctggtgcccactgccccgcggggtgtctcggacgcctggcccctgcagcgttttctacg

SEQ ID NO: 5296 - DNA, 1404 bp, Homo sapiens
  source 1..1404: mol_type = unassigned DNA
acgcggggtccccgggaaccgccgcctttcttcctcgctcccgcgctcgcgcttcccctcccggggccccggcccacccacccctggtgcggccccgccggactcaggagccccggccgcccgggctgcggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagaggggggctcgggcgtcgtcggggggacccttcccctggggcgggcggcaggtggggggtgtgggcctggccggccggctcgctaggcgcggggtctaggccaggctggggctgcttggaggctgcgccctcccctgcccgcggcgccccggcccccgccgtcgagagtggacgcccctctggggtaacccctcccggcccagaggcagcctcgggggcggggatcctgcgaaccggggatcccgtgaggtcgcccgccatccgtgggcagtgaaacgcgccagcgcgcagagcagactcgcctgcgctgccgtttgctggacgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggaggggcagggcgggcatcccggtccgaagacccaggaactgctctggcctggcctggggtctacacctgacgcctggcgagggttggcttcgggtctggtcccaccgggcctgggagggacgggcg

SEQ ID NO: 5297 - DNA, 1247 bp, Homo sapiens
  source 1..1247: mol_type = unassigned DNA
tcgtggggcaccacgcgcggacccctgcctggcggctcctgcgcccggggctgctgagcccggggttcgtcctgaggccgcggctgtggttcctggccctcccggcccgcgtcactgtcgcgcggcgcccgctgcatcttgccttccttgcggcttcgcatgcccttggtggaacccagctcggcggacgacgaggaggatgagatggaagcctgctggaaaccgggcaaatcccacagaaaactgatgaggaagacggccgagagcaggaccctgggagtatccatggcgggcaagtggctgcgtctccccaggaggcggtggcggcggcgcaggacgcgcggggcacggagcggctggacagcggccggggcccggctcctcgggcggactcggagtgcgaggagccgggtcccagccacacaaaccccggccccgccacgccccctcccgcccctcgccgggaggggaggaatggggagggagggcagaggaggggtggggagggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggcggtggtaccctccctcctcggccccaaccgccaggcctgccgtttgcgcccctcaggggccagcccggagccagagaagcctcgccctgggccaggcgcagggcccagctcggaacagccccattttctcggttgggtatcgctctccacaaagacaggcgtctattcccgaccctcgaggtcaggcaaaggccacgagtctttagagtttggatcgatgctaaaagctgctgcgctcccctgcaggccccagcctctcctctcgcagtccccaacctcttctgacgcagactttagctgctccacttcttcgtctgctcccgggatcctctccctctcgcggcctgccccccg

SEQ ID NO: 5298 - DNA, 1861 bp, Homo sapiens
  source 1..1861: mol_type = unassigned DNA
ccggtgagcagagccggcgcagccacagcgcggagccgcggcgcccactggtcctcggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgcgggaatgggggcaccgagaattgcggtttggtctagccgcagaggcccctgaagtcactcccaacttcttcgccctcggcgggtcttgctgcgtggtctgggaaggacggaggggaaagggtggcaggaggggggagcctgggtcgggcccgcgagggaacggctccactccgcgcgctcctcgagaccagggatgacctggaaacttcggggtcccttcctccgcacaccatcccccccgcgccagctttcctgtttgactgcatgcaagttctggggagatgggggccagatttaagagacccgcgagtgtccagagagaaaagtttgcaaaagttcttttgtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcg

SEQ ID NO: 5299 - DNA, 3044 bp, Homo sapiens
  source 1..3044: mol_type = unassigned DNA
gcgcgcgtgtggaaggctgggtggggtgcgcacacacgctcacttgtgtacgtacacacacacacacacacacacacacacaggcacacacacccgagctcagtcacccacattgcttgcccagggcgcctggaagagctggcgagcccgcccagctctgttcacccggccccgccccgccccctccgggagggctctccgggcggcgcccagccccgagcagagcaaaggacggcggcggccacctccgttctccggccgctggtttctcgtctttcctcgtcctttcattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccacctgcgttccccactcgctccaacctccctcccccgctatccccacttgtgggcctccagctctctgcccctttcctggcccccatccctgacaccccagggacccttcctccctcctcacgttctccctccttccaggatcccgccccgacacttcggggccctcccgctacgcgcactctttctcctcaggtcctgacacctgggcgccccctccctgtcacccaccttcagctccagccctgactctcgggcgccttgccacccttacgctccccgccccgccccggtccctcgggcgcccccactcgccgcctctacctccctacctgctacacctggcacccctgcccccacccctgctcatactcttcccccgcccccgacacctcgggcgccccctcacacgctcctattctccacacttccgtccccgaaaactcgggcgccctctcccttcacgctcagtctctcctccctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaagtaaggacctggctccatattcccgcctctctccctgccctccgccccctcgcccactgccctgcggccgcctgcgcgccccagttcgccgccctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctcggcg

SEQ ID NO: 5300 - DNA, 1603 bp, Homo sapiens
  source 1..1603: mol_type = unassigned DNA
ccgcacttcgcccgaccaaggccggggccgtagtttgcatccggactggatttggatgcagccaatcctcctttggctgatggaatagtctcccctccccacagccccggcgcgcccctccctcgcgcgcctcgccgcctcccgccgcagaacaggagctgcgcggcccggagcggcggcggcggcgccggagtatccgtcccgcacgccggggcgaggggcgagcgagcgcgctcctcctcccgcgccctgcgcccccgcgctccccctctcctcgctgctcgctctcccgtccctccctccttctcttccttctttccgtgttatttttctcttctctttccccttttctctctccctgaccgttcgcttgtacattcccattctccccccgtcgctctcctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccagcggcggcggcggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttggtgggattattgcccaggagcggggtgcgcgggacgggaaagcggtgggtgggtggcggggctaggggagatccgctcccggtcccctagatgtctcaaactttgcctgagcagtcgaagggacaactagacagtcatagacagacagacggccagcccgagcctcgggcaggagagaggctgcgaggagcagcccatgcttgccccgctcagccctcgcgctcccgggctgcttttttaattccgacccgcgcacgctgcgagtccccggcgctgtcgtccagccggaggggcagtcccgctcctttagacgcttattattgttgttgtcattgctttgtgcgattgacgtgggactactcttgggaaccacttttagtaaccagggtagaaacttctcagaaaagctgggcggtcgagacctcggggcgagggaggtaacttccccacgcggtggaaaatcagagcgtcagggtcccgatcctgggcggtgccagagccacaccaaacccgaagcgaaacaaaaagtaggtgtaaaagttcgcgcctctgcggcgggcggccgtgcgtctctgccctgcgggcgcgggctggtggctggcaggtcgtgtcctgggacttcgggcgggtccggctcacgccgccaggacgctcagccgagcggggattcgggtggtgtctggccctggtggcgcgcggagtcctccctgggaggggccgccagtcacttcccagcgcggaagctgtgagttcaaggcggtgggcgcgcaggggagtgcatggccctgagcccccgggtgcccgggggtcccgatggtgcttagaggacacggcgggtcaagagacaccttccgaaacaggcacgctcgcagagatcaagtcg

SEQ ID NO: 5301 - DNA, 1365 bp, Homo sapiens
  source 1..1365: mol_type = unassigned DNA
gcggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtctcgggcggcgcggcctccctaggcgcggtgctccatcccgggctcgggaagcgagccgcttggttagcacgtgggctggggaaaagtttgccgagaccggctgggagcgcctggcagctctggaattccagcggccgccgcggggttggcgacgccaggcaggagcgcggagcggcgggtgcagccactgggatgctccgtccccgcccgcgagcgcggtccccaggcaaggggtgcgcccgctcacactctctgcctccctaaccaattgtgtcgcttcctgcgctttctccacggtcacttcacagctaagatttctttctttccgagctgtagaaggcagaacgctctcgggaggacgaagtgatccgaagggatgtggcaagcgcactttccgatggagatgcagaccg

SEQ ID NO: 5302 - DNA, 419 bp, Homo sapiens
  source 1..419: mol_type = unassigned DNA
tcggggaggcgacctctggatgcgccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccgcgcgctctcccggcacggttcccggagaaagtcccccaatcaccagctacggcacttgtagcctctgcacgccgctcggctccgccgggtgggcagcgcccgccacg

SEQ ID NO: 5303 - DNA, 3675 bp, Homo sapiens
  source 1..3675: mol_type = unassigned DNA
ccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagcccggcgcggcgcgctcagccgcctccccggactcctcccggggcgcgggagcccagcggcgcgcccagcccttacctatggtggtgatgaccgtgatcgcaaagtagaaggagccggcgaatttccactggacgccggcgcggtgcggttccgactgcaggatcaccagctccagctgccggtagtcctcgctgctgatgttgtacttccccttgatccggatctcctcggctttgagtttctcctcctcgcgcatctcgtggtccgactcgagggcgtcgaacacggcggcgcccaccagcaggtaggtgaaggtgcagacgatgagggacagagtccgcacgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcggctggcggggcaggggcggcgcgggcccgggctcagccgagaaggcggacaggcacaggaggctgctcgagcgccggggccaggcgtccgggaaccccgacaccctgcgccagacccggccgaagcagcccgccccactgcgcagggccatgcagggcggccccgctgggtaccgcgcgggccttgctgccctccgcaccccgccccccgctcccgcgggaaacgcagggacgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcgcgcccagcgcccacccgggcgcgcgggtgcgcagcggggtccccgccgggcgtcggccggtgcgcgaagtttgctcggctcaacccccaaggcgcgggagcggggcgcggccccaggacggcagggaccgcgatggagcggcttcgggggcggccgggggacggcgcggtggcggtcggccagcccgctcctccgggggcggcgggcgcggcggcggcggcgggaggggtcccgcgggcctcgcggagcagcggggcggacgcgggcgcatgagccgcgcgggggtcggggccctccggcgtccgggcgtcccgggaggcggccgccgcgctggtctgccccgggcgctacgtgcgtgcgcgccgttgggagcccgaatgtgtgtgtgcgcgtgtgtatgtgcgtgtgtgtgtgtgtgtgtgtgtgcgcttggcagccccgctccggcgggagggcctcggggagcgggggccgggctacgccgaggccgggcctccctccctccctccctcccgcagcctccagggcgcgccacctcccgcctggtccccagccagctggcgaggctgctgtggcagctcccgctgcagacccagcgcggcgcagggcgcacgcggagggagcccgggaggggcggcctgagccgccagggagggggcgggggcggagccgccggcgggttttggcgggggatgggaggataaacgcggcttcttgggtccttctagccccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccaccccccaccccccacctagccacccggcgcgggagcgtgtcattggccagggacatggcctcgtggagtggtggggtcccgagggctgcctcggccccctcgcctcccagcggcacagcccgcttgggccagcacctgcagacccgagtcgtttccctggagagcgctaaggacagcatgggccgccacttttggagtcaggacagcggggaaagacatcgcaatcccccgacccagtaacctctctgttgctttactgaaggaaaaaaaaaaaatacacacacacacacacacacacacacacacacacacacacacacatatatatatatatatatatatatataatcactctttgatatatataatcactctttggttccccacagctgggcgcaaggtgcgccgtggatgcagccctgagccacgcgatagccccctcgagaccacctggggtaggaacacgaggctcgggctggggcgcacctattccctgcttccagatgagccctctccaggctttatctccttcccattttggcctcctttacctcctccccctccccgccctctccctttaggctatcgaggggcttttccttgaccttcggcttcctgaatcccgcctggagccctggagctccaaaaggacagacccaagcctcagagacccctgggctcctcttcctctcctgaccccagccaaggaagggatggagatgggaaagagttgcctggcggcaggctagcagctggccaaggggtggctggggaatcagacctaaccctcgggcagctcgcgggctccaggagaccagtcccttctgtgggtcgccccctggagcggtgctcgggctccctggcctcagggaccccgggcccagagggtctgggaccccagtgattcaccgaggcctcccagctgggacgctctgcaccccactttcagggatcacgggtgcccaccagggaaggggagcccgcgctgtgggctacgtctgagccgtcaggtcctcgctgggtctgcgggcgccctggggcgagggagcggggagccctaccccgagcaggcactctccccagattcattttggaaaccaaggcccccgcgctcggcaagtgagcctggctgccgggtgagtcaccgcgagcgggcgacaaggattcccagcagctggtaattaattgcgccgtggctcagcccacgacggaaccccagtcaggcctcccgccgccctggcagcggcgccacccctgagtcacagccgtcgggcctccgcgcggtccggaagccgcctgcccgcctcggcgccaccagggggcactggactccgacccacgcggcggccgcgcagccggcctcgctgcg

SEQ ID NO: 5304 - DNA, 3675 bp, Homo sapiens; identical to SEQ ID NO: 5303
  source 1..3675: mol_type = unassigned DNA

SEQ ID NO: 5305 - DNA, 3378 bp, Homo sapiens
  source 1..3378: mol_type = unassigned DNA
gcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaaggtaaggaaggctccggcggggggctgggggcgcggcgggtgggggcgcagcgagggtgggagggggtcgggggaggggcgggcgcccagacttcctaacttcgccgtttggggcttcgcagctccgaggttttgcgctcagagctcaggagtttggacccccaccccctaccccctcagccccctgccttctccagcggtggcgatggaatgtggcaggtccccgcgagcccgcattgggcaggctgaggagggggcgaccctggacgcaggagaggctcctcggcgccgccgcctcctccccatccacacaccacagcctggcacccctcttcatcacatgcacagggcaggctggggagggcgttcccgctgtacccccagcacacacagacgctggcgggggtctaagggagccccccatggcccccaacagccacacatagacgcagcaggctccggagagcccccgagcgtgtccccctcctgctaatcacgtccagggccccctacagacattgtaagggcccgagacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcctcgggagggggcggcggagctgagaatcaccgcgaagcgatgcgaccgggagggcttgacggaggctgcggctccgagcccgcgtccctcctcctggccgcggcggctcctgcttggccactccccggcagcctgaagagaacgcctaatctggcaccccagccccaggccgctgggcaccttacccctttccacttttattttgggcttctaagtttcttggagcgcaggcgcctaggctgggacccgaagagccctaagccagccctctttcagcacccgtccccgccgcgacctccccgttcttcctccgggtctggggcgcagattcctgggctgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccacgccctcccttcggctcgctagctgctccttggcgctgctttcagacttgttgcgcctcgatctggggggcagaaggctggcccgggagacccggcggctgagggccgagccgcgaagcccagggatgcgccagagaggcgcgcggctccgcgggtgggcgctgcgctggggggctcgagcctggggtttgccgcctccgatcccagggacgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctccaggcccaggcggccggcgcggggccgcagtggcggaaggcggagggccggcgcgctgccgctgactgccgggagagggcgcccgcaccgcgcccgcgcggccctgcccgccccttccgtctcctccgcgcctggcccgcggctccggccccatcttgggcagccccggccgccacctccctcccgcccgcccgcccgcccgctcgctcgctcgctcgccgtccgctcccgccgccgggtcccgtgacgcgcctcgcgtctcggccggagcccccctcgccggcccggcccg

SEQ ID NO: 5306 - DNA, 1108 bp, Homo sapiens
  source 1..1108: mol_type = unassigned DNA
gcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggagcggaccctcgccgcgctccgaacccgccccgcgcccccaggccacacccggctcgcaccctccccgctccacgtgcgcccacgcgcccctccgggcctccccctccttcccgcgcgggccgggggcgcgggccccggaggagctgggggcggcgggggcgcggggcgggcgactgccgggccccgggccagctctcgccccccgccccgcccccgatcgctcggctcccccgcccggcgctccctcgggctgcgctccgcggctctcggcggcggcggcggcgggcgcagagcgcggcatgggcgcccgggccgcggggcctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcccgtgtcccgcccgcccccagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcggtgagaccccggccgggccggcgggaggggcgccgggcaggggcgcgggcgggggctgccggcgggcctgcgggtggggagggcccgcacccgtcctgtcccggaggggtcgctgtggcccgcagccgccgtggcctggcccggccggcggggtccatgcgcctctggagagggtgggtgggcgccgagcgggtggcagtgtggagttggagacgggcctgggaggagtcgggacccccg

SEQ ID NO: 5307 - DNA, 1700 bp, Homo sapiens
  source 1..1700: mol_type = unassigned DNA
gcgcggggtgggcgctcccggccctccagcccccaactccctcgcgcacccgggacgggtgaaggcgcccagctgccgagcatacccgcgacgcgggttcaaatcccgccggctcccaggcaccctcaccccgccacagcgcgggctgtttctcctcccttccccggaggaattccttaactctccagtacccataccataacaaaggaggctcggtccaccaatgcgcgatcgtagcctacagggacccccaacgaaccccggcccagagaatgcacctggccgtgccacgcgcgacccccgaggggcaggcggacgggtccaggcgcggacaaaggggcctctcggggcgcccaagctcggggcgggacgccgggagcggagctggccgggaactcaccttcgcagcggcccggctgtgctcctcgtggagcagaagggcggcgggcagcagcagcagccagacgctgagccggggccccatggtggcgcgcccgaggcggcgagggacggctgcccggcgtgcgggggccgcggcggacagctagctctcggaaggccggacttccagcgctacgcaccgtcccgggtgcggcggctccaagcggagacctgagcgcggcgggccgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagaccggcggtgaggatgggctgcctccctcatcctgcgctaaactcgctttgtctgtcgcctctaggctaagtgggactgaccggggcccagagtggacgaaccgccagcatggggagagaccagcgcgcggtggccggccctgccctacggcggtaagcgactttctgcctggtccccgtgggtcacgcgcgcatggacccttcggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcg

SEQ ID NO: 5308 - DNA, 692 bp, Homo sapiens
  source 1..692: mol_type = unassigned DNA
tcggcgacccggccatttcccgagggtctcaggcgtcccacccaacggccgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctgagggagccaggcgggagagaggggaaccaccgaggcctcggtcttcccgcgtcccagagcggccgggcgagtctcacttccggcctgtgacccgctgacctgtccttgtcccaccagtcgggcggtgaattggactgactggtgacccctggcaccaggcttccccatgggcaccggagcaggcggacaggggtggggtcccgcgagcgacacggaagggtcagtgtggcggagcggaccctgtggaggcggggtcactgtgctcctgagaagggtcctcgggggtggagtctatcaaggttgcgggggcgtggtcacggagcggagccaataaaagcggggcgtgcacggccgcgggccagtgcctatgaagggcgaggggtgtggtcacagggcgggatctacgaaggatgcaggggcgaggccgggtctctgcaggatgtgcggtcgcgggtcg

SEQ ID NO: 5309 - DNA, 1924 bp, Homo sapiens
  source 1..1924: mol_type = unassigned DNA
ccgccgtttgctcaatgtccccgccagccttgtcggtccttaccgccgtttgactccactgtttttctcgtggtttctgctgcttctctaaattgtccaacgaccgttattcagtaaaaatgaatgaaacggggccgtgtgatctaggcagcctggagatgagattttggaatcataagctacattccaacgtataaaccgattttactcgttttggatactcgatgtacgcggaatgggcgctgtaaaatgcggctgccccgccggaggcatctgcttgggacttgctggcagccgccggtcccctctgcttgcgaccctcggcccagccgccgggaccctggtgcacctgttcctgggcgtcctctctactccccagtggccgccagctccactcccagcctgtggccccggacccgccggcctgagcgttcgcagagggccggtcgtcgccacagccccgcgtcccggcccccgcgccccttggaccttcgccccaggccggcgcagcccagcttcccgggcaggctccacgctaccggggtccagtgcgcggcgacgaagcggagagctgtgtccagactccggagagaaactccggctccgcggggcggcgcggggcggcgcggggcccggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggaggacccggtgcctggacgacccggagcaggggaagcactcggccgacgctgtcgctgtcatcggcgtcattggcgggcaggacagtggggcgggtaaggggcctccccgcgcctcccggcccttcgcgctcggcgccagctctttggctcccttccctgcgcagctctaggcttagctctcagccatttctcaagaagacgatcccgagggtcgaaggccgcccttgacccttgaccacggactctccgtgtaactcggaagagccgtgattttaaaacccggcctcggggttacagaagcccgagatctgggaggcgtccgggacctccctcccagaaccgcagggacccggcctgggatccagggtgtggcctctcgctctgcgcggtcgggaaggcggccgggtccggtcaccgcgccaagcactgcgcacccctgggacgcgtcgttgcggggggctggggggctggggcgcctccacgacgcctggtctgcccggccagtgcttggtgtcgttggtgggttcgtggctgcgacgggtaaacgtccgttccgcgagccgggcaaggcaacccctgcgggtcgcgcccgaaggccggacccctccaagccgcctgggagcttccaaacaggtggacccgaagctcctgtttgatcggagaataacgttcaatttactccgccg

SEQ ID NO: 5310 - DNA, 1991 bp, Homo sapiens
  source 1..1991: mol_type = unassigned DNA
tcggtgcaccgtgctttggcaaccgggtcttggcgcctccgagagcggggcgaggggtgccacgcgattcccaggccgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttttttttttttagatggagtctcgctcggttgcccaggctgcagtgtagtggcgcgatcttggctcactgcaacctccgcttcccgggttcaagcaattctcctgcctcagcctcccaagtagctgggactacaggcgcacaccaccatgcccggctaatttttgtatttttagtagagacgggggtttcaccatattggtcaggccggtctcgagctcctgacctcaggtgatccacccgcctcggcctcccaaagtgctgggattacaggcgtgggccaccgctcccggcggggcccgagtttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcg

SEQ ID NO: 5311 - DNA, 1667 bp, Homo sapiens
  source 1..1667: mol_type = unassigned DNA
ccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtcgccggctccttgcagccgccgcagcgcctccgcgaaggaggacgtgccgacccggctgcgcgcccaaggcagaggcccgcgtcggcgttggctgggcgtgagctgggaggccgagctgtgagcgcgaagggagctggagagacgactgcggcacctccggccgccccggagcacacacgaccaccggggctgcgggaccaagggccgcgtcgcccggaggccgcccctgagcgggcctcgcagccccgccgtccagcgctccctggccctctcccgcagccaggctgccaactcattcgggagcccggggcatgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccaggtaagagcgtctgaggtgcgggagtttggccgggcgcgggggcaacttcggagtgccagctgcagctccacttgggaggactggaggcaaagttttgggacgtgggcctgtcggggctttccttcctactctccgccaggccggggcttcctctcccgggagaagccggctgagtctggacccagcgcgagtggcactcgcgcccgcagggaaggcgcctccgggcagccaaacgacgggactgtgcgtcagtatcgccaggtgccttcccaggttgaagggttcggaacgtgtcagattgagcagggagacaacggagttgagacaggacaaaattaaaacccacgtgcgcacactcactacggtggggtcg

SEQ ID NO: 5312 - DNA, 433 bp, Homo sapiens
  source 1..433: mol_type = unassigned DNA
ccgcgagataaatggtgacttctctcttgcaggcaccgtcatacctcgggtttagattctggacaggcgagccggctgcaccgaaggcccggtaggcggactctggcggagcgcttcagagagaagagtgtagaccgcgggaggcggagggctccctgccagcgtgcctcggccaatcagtattcacaccgcctgacaaccggccaatcagaggacgtaaagctccggggcctgagcggacagtactaggaaggggagcgcagtctgcagactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccg

SEQ ID NO: 5313 - DNA, 896 bp, Homo sapiens
  source 1..896: mol_type = unassigned DNA
acgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccg

SEQ ID NO: 5314 - DNA, 1494 bp, Homo sapiens
  source 1..1494: mol_type = unassigned DNA
ccggggtcttcccaagcggagcacctcaaaagccgcaccgcgcagtagaggtctccaggggcccccactcgcccccagtgactacggagcggcctctacctcccgccggcgcctggccacttctcctcccccgcagtctccgcttgatttccatgtgactgcaggcaagaatagcccagcctttgtgcctctgcaaagaacgcaaacaaaaatgtacaccatcaccacccaacaaacgcgcaactccgcaagacacaaagcgtctcccaaacatcgcttccctggtaacatccggcatcctggggctgccaaatcgcagacaaagacgcccatcagcgcggggggtgaggagactaagggagagacaagaccaacgtgctcccaccaacgggagcggcggttaaaagggcgccggtgccaggggtgagggacggggcaccggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctccgggcccccaggctaacaccccacccccagccccccgacaccaagactgtgcccctctgggtcaaggaaaaggaaaaacttttaaacctcttagtcagcgagagcaaaagaaaggggtggcgggggtgctgaaaggtctaggattatccaccgcggggctggggggagtggagacttgcgagtagcaaaggaaacttctagaccccatccttttaaaaaagccacagcagcggcttccgcgaagcgccgggccgcgcggggtggggcaagcgcaccgccccaccgccccacggcccgccgccacccctacccccacccccacccccacccccatccccgcccccacccccacccccaagcgccgagcccagggcgcccgcgcaccttccccgccggcgcgcgcgcagggcgcgggggcgcgcctcggcctctgggccggggctcaagcgccgcttacccggctcgcggcgcccgcccagggccgcgacgcgagggggcggaggactggggagcaggggtcgccggggcctctggatgcctcgcctcgcccacgctcactgtcttctcttctgaagtaacgacccggcgaggagcttcggatcaaaacgcacagacactcacgcgtgactgagaaacttaatcccgcggtggcccgacgccagcctagcgctccgccgcgccccctcccccagcgcgcgccgcacttgcgccgaccggggctgccgcggaggcggtggcggggcccaggctgctggggctgccgtgacgcctgcgaccggcggggcggcgggcgcgccttggccaatcaggggacgcggccgagcaggcctgtgcggggttttaaactcgctcctgggccgctcg

SEQ ID NO: 5315 - DNA, 828 bp, Homo sapiens
  source 1..828: mol_type = unassigned DNA
ccgcgacctcaccggggaaacaccgcggacagtcgggccagcagcgcccggagctcactccaggtctccaaacttgcagcacttcccagagcgcgcgcgctcggagcgggacctgcttgctccagtgcacgccgcggagcgaaccatcgggctggcgggggtggaggggtgcaggcgtgggggctgcgggccgctcgggccttgggcttctcctgccgccgccgccgcctcccgcccccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccg

SEQ ID NO: 5316 - DNA, 2705 bp, Homo sapiens
  source 1..2705: mol_type = unassigned DNA
ccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctccccggccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtccgtcatgcaccacctgggctaccccgtgcccggccagcttggcaacgtcgtcagctccgtgtggccgcacgttggcgtcatggattcggtggccgccgccgcggccgccgcagccgcagccggagtccctgtaggcccggagtatggggccttcggggtcccggtcaagtccctgtgccactcggcaagccagagcctgcctgccatgccggtgcccatcaagcccacgcctgcgctgccgcccgtgtccgcgctgcagccggggctcactgtccccgcggcttcgcagcagcctccggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggccgggcagagctggcgagtctcagcctttgctggaacggaaggtatttaaatagacgaacaaccccg

SEQ ID NO: 5317 - DNA, 704 bp, Homo sapiens
  source 1..704: mol_type = unassigned DNA
gcggaatgtgggcggggcgcagttggggagcttgcggggaatgtgggcggggcgcagtggtgggagggcgcaggagtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccg

SEQ ID NO: 5318 - DNA, 950 bp, Homo sapiens
  source 1..950: mol_type = unassigned DNA
ccgggacggagcgggccacccgagtggtaaaccttttcccaatggatgcgggaaaagcgcatttgtagttccctcctcaccgctgtcaagcgagctgattgctaaggagtgcgcatttgcttgcctctaacgtgacagtcgcgggagcgccccgcaccccgggcttcagggaatgaaggagtctgccccgaactggccccagaacccccagcccccagggcggcccgcgcccgcacccaccttgaccacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccgagagccgcgcgcccgcccgctcccgggcggccgacgacaggccgcggaggcccgagctggagagtttcaggtgggacaccttgtggagcaggtggcccaggctgccgggcccatcgtcgggcgccttgcgcagcgcctcgccggacaccaagtagggagccgccgccggggtcgcgcgcgccgccgaaaccttgcctccgccgccgctcaccgacaggctgtggagaaggtcatcgaccgatgtcaccgagtcattcctgaagcggttatacttggtgcgtggaagcatgcccctccgtgggctcgctgcatccgcccgggcgctgctggtgccggccccggcgcgggctgccgcgcatagcaggcgagccactgtccccggagcgggacggagagtgggggccccgggacagccttctggagaacgagagcagagcaagaggatggtgccctcccaccgttaaaagccagcacagcggcggccgcgcagccccggcccgggagaccgctgcttggggttgcacg

SEQ ID NO: 5319 - DNA, 4861 bp, Homo sapiens
  source 1..4861: mol_type = unassigned DNA
gcgccgccgccctgagtatcctgcggaaaatgtgagaactctggggagccattgctgctgcaaggacccgcgggcgggctaccgcgctggtgggggggctctgtccaaaccttgcgtcctcgacttcccatccgcctcataaagggttggtgaagaccatctcaaggaccgcacgaactggtccttcaagtcccaggaaaccgaaacaacaaccgaggcggctctctgtccgggccacttccggagcgagctctgcggcggacctctggctcccgctcctttgggcacccgcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctgctccaccgagcccgattgtgtcataaaatattttattggaaaaaaagtcaccgtcttcgcaagagggggtaggggccccagcgacatcggggacccggcctccaggccgagccgacgggttgccccggggcaatctcaggccgttgtggcctgagcccaaccgctgggtccccgacgtccagaagcgggtgtgtgcctggaggctccccggccgggagggcaggccccagacggggtgggggtgcaggcgaggagcggggcgtgaatacgcgtggagcgctctgcgccacggagctcagggtagagactgtagcttccgccgggctggatgcgagtctcccaggttagagcccagaagcgcgctgggacctgggtctggcttttgggtctgtgtccttcctcgtttggccccaattgtccgcattcaagatcataataaaaaggcttaggaagtaaacttcttggacgcggaagggccggctcgcgggtttccgccgagtgagggggctgcgggtggcgcgggcatcccaggccccgcaccgtataccgccctcagtcctcgcggctcctgtcgctgggctcgcccggcacctccgccggtttctctgcatccttggcgcgctcctgctcagtaagctgctcgctcgttggaattgagttcttcttgggccgccccttgggcttggtgggagactccaggccgccgccctgcagcacctgcacgggggaccgccagcacctgggtgagccagcacgtggactggggacccccgaggagacttgaacccaggtaggactaaggagtgcagggtccatatgaggaaatggtggggaaatgtcccgggaaatggcggccatttgtccaaatgccgcctggggagcggcccggcctggggagcataagactgccaggaggcctgaaggtgccgcgggaaaggacgaaatgttggcttacccaaggggcagaaaaaactgagaggattccggtgcgtaccaggcaccgagggaatcggggggttgggcagagtctcagtggggagaaagaggagagcagctctgcatgcaccggggcatggcccaggaagctgaggggtgggaagccaccaggcacactcactattttcttccacttcatcctccgattctggtaccacgtcttcacctgcaactggctcaggcccagggactcagcaagatctattctggaaagagcagggcgcaccctcagcaaggcaagtgaccacactcccacagcccgctggccccagccttgtaccgccctacctgtccggcgtggaaaggtacttctgcttctcgaagcgtttctccaggcccatcagctgcagctcggtgaacacagtgcggctccgacgccccttcttggctttggtgcctggctccccagggcctgccgcctccagcttcccgcggagctgcaactcgagcggcaggtgtggcgcacccgcggcgccgggcagcccgggccctgccgccagcaacgcagagctcagccctgaacagcccagcggcgccagtgggaacttgaacaccgccgcctgctcggccttcagcacggctgcgaagaaagagaatgaggacccgggtgagctacggccgcgctcctctgccccagggactgccgcaccacgtgccgcgggggtgctcgcgcttggccagtgcctcccagcgcaaaacctccacgccctgccggtcggcgccggtggcgcagatggagaccctcctcaacgttgccgttccccagatttgggagggagtatctcctcgaccctgtccgtgttctgtcctggagttccccaggcctcagctgcctctgagatctcggggttcctgatgaacatgtttgcagctgcgagaaactcggagtgtgtcttgtctttcggggaaagtagaaaccaaaaagaaaacggcagctggtcctaagaagatggcgtttgctccaaccaaatcagccttgctgcgttagaaaaagaacatgcacggagcgtgcacatttgctcttccgtgcgtggcacaacagccatgcggtggccaggagtcatctgggccggagttgggtgcttcccggaaattccaaagtaccctgagaacctggaaattattgttcacgttttctattttcagacgcttccccatgcagatgtttccattttcttcagtcctaaaatgattgtgtgcccgcttcaaacgaattagtagcaacagagcagatggagacgaaaggtagccgaatggccgagtcccagctggacttagaaggagcgcgctggccctgccgtctccaggctagggagcaccgactaggaggtgggggggtgcagggaaggcgacttgaagggctggggtcccggctacagcgtaggagcctcccttccccgacaggcctgtcactgaggtgcgagtcctagcctggctggagtcggaaagggcagggcaaggcgcaggtaaatgtggggcagaggacccgtagggaaaaggtgggagatgggaggcaggccgaccccaatgagagaagcgagggaggccgaccggcagacggttggaaagcgagatagggaaagacaagacgagggtggagtgcgatggagacagcaccatcagggcagagcaggccccgccaaattagaagaaagggcagaagctgaaaaggtctgcgcaggccgttcaagccctgcagaggcccagccgacctgaaaccagaagggacagccaggcagctgctcacagtcaggcctctggccccaaggcaaggccgaagcaggtccgcactgcggccaaggccgcgttcctcgcccgctggagctcccggggactccgggccggcttgggcccgcgtcagcacccagccctcgggagcgcaggcctcctccccagaggtccgacttccctgggttgggcagccgcggccactcccggccatccctctgcggcgaagcccaggcgcccgtggcctgaggtcgcttccacccacgagagtccgtagcctggcagtgcgcctgcactggggatgctcactcggggtccccgggctggaggccgaagggaagcagtgaaggaaagagcgaacaccctccccgggcggcccgcgggcacgaggcctggtttctgtgaggcctggagcttgcaccctccgcctcccgcctggagggctccgagagacggtcccagaacctgcgctcccagagcagcttcccggggctgcttcgatgccggaggaggctcggggcgcccccgcggttcagctcgctgtctcccgccaagcccggcccgcgaccccgcggccgccacacgtacccaggtggctgtggaagggccgcgccgccagcagcgcctgcacgccgaacttcagcagctcgcccgccgcggcagcggcggctgcgggcgcggcgcccttgggcccgggtggctccgtgaggatctcctcaatcatgaagctgcgatagcggtgcggccggtggtccgcgcagccctcgggcgggccgaagcgcgcggcgcccggctcccccggccgctgcatcgcggcgcccactgctgcgcccgcggtttggcggcggcggcggcgacggcttggctccggcgcggggcccgcgcggggctctaggccggcccgcagctcggggcggcgcgcgggcgccggctcatgccccctcccccgccggccggccgggcggaggcgcagggcgcgggcggggcgcgcggggctcggccggtcgaacccgggactgcgccccctccccacgccgccgcgcctcttgcccggccagccccgcgtcaccgccccgccccgccccgccccgcgccgccgcccccaacccctaggctgagccggagggagggacccagaagggagggaggcggaagggaggccaaaaaggagggggccacgtgaaagaggccggccgaccgagaccgagggagactgagcggagcgcacgccctggaaggagagagccggagagttcgggaggcaagacccccagagacgagagtcggagggatcaaacgacacaggtgagagaaggggcagaggcagacggcgtgggccaaacaagattccagacagtgatgtgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcg

SEQ ID NO: 5320 - DNA, 999 bp, Homo sapiens
  source 1..999: mol_type = unassigned DNA
gcgtaacggcctgtttgcgctccctgcggttacagccgacacacgctcgcagacgcacgcacggacaccccgctttccaccagcgcacgaagacgggacgcgcgctcacagccccagggctcggccctgcaccacgagctaacgcgcggtccccagggaggtggcgcagaaggcatggcgcctctgcccacggcgtcccggtcctggtagtccctatagagaccttcgttgatggcccaggtctaaaaggctttttcctccgagcctgcgttcctccagccttcccgctgggccagggctcaccatccttcctcgccggcgagcgtgggcctccctggaggcgggggtggccctgcagaggcagccccaggtgcgcgctggagaggccggcccgccgcgcgggagacactctttccaaagtggaagcgctgcgtgggcagcagcgcgggccgggccctcggatcccagtctctgttgctcccgagacccccgccccgcgccgcatcctccgagctcagcgccctcgggctgcgctgggcgcagtggctcccggtcagggcgcagtcggcctgggcgctagagcccctctcagctcccggcctagggcggggaagcgccagctcccgcagcccctgtgaaaggtcccctgtgcctcctgcctaggtgcgcgctgtggcatctctggccagaagcacctttggcggcctgttgggcccctcgcagcctctggctgagactctgccgccggcgctaacgggctgcgcccgcgctcccgctctgtccccgcccgggtcccgggctccgcgtgcacaccactccttggccttttccaccaaaacttcctgatctccagttcgatgctgtcgtcgcggttcccggaactgctgtcttcagacggcgagccggggctgggagcggccctcacggggacggactccctccggaggcggaggtggttctcctgacgcgaaaggcaggggcgcgccccggctcccagcg

SEQ ID NO: 5321 - DNA, 1750 bp, Homo sapiens
  source 1..1750: mol_type = unassigned DNA
tcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttccgcagttcccagtccccgatgtggtacccccgacccgcgtactcttggtccatggagctcaggagcgcctggcccaggcgtctcccgaaactgaagagtttcctcatggtggcgacttctcagacgccaaccacccgctactgagccgccgcggctcctcgtggcctttccaccccgaccaagttccaaatccgcgatccccctccccaccccgctatccacccctaaatccaagatccaccaccaaaccagcaatccacccccaaacccaagatccacccccaaccccgcgatgtagctcagaatccgcgatccagcccggtccaccacagccttcagcagcgacactcgcagcctccgacctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatcccggaatcgcaggcgcgcatcccttcccgcctgagggcccgcctggccgtgactcccgctcctctcctcctccgaagagagatggggccgctggcaggggctctccgcagccaccggggatggggctgagggtcggttcctgccccggtgcagccgccgcgggcagaccgcctggcttggccgcagccacagcgacatctagccccggttctgcgaggctgggcgcgccagccagcttgggagttgcctggcgcctgtagctgggcgcccaggtggtggagcatggcctgggcggcctctggatcgcgagtgcccctggcctgagagcccgccagaccctgcccccacccggctcctcctctgccagagctcgagacctctagccaggggccctctgcaaccaccggggatggggctgagggccggttcccgcccctgtgcagctgctgcaggacagaccgcctggcttggccgcagccacagggacatctggccctggttctgagatgtggggagtgcgggcgggctcgagagttgcctggaggctgctgcctgcacacagaaggcggctgcagcttgggtgcccaggcgggctggaggtgcatggcctggtcggcctcgggatcgccagcgcgcccagcctgagggcccccaggtcgtgcctcccgcccactcctccacctgagggggattggggccgctggcatgggcactcggcagtcaccccgtgtggggttgagcggcgggttctcggttctgctcctgtgcagccgccgctgggcagaatgcctggcttggctgcagccactgggacacctggccctggttctgcgatgctgggagcgcgagcgggctcggaggttgccaggcagctgctgcctgcacacagagggcgactgcagcttgggcgcccaggcggcggagcatggtctgggtggcctctggaatgcgtgcgcg

SEQ ID NO: 5322 - DNA, 391 bp, Homo sapiens
  source 1..391: mol_type = unassigned DNA
gcgcaggtcgtagaactcccccgcgaaggtgccgtaggaggagtcgtggcgcggcaccgcctcgtcggcgcccgtgtccccccgcgcgcgtccccggggtccccggccccccgggcccgcaccgtcgtccgcggggctggctgcgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctcggtctgcgcatcctcgctccagcaccg

SEQ ID NO: 5323 - DNA, 817 bp, Homo sapiens
  source 1..817: mol_type = unassigned DNA
ccgggatagagacgggcaggcagcggtgggtcgaagggcccggggactagggcccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaacgcctggcccagccgctccactctgctccccgccgcttcgtcgccaggagcgggcggcgcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccccggagcgcaggcggcggctcgggcgggaagaggcgctgggcggccggactcgcagaggggcgtgcgcggagctgggcgcggggcagcggccaagagcctcagcgccctttcatctgacactggggacagacacaatccagactcctcagcagctcgggaactccggagggaacggcgcgcg

SEQ ID NO: 5324 - DNA, 814 bp, Homo sapiens
  source 1..814: mol_type = unassigned DNA
gcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacaggtaggtgagggcgcctcggcgggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatccctgggaggaacctggggagccctcctggcggccccgcggaccctcggccagtgagggctggttcccggagcctagggcacgtaacccgtgctccg

SEQ ID NO: 5325 - DNA, 1429 bp, Homo sapiens
  source 1..1429: mol_type = unassigned DNA
gcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagccctcccgagagtggagttgcaccaaggacaaacactctagcgtcattacaaattttttctgccccttgggcgacctccagatgaaccctggtgactctcagattggattttcattccttactttctttgaaagaaagtgccccagatgcgtcaataaaacatgcctatgtattcgtgtaggcgtccgcatgcctgcgcgccggccgtgtgcaggcgccgaagcacacgtctgtgtgaacacacgggcacgcgcgtctttgggtttagtggtccttccctcgcg

SEQ ID NO: 5326 - DNA, 7708 bp, Homo sapiens
  source 1..7708: mol_type = unassigned DNA
ccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcccggagcacgcgctgccagggcctggggcgccgagcggccaatggcacggcggcaggacgtgatgtcaggcgcggctgtagaaaaggcgcggaggcttgcgctggcgcggactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacggtaggcgcgcggctgtggggtcggggctgagagctgggatggggccgggccagtcagcgcctctgctccccgaagtttggggagcgtccttcgtgccgcacgggactgggtgctggggatcctcggtcagaatgcaaggccggtggctcccggttcgggggaaacccggctgctgggacgcagaagggaaacaaggttgaaaccgaaatctcggccctgggggtagaggagagcgtttcttccgaactggaagcgaagtcccatccgcggcccggggcggctcccttctcaccttgcccggtgccggggtcgacagccccgcgctctcctccacctctcggctccggttgctggcggcgccgcgagcggcgccagggaagggcgaaccagctgggagcattggggctccagccggcttgggccgctcccagctttccggcaatcggggatcctcctcaacccccagcgcagtttcagaggccgaagtcttcggggccaacatttgtcgttgatcgcgtccccagacccttgactggtcagacttagccaggccagggctgggagttcaggctccggcctggccctcgccgaaggagactccatttggatctctacacctggctccgcgggcccagccccaaatagccagttcctcgcctcaggcctccctgggggccagacgagcagacactgcccgaccagcgggcccagaagtgacctttaggaggccgcggaggtggggagcacgggagaagcttctctgctccgggagcaggagcagcggcgccagtgtcctcccggcctctgagcgcttcttcggttagaccttctctgctggtcagtttggatagggaagtatttgggttgaacctgtccttcacccacggactttgagggtgtccctgcaccccacttacctcatccccggacccaagagggccccagcccgtgtggcagaggagccagaagttggctgacttgtcctggccttaacctctggtctaaggatccagggatcactggagctggggcccaggaactccgctgtctctccaaagaggattctgtgtggagggtgacttaatggtcaccttatcccccgggtggctcatttaagaagcagtttagggaaagctcttggagggcttgactggagtagctgtcctggtccctaaacacagcccgagcattttgggggaaaggacagggaggactggaaggaagagaggtaagcaccagagccatttaggccaggagcccggcctgggcccgtggctggcgagggctgcgcaggcaggcctgggttctgaaccgcccagaaatggaaatgggccttttggggtggggggaagcgcgccgcatgtcctggcagccccctccgcgttcagggtagccaaggccacagagggagttgtgggtgccggtttcccggcggcggaggggccgctggctgacgcaggcgctgctgtcttccgcctccctcccttcgcagaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggtagcccccccacccaactgcccctcaggacccctccccccaatctcaggcacagtcttacagtttggccctctcctttccgtttagtcccaggagagggttcactactcaggactcccccgctccccccccaagttctccaagccaccacaagttgggtgataaccttttaaagcagcaatttggggagctcttggaaaggtctacgaagtaggagaaccagaaaaaaagcagaagctgccctcctgctcggagcttagaccacaaaaaagcttgagttgggatccttgctcccctctctctttgaagtttcttgagttaatccgaggttatagaaacaggcacccccaaacctaggcagcccaagctggagtgaaacacagctggaaagagagctgtgggagtgggtgcatttccaggtcttttgagaaaatgggaatgaaaggtggccaagatcaaagaaccagaatcactagtagactccaagttctctgtttctccttctccccagttttaggattagggtctatgtatattctctctgtctctgtctctacgtctgtgtctctctctctttccctgtctctgtgtttcttccaaattataaaagtcagtaggattcccaggcgctggtttggagggaggagtaaaggttgaggagggggtaagtggtaagtgtctccctccactcccaggtaaaggctttcctagggcttgcggagactctgggtgaagtagaagtctctgtaggcataagtgtgttaagggaaactattttaggacaggaccaggcctgggtcaaaatctagttctctctcccccccatcctccaaataaaggccgggttgttcgtcttgaggaggggattgccccccgcagcagcagcggcacctggaggaggaaaaggggggtacccaaccgtgtgttcccacagcccctccctccatggtccctacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctggtgagtgcgcggcgcacgaagcgcccccatagggttgggggaaagtgtgcggcctcgacggccgggagctggattgaatctctgtgtgctgggcaaatagcgagccttaagcaccggacggcctcgcagaagggacattagccccctgggcttccagactgtgcgtcctcggctggagcgggaggagagggtgcagtggtcccttgctgctccgggtgcagggccttgtctctgataaattgtttttttggagatggctttttggtttgggcctttgccccactttgctaggcaggaagtggcagggatggagaaagcaaggcggcgctgacgccaaacaggttttgggttggcgcggctgagggccgggaactggggcagcgaaggaacgaggcagggcggcgagggtcccaagagaaagggctggctgtggcccggggcgccgagctcggcctggagtgcggcctgacctcgtgaaatgtcccaagggcggcaggcttggggaactcgggcttggggaactcaggaaagcaaaggctgcggttccttttgctcggcccgatcctcctttaaagacaggtctcagttttcccggactttttcctccgagtttcctggcgcctgctggggtgagggccgtgaccctcggaagcgagccccccgggcggggacgagaccggagcaggcctggcctcgcgccggggtggggtggggtggggtgaggtggggggcttggttcggatttccggcatctttgaaccccaggccattcccggagaagctctgccccctcccgcgcccctccctgctcaggacagctgcagaggttctgagttccggcaaatgagccgtcaacatctgcccgaagtctgcaaggcccggaaaggtttatgactctccgggcttccgaactagagtttatgtgcaattattttctttctttcgtttgcaacagaattagatttggagattttgtgttcttcttccttttccctttagtctaatgcacaagcagaaaaaagcaaaaacaaaaacaaacccaagactgtgcagagggtgctacggcgggaagaagtcagttattttcatcttaaagaatctgagttgaatagagagggaaatgaggggcgggtgttcgctccaacgaaatcgcttggaggatcatggggcgtgtgtccctgtgtgcggaactgggaggaaaacgcagcccccagtttggtaaatggtgaagcagcggtaggccggtcggtggcgcggatttaagatttgctgaaggcactaccacagatgtagctctctggaacttccatccctcctctcctaccaccccccaaaaaaagacaaaaccgagttcagaccggctcccccaacaccaagccgcttctatttatcaagtgggtcaacttccactcggaagcacctcgcggggctcggctccagggcacctggtggctggggagctgtattgttttcctgggcacggaggttcggcgccggttttaggattgtgcaaaaagagagtagaaggtacagagatttatttctgctttttgctgttcagccgccgtttgccccagcgaggtgggctggaggctgaatttcaagccttgtttaacctctacaagagacaccctccattcagccatctcactttctctctggcctccctctctctttttttcctttccgttctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccgggcgctgggcttacagcagagccgcgggccgcggggtcggaaagtccttccggggcggggccgcagcggcctcttcccgcagcccctcgggcccgggccccggtggaacggaaacctccccctaccccgggaggggctgccagcgggctgggggtgcgaaaacggcggcaggagcgggcgaggggcccgggccgcgcactttgcgcctgggtttgcgcgccgcggccgcgggagtcccgcgcggaccggccggacgcccggcctcccccagccccagctttttgtgtgtgtgtgcctggcggcgtaattactgatttgattccaatccattatttagacaattgaacctacaatctcgtctttagtaaaatgaggcgaagtcagatttgattacaggttcagtcccagcgacaagagctcgaaacccgatgggttaataacagatcacgagtaaattattcatgattttacgagctctttagctccattgaatcggcctaattgagaggaaaaaaaaaaaaaaggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttccccttttctctactcccccgccaataacggcttcggaaaaggcctcccccgcagggaccgggtctcccggagccccgggattcagctcggccaccggaccctcgccacaagctgcgcctgtttccgggactcgctttcccctccg

SEQ ID NO: 5327 - DNA, 3969 bp, Homo sapiens
  source 1..3969: mol_type = unassigned DNA
ccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacg

SEQ ID NO: 5328 - DNA, 2490 bp, Homo sapiens
  source 1..2490: mol_type = unassigned DNA
gcgtcccttccccgcccgaggcccacccagcgccagcgcccggttctcttgcagcgactgggccctaatgtcgcacgaggggccttcgcgaaggccaatggtactatcccctcagcccctctcccacccccaccccctaccccctcaggctgtggggggtcaggggtcgaggcccgcgcggcgcgcaccttccaggcgcatccccaccgtcaggcatttctggaagcggcagaagggacagcgcttgcgctgcgtcttgtcgatcttgcagctctggctctcggtgcacgtgtagtgcttgttgttctgcaccgtgcgcttgaagaagccctgcgggagctgagagtcagcgaggccccgcagcgcccgtctgccgcacccctgccgcgcgctcgccgctcaccttgcagctctcacacgtgagcagtccgtagtggtagccggacaccttgtccccgcacacggggcacagctcgtccaggtcctcgtcgtacgaatagtccatgcccgcggcgtccgcctgcggagggacagcgggtcagggagggccggcggagaccggcagcctggggtccccgcggccgccgccccagccgctgtcgccggcccgtcgcgtaatcccctctctgtgcccaggcgctgccgccggcacccaccgagcgccccgcgcagcgtcccggggtgggtccggtgcagtccccgcgcccggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtgttctgggaacccgacagagacgaaggaggcagagacagagtccgggggagccagagatgggaagaaactctggcgagagacaacgaccgacgccaccgggcgcagacacgaggccagtccgagagtgccagagacacagacactgagacgcccagctagagagaacccggcggggacgagacacagggagggatggagagagacagggagacagagagagagagagagagagagagagacgagagagagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgccgggcaggagcccaagcgccaaggcgaggccccgcagggtcggacccagacgggggcccgggccgcaggaggcggaaaacgacggcgccgggaccgagagcccgaaaacgcagagccgccgggaccccctccccgggggagacaaagccgcagcagcgacggcaacgggaggcgcagcccgagccgccgctgccaccgggacgtcgggcggggagacctcgggcgggggtcggcgggctccgggaagccgagcccgaggcgagggagcgacctcgggcggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcgggggcgcggggctggcggcgcgggggcctcggctcccccctcccgcctccccgccccccatcctgcctccctgttcccccccgcaccgccgccggggccgctccgaggcgcacctgggacccgggcccctcagccgccaccccgccctgcgccaacccgccgcgccggggccgggggccggcccctctatatcggcgcgtgcggtatccgggggcggaggcccggtcgtgtcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggtatagggcagtgggggccttgggtcacccgcctgcagtgggaggaggcagctcctgtctgtgaacccagctgggtcgtggcgaatgccacgcgggtggctggtcgcactacagcgtggaagtgggtaagggcgagtggcgaccgtggccgaggctcggattcacg

SEQ ID NO: 5329 - DNA, 5370 bp, Homo sapiens
  source 1..5370: mol_type = unassigned DNA
ccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccccaggtagagagaatccgaggctgtttctgccgctgaaatctgagcgggagagcatcccgaagccgcctgcgtggagcgagcagcccccgcgtcatgggccagaggcgcccgggagaatctgcgggtcacggatcacacccgcaggggcctggcggagcaaggtgccgttcgccgcctgcgggcaggagccggctctgggcctcggcccctgctgtgccgtccagtcggccgcttcttcgcttcttcggcaagggaagcggtggagaggcgcgggagccccgattgtgctggagagatctgggacccctgcgcgtctgcgtgcgaaggacccgagaccggccaactcagctgggagcacgggacacgaggagtgaggacaaagggcaaggaacggggcctatagggagggtgtgtgtgtgtgtgtgtgtgtgtgtgtgtgtgtgtgtgtgtgtgtgtgtgtgtgtgtgtgtagggggaatgaatggacagcggggaaggcatgcagaggggcccaaggggtgtggactcagcagccccaccccagaccagagaaggcagccaggctctggcgtccaccgagccagcgcccctatctgggcgcgggccgcatggcggcagaccaccctatatccgccttggtggcgtgggatatgactggcaggagcgcggaagaggcgctgagaatgcatgcgcacccggacagaccagacgcggcacggagggggtacttcccacaagtcctcctgccttgagaccaggccttcgagtggtccggggaatgcgcctctgggcacagccagcggccccagatcggcactggacgccaacccgagttagagaagcctgggagactggatcgcaggggccctcattcagccaaggagggggaaaggagagctgtagggtaggagaggccaggcacagggaaggtggggaggggatggagccttgcgccaggagttgggggtgcagggcctgtgacgagagagtattaccatgtgcaccctgaaggagagggagagggtctgggcctggaacgaggactctcgcctgcaggcagtcgcccagccccggttgcagggatggaccgcgaccagcagagggcagaaagtgcctggtccgcccgccggccccgagccgcgctccgcgcctcgggactctggctctgtgcgccgaagccttgcccgcccggcttctccctgcagcagccgcgcccccgccccagatgcccggagaaggcggctcaggcccagcccaacttcgcgggtccaggcctggggtttccaggtcaagcaaagaggggaccgagatgtgggagagaaactccacattgactgtccactctccccgacctagccacacaaaggcgcctagaaatacacgaaggcacaaagccccccaccacacacaaacacacacacacacacacacgctaggagacacgcgagcacacagaagcattcagaaccccggagataagcacagatacgcaaagctgacagagacacccatacagaaaaggatcgcagacacaacacagaggctgagacacgcacaaagacttaggcccccgcatgaaatgatgcggacacacaccccagacacaggcacgaaggacccacacattcacatacacacgggtgcaggggactcagacacagatccacagattcacccctgggagtctggaaggttgcagggacacacataccgtgtgtgcagagccaaggagcacacggaggcaagagccgcagaggcgggggcccgacacgcacagacacacacagatacccaccgacacacacgcaggtagggtagggcgggagcctctaatcctccacaaagccgggcccctccgcggggccccgcggcgcagggggccacttctgaccaagcctcccgcaggttccaaatccgatccgccctttcgcctccagcgaggtcaggggacccgccccccatgccctccgcccccgcccggctccgcgccgctgcctcgctccgggaggggccggggccgccccgcagcggatcgcggggggtcagcccgccgctaccccgggccgcaaccgcccccctgctccccggtgagccgcgcgtcggtggggaccacgggccgcagacagccggtccgacgctgtggcctctcgcaccggacgcgggtgccaggcccggctggcgcggaagtcggcagctccatctcgccagctttcgcgtcccgttgccgaggtccactttgcccaggctggctagagcactgtccttgatccgcgcgtcccagcgacccctggccgggcacccgacccgccaaaggaccccgatcttggcagccaacctaatttcttcagagccgctaccctggggccaccactccctcctagcgcccctcactgcaaaccctaggaggcccgggtcttgcccactgctcctgcccctgcccggggaccccttttccagccttagttgtcctctaaactctcggtcgcctgaacccaggcctgaccttccttgtcgtcccagtgtcccccattctcgatcccggggccccaacctcccatcggctcagtcccccgcccaatctctgccaggcccggagctttcccagacccctcacccacactccaggctcactccccgttcctgggcctgggccccccttgcacgagtccagggccagccgtcctcgccttctgcccgcccccgtccttcgttcctgggagccggccctctccgcggaccaagcggccccgagcaggcgccgccgcccgggggactccgactcagcccccgcgacctacctcggccgacagtcgggggttcccaagcggccactcccggccggcgccgtcccctggcggagccgccgcgctccctgccgtccgcgcagtctggcctcgctcggggccactcctcgtagcgctggagctttacaaaatattaataataaagaaggcagaggagaaaaaagaaagccttcgctccccaactcccaaatcaatttttcaagggggtggagcagagggatttgtttcgaagacgatcaaaacttctgcgaggggcccgcggggcggccgggccggggagccggggcctgagctcggggccaggcgcggcgcggggcgcgggccaggggcgcggagccccggggcgcgcgggggggcgggacggcactatttgacgtggagccggcggcgcatcccggcgcagggataccggccgcggggttcaaatgtcaggaagtttcgggaggtgaggcggcccgtatccctccgccgccagccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccgccgccaccgccaccgccgccgccgcctcctccccgcggctccgtctgcagcagccgccgccgccgggttccgggactgacaagcaggtgacagaggagccggcgcgcgtggctgcaagtgtccgggagagcgcggcgcgggctgcagccgccccggcccgcccgcacgacgccggggcccggggccagcgcgtcgccgctccacgatcgccgggggccggcgcaacccctgccctgcgggggccgcgcctccccggttccagggccgcggcggcggagagcgggtggacgggccggcgggcgagcagcccggccggcggggtccgcagcgcgccccgcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggtgagtgcggggtcggaacgcccgagtggtctcgggcgtgggatggggcgtcgtccggctgtggacacgggcgttggggccaacggataaaggaaatgggtttgcaggacatggggaggaggcagagacaggactcctggagtgatcgccagagggccgcaagtacgcctccggcaggcgtcctgaggggacaggacagctccagtcgccacccaccatcctttccaggcttaggttctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagccggccaccctgcgccgtgctcgttgtcatttgtcttaacacggagcgcggattctccggagaaggggagagcacagcgccgagccaaggctcgaggcccgcggcctctccacgccggagcccgaggactgggacggactagccggggccgcccggcccctggcgcggcggtccggggagcgcaggcggcaggcggtgatcccgggcggcccgagccctcggggccgagggctgtgggcccggtgcgaccgggacgccggggctgggccgggcggcgctgacggccgggctttcgccctgtgcgctacaggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagtaagcgcttctcgtcctccttccccgccaccgcccggcactcgagcccggtcagccccctgccgggcccggcccgcgcccgctctgccgccggctctgtgcgcggctgggccgggcagctccaagggttccgagagctgcgcgtcttggggctggggcggaccagcccagcccagcgggcactgatggggtcctgggagcctccggacggcccccagttgccatccgttgtcccggaatcctgcgctgggccggccg

SEQ ID NO: 5330 - DNA, 3120 bp, Homo sapiens
  source 1..3120: mol_type = unassigned DNA
gcgggagagcttccttcgacgtccggacacgcggatggggcggctttcagcggcctccacccgcgcacccctccaggcccacctctcggcggttcgtgcagcatgttctttactgggagtgggatgacaccatgcataggctcctgggctccgcagccgagccgcgggcaccagcggcggttgatgaatttcggtgtcaccaggggtttagcccggatttgggaaccgcgcgctctaatacgcgcacacggtcctgccctttctaaagcgcagccctttcacccagcagctgatttatggaggaattcgatcctgggacgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaagactggcggggagagctggcattttcattccttgttgagcacagccctcgcccctccccaagccctcctgccgaccccctcgggctggccaaaagcagcaagttcgggaggtttgtttattgagagaacagaaaattaggggttgcgggggagaatctaagacccttttcccgcctgagaaacgtgcgaagtccctcagctcctggaggcaaccaggcggcccgaaagccgagttcccggcgcggatgctagggccgaccccagccccctccctcctgcgccccagcccgagggcggcgagtggcaggtttttttttatcttgtttttttttttttggatttggtttgcaggggggaaatgtggttgtatcaatccacaaatatttactcttaacagacttgtatctgtggagatttcgaacaaagacagtttagggggattacaaaaaccctaaaccccgtttttctcccggacttggtgctttaaatgccaattataggcgagccatatccaacagcaacggggaaaggcgagcaggctccggggagggaggtggggggagagtccggccattaaatgtaacttttcattatgaaaaggatttcgccggttttatcttctaataagattatgtcacgaacacaagtacctaggatggtgctgagtgacagggctctgtcgtttaatcagaggctgtgccgctcaaaccgcggggccctttgtcccacggagtgaacgacggaaacttgccatcctaatccccttattcatgtcaagcacagaaaagaagccgagcaccttacaaccgtgtcccctccaccccttccgaggacggcgggaagagggggctccggccctgtagccccctgacgcttttcgtttccgagcgcgcttgggcctcaggagccggagcgttgccgtgggggcgggggaaggggtggttttgcgggtgccttaattggcagcgtctggaaaatggggacagtgaccccacgactagaggatgaatggggggagggttagtgggatgtgtttgcctcctctgaccgagagcacgggtcctgctctgtcccctcttcccaggaaaggtggcactccgggtgcacacccaccacccccattaaagcgggattgaccagaagagagaggccgaatggagatgccaggctggggccctcggcggggcagatttcgttggatccctgggactaatgtcgcagcgctcgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctcatggacatgggggtggggagctcgtggggtttcagcccaaaggctccagtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtgtcacctcgtaaaagcgacaggcaaggactgttttatggggagggagaaggagcaggaagtgatgcttccatctctgacagcatagggaccgggagctccgatggaggaaaccctttccgggcaggacgagtagagggacaggacatggccggggaccatgggattcgctgccattaagtatgggacgggcaggcgagagcggggaaggggaccgatggagccagaagccctgagctcacctcccgcccgtcctctcctggagccccctctgcaatcccggctcagtcggcaaccggcccttccttccaggtcaggggtgggggagagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccg

SEQ ID NO: 5331 - DNA, 3120 bp, Homo sapiens; identical to SEQ ID NO: 5330
  source 1..3120: mol_type = unassigned DNA

SEQ ID NO: 5332 - DNA, 7861 bp, Homo sapiens
  source 1..7861: mol_type = unassigned DNA
ccgctctttcggaagccgtgcctctccccctctgcttccttcatctccgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttgtctctcccgagccttgaaagctaattacattgggaggggacaggggtggggtgggagagggggccgctgtccccattcactgagccgaggccgccactccgccggcagccccgcgcaggcctggccccgagtcacgtctgttgaaaccgtttttttcggcctcgcccccacccgccttggcagccagccgcgcctttgtacgcgccggcgggggcgccctggaaccctgaaccgtcttacggggaacgggggtggggggaggggagcggcgcgggccccacgcgaggaaggaatttcctgggccactgcgaaagattgaggctcagaaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgcaggggaagccaggacggagcgcagcaccggcaggggagggttgccgaggggctgtgccgaggagcccgggtgggggcggctggaccgcgggccgcgggactcacagacagtgcgaggcggcgcgggggcccctctccctatgcggggctggggcgcaggggctgggcggggcgggtgggcgtctgagcgcggcgcgggcgcattcttcgccttttcttcctcgggctcattccggccgatcgatacctgcgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaagacgggctttcactcggcccccaaaaatgtatttctcggcggacaatgggcttctttctgcgcctctgagggccggcggggcgggcagggcggggacccgtgcgctttggccccgcctgaccgactcgcacccccctcccccgcacccaggcccgggccccagagcgagggcgcaggagccgcgaagccggccgcccttccgagcgtccccctgaagcgcactgtcgggacctggctctcccggagctaagccccggcgcaccggcgagaacgaaagcgtcgtgcggggccctgggctgtcccacacgcccccgttctcataggtgcctcagccgggccgaagggacgcgcgctggtgcctcaaggggaggacgaacggacctccgggcttgggccgcggcctccttcccctcggcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccactcccgtgggctcaggggaagagggcacccgggcggcgaggatgacctccgaagagccgcggcaaattgattcgttccgcccggagccggggccgcgtgaatgggggcccgggcggcggcggcagcggagaagaggataaagatgttctccctgaaagggggagggggcgcggagcgggaagcggggccattcactcctggcccggcccctcgggaagccgcgccgaagaaagggggccgaggcctattcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacagacctgagggcttcccgcagtgggacgtggccctggagagggcaaaatcctcggggttgtcgtggggtaaagtgatcttacccaaagagagaccaagcaaagaaacctcagttcacaaagtccaactcaaaccattgcacagacagggacaccgaggcccagagaggaaaggggcagtccacaggacacacagcagtccttatccccctttggtgtcctggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggcagcaaagtaaaggtgaacgccgggctgggccaggccggtgaacatagatcaggcctgaggggagcgcggggcccgaagccaggcgtcccctcttgtctagcctggtccctggagtcctagagagcctcgccgcaccccctccccttctccgtcccctcctctcctcagagccggctgagcctccctccctgccctgcgcttcccacggggagagaaggaaaaacaggaggggggaggaaggaccaggaaggggagagaggagtggaggggtactgtttggagcggtccgcgcgcccccgcccctcgcgctctcgcgacgaaggctcctcgagcccagccgggtacaacaagtctgtcctccgacgtcagggggtcattaataaccaattaggagggtcactgcggctcctataaaggcgctgagattttgccaaggggaagacggccccggccgagtgtgcgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcggtgagtccagccgtcggagcccggcgcaatccctcctcccggcgacccccattcccgtcctggcgatgcgcgagacgcggctgggatacccggcctcgctgctactcgcgccaacctgggctctcccggcgctcggtgcacctcagtttccccatgggccaaaccaggacgcgagccaccaagcagctccgcagcccacccggctcaaggaccgaccccggcgaccccgtcgctcggccccgacgcccccgccggcccctcccttcccctcctgcgcttgagctggcgggttcccggcatttacagccttactaggcgtgtaatagcagttgactcaaaaagaaggggttttaaattcatttagttaacttgggcttgacccacgaaagttcccacttaaaccaagaactttaaaaggcagccggggctggggagggggtggagggagggcgggcggggagaaaaagccgcggggagagcgagggagagaaagagagagcgagaaaagtttcttttctttaagatgtctcaagttcttattcctcattcatcaacccgcaaacaatatctttccctggctctggcatctctgcgcgtcgccctcttttccccctttacgatttctgttcctctcttaatttaccgtgaagactaattccacttccattcacgctatgtcaaccatctaatcccccttttttgtaaggggaattcctcggccccttttaaacaagtcccctccgcattgagctacaatttactgctacagcattcttccagggctaatgaatttagaattagcaatttctttcgaatggagccgaatgaatgcgatcactttaacagcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggcacctccaacacctgccagcccgaggtctgtccccagcgctgatcacggcccggctcctctgccagtgcccagagcctggacacacagtgggctcccggaagccgactaggcgaaagagtctccggttggccttcacctccttgcaggacctggcctcagtttccctgtgcataaaaccgctcgctgccgttggctcattaattcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccg

SEQ ID NO: 5333 - DNA, 1434 bp, Homo sapiens
  source 1..1434: mol_type = unassigned DNA
ccgggtgtgcgccctcccagggccctcactgcgcaccgcgggccacggcagaccaccccagcccccgccttgctgtgcaggtgtcaggagtgccggttggctcccttcctcccaagcaaggccttagggcaccgcggctgccctgggatcgcaggggcgcctttagctctccaccgatgccccgacgcccccctggcgctggaggccctcgcgagtctggctgcttttcggagcctgccctgcctgctgggtttcaggcgacggcccaggctggctgggaccctcgaatcaccgcggaaaagggctccagtaggcaggacggcgccgtctctctgccggcaacctttgccccaaagcggaccctctgcggggatcggagagggatgccccggcgtgaggatgggagaagccccgggacgggagggccgcgggccgtgcccccagctggagtccccgcgccgccgccgggtattttatgatctgggggtggtggtgtgtccgtctcctcatgtcaccctgatcccaactcctgggcggactggagtttgcagacctcgctgccagcagccagggggcggcggggagccgagcgagaggaaaaatccacccatttcctgggcggattgcgtcggtcccgcccggccgagccccgcctcccggccgcggcccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccggcgcagcggtggcgaccctgctccccgctcccccagcctgggccactccatctccgcccgcgcgcccctggggcggcgtttccttcgtctgggcccctcgccgcggggccg

SEQ ID NO: 5334 - DNA, 5053 bp, Homo sapiens
  source 1..5053: mol_type = unassigned DNA
ccgcgggctccctgggacccctgcgaccccgccgacgcgcgctcgtccccccccgagctccgcgatccctccgcctaccggggaaggagacctcagcgtcgctgtcctgcccctcctgaacgctgtccttgtccgacttggagccgccgcgggagcgcttcatgttgcggaaatactgcccccagcgctgccggccggcgtccttcttcagcctcttctccttggcccggcggttctggaaccaaacctgggggcggggcggggtgagcggccgcccggctctgcgggggcccccaaggccgcgggcgggagggaagcaggggcgagcgctgacctgcaccacgcgcatgtccaggcccgtctcggacgagagctgctcgcgcacgtggcgcgccggcttgggcgaggtgttgtaagcgctcttcagcgtctccagctgcttggcggtgatggtcgtgcgcggccgcttggccgtggcctcggcctctgcgcggcgggcgagcggtgaggcgcggcagcccctccggccccggccggacccccagccctcccaccccggccggcgcggggacgtcggggcctcaggtgcccacccccatcccgccccacaggcttctcggaaggcgcgggcgctgggagcgattggcaaaaacgggcagcacccgggctggggtggagggggcgccggcggagggcgggttctgccgcgggggcgggggcggcgccttccctaaaatcgcacctccacggcgcccccgccttcagccttggctcccttctccaagcaccctgatttccccgcgggctcccctttattctaagggtgtgggtatggcccagccttcgcggccaagaatttagggcgataattccgaccaggggcgaaaagccgcacacttcggaccgaacgaagcggttcgggacgcgggtctgtccgtgactccgccgttcccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacctcgctgcttggcggtttcgtagtccgccttgcacacgagccggctgtcctccatgaggtagaactcgtcgcccgtggccagctgccgcttgcacacgacgcaggcaaagcagtgcaggtggtacacgaagtcctgggcgcggcgcaccacctgcgtgggcgggatgcccagctggcacgcggcgcacttggtcccgaagcgcctgcgggacgcacagggccgggctcagcgcggaagcgcgaggctcatttcgccccgagcgggttggagagaggcaagcggctgcctgggaaggcggccccggaggaaggctctgtccggccctgcagggtggtcgccagcctggccgccggggcagagctgcccactcccactgagaagggaacctcaatctcagaaagacctcggggagcccagccgccattgcctgcaggacccatgctggatctgggaaggtgaatccggagggagaggacccatctggggccagtccctcacaccccacagctggagccatgaaggccactgggccagagccgctgggtgccagcattaggaactaaaacatcaccaatttcggaggaactaagtccagtagaatcctacaaataggggtgtatcttctctaatgactgcttctgtgatttaggtaataaattgcttttttttccaaataatacttgctgatgtcccagccaggcccagccacccagggagcacccatggagaggccccacccttaatttggccaggccacagggtgccctgcctgggtgacaggagtgggctgggattgcgagagacgcaggcttcgagggcctggccttggtgattgtgaggggaggagtccctggggcaggcgtgccctccgctcccacactgaggtgaggtttcggggctcacttgaaaaagtcgtccttgcagtaaacgctctcccctcggctgaagcagcgctcggccagtggcgtgtggcagtcgctgcacttgagacacttgctgtgccagtggcggtccagagccttgaggatgaagcggtccaggatgtgctggtcacagccagcgcacagcgggatctctgtgggcacgaggaagttctgggtcacctcgtagaccaggaggcagtgaagccaccttcccaccccaacgcgagccagtctcccctccggcccacaggactcagggctgccgaggggtcctcctttccctacacaccctcttccccagccagcttaagtggccccgcaagttccgggagtgtgcaggcaccgcatcctatgtcaggagctaaggggaaactgacatcggtctaaaaatgtgtgtgagcaagaaagcagcccaggccatttcacgaggctgaatactcaattacaaaatgttgccagtgccaagaagggtgcatgtggagctcaaatgaaaaccccaccccagggggatctgctctctgaagcccggcaggaaacatagggaaacgggtcttcaccatcacctggagctggggcaccccatcgggtctccttcatgttaagcgtcatggccactctttctagggactcctcgcaaatgtggctgccctgcctggtggccctgtctgcaggcctccggggtaaatatcaatgccttccccatcattgggcagccgcaaaattacttatgagtggactggacaagccgatccactgcctttgtgtcaggcgtgggtgcccccaacaccgtcagagttactcaaacgtctggcttcccgctgcttctgccccccacaccccacttcggtactgcaggccccctggaggaaccacactggggaggtccaagggtgccctgtgggagcctcgagtctgtgagcgggttttccaggtgtcaagggctgaggactccctcttcacttagaaaaagtctctggaagagaggagtgcccgctgaagggaccgggatttactgacatattgcacccgcctccctggctgtggaccccgccggctccagcccatctcccagtgggtgagagacaccaggaaggggctccctcgacctccggcggaaaaaactgggctgcgcctccccacgcagtggcgggaaaccggcgatgaatgcgccccgcatccggcaaaaccgcagctccgggtgcggagcgtcgaggacccgctgcgcgcccggggtccccatcgtgggcagcgatcgcaggcgaggacccggctcggagcggggcggcccgacaggccgacacagcgcggattcagcaccgcggaccggacagcgcctcggccgcagctcgccgccggcgcccgcgtcgggcaaaagccgccccagcccaccccgcgccgcgcccgcgaccccagccttacgctgcatggcgactccagccctggcgggggctcctgtgtcagggatggcggggtcggcggagcctggacgccagcccgcccgctccggccagctctcccgagcgcgggcgcgcagtcctccttcctccctccctctctccgccccccagcccccgcggccaacccctcccaggaaccgtcgaaaaataaataaataagtagggaaccgcgagcccccacagcctggatgtaacccccttcccgccggccggtccctctcactccccactggctccggggcctccttccccatcctgcggctccagctggcccgggagtcgaggagaactgcccaggttccctaagaaccaaagtgctgggagctagagtggtgccaccaggaagctggggggcctggagaagagaggctttttcctacagacgggccctgagcggggataaaccgagcgggtgtctgtgggcgcagacgctgaaacctgacttcggggagaccgacggtcggagttcagctcgaccttggcccctgcatctgactctgttccgctggaacgtggaaagagtccggctggggcggccttcttggggaccctcctgtcccgtggtcactgccccgccactgctccctgcgcctcctccagcccagggagctggctccgggctgcagaggtctcctaagcccaccctggacccccgagagctccctggccggagcagcgcagtgccacaacctcactcactccctgacaacccaggccaggggccctgcaacaaatacaggctgaggcgcccaggcgcggacgttccggggtcctcgcgcccactcccgcccagatcctctagctcctgccagcctccgcggccaggcccggaaaggcctgaggatctcctggtctccccggtgcagccactcggcccgggcacccacctcggcgcaggtccgccctccgcgccagcagtgctagcagcaggtcgcctcccgccgactcccgggccgggcccagctccccgcgcgcctccatgggtcccgccgcccggcgtcgccactctccagtcccgaactttcccgggcccagcgacgccaccccgcaatagccccgaaccggcgtccaagcgactccgggtgctgctgggcgctgcgcccgcgggccgccctggggcccggagcctctggccgagcggagggcggagcggccggggggcggggccgcggggcggggcggggccgggggtcgcggagaccagcccgggccactgcggactctgagcgcctttgcgccgggacctgcggtgcccagaggccgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccg

SEQ ID NO: 5335 - DNA, 6343 bp, Homo sapiens
  source 1..6343: mol_type = unassigned DNA
tcgccttccactgtgcgcgatcggaggggtcgctctgcagtgggcgctgtgacgggggcgcagtcactgacgtctcctggggcaacacctataaataaggcccaaatgcggcccgtccttccaactgcggacaccagagggcgcagccccaggaccacgcccccactcccctaccccacccggaaaggggtccacccgagccgaccccgccgtcactagtcgggggaggggaggccctggagcttcacgcgggagctcccgccgcgggaaccacaaccacggctaagcctttctggcccgcccgccccatcgcagggagaggacggggggacgggcaggacgggcgcctggacagctgggttcctcccgcaggtgcttctgaccccggcatggaggaagcgcccgcgttctcggcccaggcccgcagccagggctgctccgcccgctgcgccccaggtaagccgggccagcgtgggggagtagcggggcctgggctgcggagggggccgccctgacccgcgtctccccccagggcaaaagccccgcaaggcagtgtgagctggagccgccagcctggggacctcttttaagatgacccgtacggaccctccggacctgctggtgtcgaccgtgtaccaggacatcaaggtggcgaccccgggacccgcgtccaagtgctcgccatgtgagcgatccgtggcccggcctgctgagcccgcgcctttcaacaagcgccactgccgcagcttcgacttcctggaggcgctggacgggccggccatggagaccctgccggagccaccgccgccggagtccgctgtgccgcgcgcccggacccgcgaagccgagccacgccgccgcgcccgctccaagagtgcgccccgcgcgcccccgggcctgacgcccgcgcccgcctcgccgccggtgttgccccgccgagggcgggaggcccagcgtgcggcgcgggccgaggcatcgccgcgccgggagcccgcgtacccggcgctccgcgcccttgccaacgagctgcatcccatcaagttgcagccgcagcggggcggccccggccgcgtcgcgcccctgtgcgccgccgcgggccgctgcgcaccgcccgagccacccgcgggtcccgccccccacgtgcgctgccgcctggacatcaagccagacgacgcagtgctccagcacgccacccggggctcgcggtcctgcgggcccaccgaggccgcgcactgggcccgccccgccccgcagttccacggcctcacggtgcccgggccccgccacatggcgctgtcgcgcaccccgacgcccagcgactcatactgtgcggatccccgggcgttctactgcgacgggcccctgcctgggccccgggactacgccgagcgccgcagtctgcccttcaccaccccgccgggccccacccagttcttctatacagaggagccccaaggcttccggggcagctttgcagccagtcccggcccaaccttcgacgcctactaccccaggccctatccgtccgaggagctctcggggcccagtccaaggcgcatgggcggctactacgcaggagaggtgcgcaccttcccaatccaggaaccgccctcccgctcctactatggggaggctccacgagcctacggcctgccctacgggccccgctatgtccccgaggagccccgggcccactccaccgcccgccccttttacacggaggacttcggaaggtaccgcgagcgtgacgtcctggctcggacgtacccgcacccgcgcagcagcccggcctgggcggactggggcccgcgaccgtaccgcaccctgcaagtggtgccgccctctgaccccgacccgttgctcgcctcctggcacggcggcaccggcaccagtccgccccggctggccaccgacagccgccactactcgcgctcctgggacaacattctggccccggggccgcgccgagaagacccgttgggccgcggccgcagctacgagaacctgctggggcgcgaggtgcgggagccgcgaggcgtgtcccccgaaggccggcgcccgcccgtcgtcgtgaacctgtccacctctcccagacgctacgccgcactgtccctgtccgagacgtcgctgacggagaagggccgcgcgggcgagggcctgggccgcaactggtacgtgacgcccgagatcaccatcactgacaatgacctgcgcgccaccgagcgcccgagcgccagggcctgggagttgcccgggggccgcacgcggccacctccccacgcggcccccgacggccccacctctggccgccagcggagcctagagcagctggacgagctcatcacggacctggtcatcgactcgcgacccaccgccggccaggcctcagagcccgcggccgactgcctgggcccccaactgcgccgactgctggactcgcggcccgcgggctccggggcccccgcgctggcgccgccacgctcgccccccgcctcggccggcagcgccgaggagcccgcggccccgggagaggcggccgacgcgtcccccgaacccagcgccgacgaggacgacctgatgacctgctccaatgcgcgctgccggcgcaccgagaccatgttcaacgcctgcctctacttcaagtcctgccacagctgctacacctactactgctcgcgcctgtgccgccgcgaggactgggacgcccacaaggcgcgctgcgtgtacggccgcgtgggcagcgtgtgccgccacgtactgcagttttgccgcgacagcggcccggtgcaccgcgctttctcgcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaaccggcagagtgcttcctgctcagcgtgtccgtggccgtgggacccggcaccgcgccaccggggacaccggccctgcccgcgcccgcgccacgcagccacgggccaacagtgcgcaagttcgccaaggtagcgctggcggccggcagccccgcgcggccgcccccggcgcggagccgcgagcccgacatggagacgctgatcctgacgccaccgccgggcacggcgggcctggatcaggacggcgaggcgggccggcgcgcgcgcgaggtggccttcatccacatccagcgcgagctgcggctgcgcggcgtcttcctgcgccacgagttcccgcgcgtctacgagcagctttgcgagttcgtcgaggccaacaggcgcttcacgcccaccaccatctaccccacggaccggcgcaccggccgccccttcatgtgcatgatcatggccgcctccgagccgcgcgcgctcgactgggtggccagcgccaacctgctggacgacatcatgtgaggcgccgggcccaccaggcctagcccaggcgctggcccgaaccctgccctgcccactcaggccccgcccggcccacccagggccgcccccgagccccgccagggccccaccccgacttcttctaggccccgcctctaattccccagccttccaagctccgctcagttcggcctccagctccgcccaggcccccaccccccggcccttcgtccccgtagtgttcctcacaggcccttcgccttcccacccccagcaacccctctccctcctccgggcctcctccctctcccagctcgccctcgaggatccccagaagaagtcggtcctcgccctcggtgctccccgctgggaggcggggtgggcctgaggaccgccgagctctgccttcactcggaggggtcactactgcacagaccccacccgtagagatccggtccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaagtaaaatagaacttgaatgtagcggctgccgttgcctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatggtgagggcgggacctgcgggcatgccaggggcacgcctggcgaggcgggggcggggctggcgggacggagacggggctgacgaggcaggggcggggctggcggggcgggggcggggctgcgggccgtagcggactgcgctctgctccgagtcctgcccctgctaggtttgacccaggctgaggtcctgggcgggaagggcgtgacacggcctgacaccctccccagcagtctcccagttcccgcgccctccccggttccaccctccttcgctcattcatccctgtcccagcctcaaggggcttcgtctctcctggggaaggggctgttcagagctgggatttcagaccccttcggctgggagttcctcccgcggcctccaagggcggccagggcacgtcctgaggccgccctcccatcccagcggacatctacgacaaagtgtcgggcgacatgcagaagcaaggctgcgactgtgagtgtctgggcggcgggcgcatctcccaccagagtcaggacaagaagattcacgtgtacggctattccatggtgagccgcagccccgtcccgccctgccg

SEQ ID NO: 5336 - DNA, 1089 bp, Homo sapiens
  source 1..1089: mol_type = unassigned DNA
gcgggaaacgccgtctcccctggcgtctgagatctggggtcccctccccacctggtctcctcgctcccgccccagccccgtgcgccccaggagggcaccgccgagcgccgggtccccgcagggttcgggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggccggctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgccacgatgcgccgcggacctcggcgacccagcccgggtagaagcgcgcgctcccctcctccagcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcgggtgagtgcggcccctcagcg

SEQ ID NO: 5337 - DNA, 1020 bp, Homo sapiens
  source 1..1020: mol_type = unassigned DNA
gcgggcgtgaggccccgccctcgccgctctctgcccgcccccagacccgcggcccgcctggccgcctcacctggccgatggcgttggtggtgagcacaggaaggccattatagtcccaatccttgaggcaatggttgaagtccggcggggcgaagccgctgcacgaggggtcggtactggtggcgacacggctggcggcgctggctgctagggcagcgctggcgacgctgacgccgctggcattgggaggctgctcccagccagaggcattaggggggaaggccccgtagtggcaatgcagcgggggcgccagcgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcccgcgtctccctccccctcccgctcgcgctcccgctcaccctgcagctgctccgtgggcaccgcatctccgagggtcccgacctgctgttggggggcagggggtggcaggagaagggtgaagcggaggaaaccgcagagcaagggcagggggcaggtgggagggagggctaggaaggcagtcaggggcgagggatgcgcaggaggaaaatgccagacgctccgcgggggcgggggtgctgggagaggatggcgtcgccacctggggctcgggcacttactccgttggaggtgggggtgatctctacagtgttgtcgattttgccgccgcccccgccattgggctcgggggtcccggtggccacccggggagccagcttgccgaccgcaggggccctgccggcccgcgccgaaaggatgcgctgtcctctggctcagttgcgcgccggctgcccggacacagacagctcgaagagatcccgctctgcagctctgcagccgcgggcgcctccttggtctctgcgatctctgcg

SEQ ID NO: 5338 - DNA, 6343 bp, Homo sapiens; identical to SEQ ID NO: 5335
  source 1..6343: mol_type = unassigned DNA

SEQ ID NO: 5339 - DNA, 1109 bp, Homo sapiens
  source 1..1109: mol_type = unassigned DNA
gcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaacacgagcttggccgagccgctgaacgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcggtcgcggcagtccacggtgtgcgggtcggtgcaggcgcagcccgcggggcacgcgtgcccgggcgcgagcagcagcagaaggctgcagagcccgagcgccgcggcggcgcaggctggggctcgggggcgcatggccggggggcccgcgccggccgcggcgagaaggaagcggctctcggagcgagccctggcgcgggacggcgcggtgaggcactggctgccgggcgcggggagccagagggcggcccgggcggggagggcgtgcgcccgggcgtgcgggggcgatggagcgcggcgcggacggactggggagccgggacagcagggatggagaggggaggggcggggagggaggggcgagggactcaccaaagggtttacccggacaggaaattaacccgctagaaaaatctcttgggagaggcgggagcggcaggggtggccgagtggccgtcgccaaaacgcggccccaccctggcagctgatttccgagatctggcagtaagacgccgcgcgcaccgggcgggctgcactcgacgtctaagttcagctaccaagcccaggagcggtttccctaaggcgtgtcccgggcgtgcgccctgccccctcgcgcccgcctggtgccaaagcacgctccctgcacgccaccctatgtcg

SEQ ID NO: 5340 - DNA, 1109 bp, Homo sapiens; identical to SEQ ID NO: 5339
  source 1..1109: mol_type = unassigned DNA

SEQ ID NO: 5341 - DNA, 1384 bp, Homo sapiens
  source 1..1384: mol_type = unassigned DNA
gcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctcggcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccg

SEQ ID NO: 5342 - DNA, 1384 bp, Homo sapiens; identical to SEQ ID NO: 5341
  source 1..1384: mol_type = unassigned DNA

SEQ ID NO: 5343 - DNA, 835 bp, Homo sapiens
  source 1..835: mol_type = unassigned DNA
ccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacg

SEQ ID NO: 5344 - DNA, 2248 bp, Homo sapiens
  source 1..2248: mol_type = unassigned DNA
ccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagagctgtagaggaggaaggtggccctggctcggcggagtccggctcgcctggtgccaggcgctggtgctggcgccgagtgaacccaggcggcccaggtgtccggcctggtggcgggcgcagggcctgcggtgatggaggctccgtcttagcccggccaggcccagccctgccggtcgtcggcccgggacatgcgcggcgctcaggcctgcagggtgccttgggcggccacaacaaagttaaagaccggagtaagagtctccggcgagaagagacgcggagaagccggagccccggaaagccgcgcgcagccccgccagccgccgccagctgcggaggaattcgggctaactttaaaaaccgctggcgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagagaagaccggctgccctcgtcatgcgaatctgtgccctgcgacctcgctgcggctgctcgagctatgccagaggtggggacgaagggcccgcggggagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggaggagctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactccggaggcgccgccagggagcggtcatcgttgggcgccgccgagcgtgcccggggcgcggccgtggcgggctccctggggcggcagctctaggcgcgggcgcgcagcagccccgaaggcgccgcctggcccagccgcccggctcccgagcgccgctgcaagtggggggcgccccgcggcgccgcgcacatcttactggggggccgccccgccggcgcccgccccgcctggctgccgcccacgggctgcccgcgagcgaggctcctgggctccgcccggactccgctcggactcggctccggctccgactcgcgtcggctcggctcccgcgcgggctcccacctgccccggctgccgggctctggcgggcgggctgcacgcgtctccggccgctcctcctccagccgccgccgatgctatcgcccgggctcgcacaaagccccggagtggagttgcacgcgcgcacactctccctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagcgcgagagctggcaccgcgagctgggagacggcggcagcccagcggccggaccagctggaggagacgcgcccgccgggagcagcgagaccgggagcccgccgtctgcggagcctggcctcgcggctcccacgcggcgggcgctggctggacggcggtggcagcgggagactgacccgggaaccg

SEQ ID NO: 5345 - DNA, 3541 bp, Homo sapiens
  source 1..3541: mol_type = unassigned DNA
ccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacactcgaattttttttgttagttttttttttttttttttgcttttttttggggggagggtagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatccggccccgaacagcccgggggggcaggggcgggggtcgtcgaggggatgggggcagagagcaggcggcgggcaggatgcccggggtgagttggcgagttccggatcttcgctcctctctcccggggctcgggcgacgcagcctaccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggcggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcacttgagaaagtggctctcgagcgcgcctttgacccccacctcgatggacgtgcgcttcttgcgcttgcggccctgcgccgcgatcttgtccaggttggtggggctgccgctggacgagtcggtctcctccagccacttgttgagcagcggcttgagcttgcacatgttcttgaagctcagctgcagggcctcgaagcggcagatggtggtctgcgagaacacgttaccgtagagcgtgcccagcgccagccccacgtcggcctgcgtaaagcccagcttgatgcgccgctgcttgaactgcttggcgaactgctccaggtcgtccgagctgggcgcatcctcgtccgagtgctcgcccaccgatgagccgccgccgcccgcgcccgggtgcaggtgcgccgccgccgcgtgcaggccgcccgcgtgtgcatgtccgtgtgcgtgtccgtgggcgcccagatgcggcggcggcgacggctccagctgcgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggccggtgccgccgccgcctgccttgccgtgttctaggtgcgggccgccggcccaatcgccgccgccgcctcctcccgtgggtagccactgggggtgcgctaggcccacggggtggcccgcgcccgcgcccagccactcgtggtgcatcagcttctgcacttcgcggtacgcggcccctgcatgcaatcgctccgcggccgccgccgccgccgccgccgccgcggcgtccgggtgcataagcggcccggtgcccccggctccgccaccggggccccgcggcaggtactgcgcggtggtggccatgccgccccgcgccctgcgccgcgccgccgccgccgctccgctccgtctgcgggccccgccgcctcgctccgccggcttaaagccccgacccgctcggcgctccggagccccaccccgcccgccgcccattggctgcccgcggagctgcctcccgcctcccctgcccggcccccgccccgcgcgcccgcccgccaccctgcccggccgcccagagctctccattgggcgtcgctcccggggtcccgcgcgccggccgtgctgattggccgctggggcttcattcacggcccccctaccgtccgcgtacacactcacgccccgggggcgcggccgccacgtggggagtggcgcgggggtggccctgggaccgcaccccctctcgtcctggctgtgtgggccccgctttcccccagcgctggagactccgagcccggccggtcccacattccacgcgagctgaattcccgcccgcatcccgcccgggcagcagggattgccggctccgggaggcgctcgggctccgagaagcggctcagccccgcgcccctccctcctcagtaccgctgccggcggaccaggattcccgcgggtcctggcggctgcgagcgcgaggcggcgcggattcgcggctcggttccggcgcgactgctcaccgcgcccgcctcgcctcccgcggctgccagcgtgcactgggcgctcctcggcgcgtctgcccggcccgtctcggctttccttctccttcctctagtcccagcgtcacaactccgccgacctcctctgccctgagagcgcgtccggtgcgggcggagtcggacggactctggcttcacgcctcgcgcgggcacaccttctcccgggcactgaggcccaggtgagtaccgcgcgggcagctggggctgggacggcgggcggcagcggttctacagtcctacgcgagcccctggtacccggccgcgctccggggttccagaaggagaagatctcgaggtggagactgtggctccggggaaaacgctgctggcaagggcgctagttgggggtggacgttgggcccaggggtatctgacctgcgccgctgcagccttctcgctccttctcccagcttgaacggctcatcggctgtggtcgtggtgggatcacgccccgggagaggagaaggatgggctcagggaaggggctcgggctctccagaaatccggcgtgcaggccgggagctgtccagcctcg

SEQ ID NO: 5346 - DNA, 1513 bp, Homo sapiens
  source 1..1513: mol_type = unassigned DNA
gcggggcgggccggggcgtcgctgcgggacggcatccaagggcgcgcgctgcgtgctgtccccgcggcctcccgggcgccaccggctcggccaggccccgggagctgcccgccctaggccgcgggggcgccccgggctcgcaggatccgaaaattcccttcccgggccggggcgggtgagcaggcgggcgctgggctgcgctcgacgcctctccaggccgctcaggagagcctcgagggctgggagaagccgccggggcggttgggctggacgagcgagtttaggggccaaccgtctccacccgccggccgcgctgcagagcggtgctcccagggctggggtctgcggcgaccccgctgggaggaagggagagcgagaactgagacgcttgccccaagttgcctggagccaaaggcccccgagagcgtggccgtggggctgggtcgctggagtggccgcttcggcccagacactcgcacccccggcggtgcggcggttttcacgcgcgcactcactcagcgcgcccgggggtctgaggtcgccgctacggcgcctcgccccgggcagcagcaaccagcacgcaggcacccctggaacaggcgggactgccttcccgacgcgcggcctgcgcccaggcggcggaggggcccagcccccttccagtcctcggctccagggcgcagggccacgagctcccgctcccaccctcggcccctggcacccggcgccggctccgccgccctctctcacacgcacccttggcagggccccgcggggcgccccaaagcttgggggcagctcccaggtgtctctgggaagggaaagaaaggccacaaagcaaaagaaggagcaaagagaaggcgagggaggagcaggggcccgggtcctgtggactcgcctgggctgggagtggggacactgagagggctgcgaaggctccgggggtcgcgcgtggcccgcaggctcacccctggcccgcggctgcccttccctccccttcctgggctcctggcccctctcagtgctgttcctttctcctcccctcaggccctctcctctcccgcgcagggctccgtcctggggattaagagaaaggagggaggggaaaggggaggggaagggaaggggcggaggagaaagagggacgatccttccaaaggcgggtgttgagtttcagctcaggaccctcgggtccaactgcctgtggtaccccccacaccccccacccccgtcccgccctggccctgccccagtccccggcgccttcctcctccggactccgctgcatgcctcgcttgcggtggtccgatcggctttctccgggagctttcctctccccgccacgcccccgtctccccggccgtccccgcgcctctcggcctccctttcattagccccacatctgtctttcccatgggagggagcgcgcgccttccgcccagcggggcccttagcagagcctctccaatcctcggcgcctcccctacacagggttcgctgggccgttcttgcg

SEQ ID NO: 5347 - DNA, 3541 bp, Homo sapiens; identical to SEQ ID NO: 5345
  source 1..3541: mol_type = unassigned DNA

SEQ ID NO: 5348 - DNA, 558 bp, Homo sapiens
  source 1..558: mol_type = unassigned DNA
ccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggcacgctggcctgcgcgggtccccagccgcctcccgccacccggaacccctctccttcaagcgttgaccgccgacccacagctccccttcaacccggggcgagcggggttcttaccatacacctcccctctccgctcggttccatccttctcccgttctcctctaggcttcacggtttgcaagcacccttgcaaataactcctagcccacccacaccgtctcgtccgcactttccgagagccaggcacg

SEQ ID NO: 5349 - DNA, 7244 bp, Homo sapiens
  source 1..7244: mol_type = unassigned DNA
acgcccagccagggcgcagagagagcgctgggcgaagaggggtcgatggcccgcgggaacagggctggggttcctgtttggggaccggccggctgccaggcccctcgccctactgcttctccggagcgccgttgaccataggcccgtacaggccgccgccgtaggtcggctccttgtgcaccgccgcagcagcggcggccgagcggtcacgcatgagatcgctaaaggcgtagtccatgggtgggcggaagccgagcgtgggcaccaagccggcagtggagtagggcgccatgaaggccagaccgcggctgtgcgccgccgccgcggagtaggccaggcgcagggggctgaggccgagcggcgcgcccagcgggtaggcgcccgcgtcggcaccgaagtgactggcgttgggctgcagcggcgagaaggccgagcggctgctcagcgagcccagcgccccaggcgccatggcgccggccagcaagggtctgtggtgcggaggtgcggcgggccccgcctgcagcggcgcaggcagcccaggccccccggcggcggcggcggcggcggcggcggcgtcgacgcggctgggccacgcgtcgtctgcagctgctgcagcacccacggcggccttatctgggggcgccgcagggcccaggccggccgccaggcccccacggtggtggttcagcacctgctcgatggcctgcaccacgtcgccgccgcagccctgcaacaccagctccaggacgcctcgccggtggcctgggaacacgcgtgtcaagatatccagcggcgtccgctgccgtggacccgagcctccgcccagccctggcgccggcgcggcctcaccctcttctttgtcagcctctgaaccggattcagagcccagagggctagcggagcccgggctgtcctcctcgccgccgccgccagggccagcgctgcctgggcagctgccacctgcctctttggaggcccgagctaggggcgaaccagaaaaggactcgccatcgccgttctccgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggttagctagaagacagcagtcacagcacctcggccctttggatctcagtttcctctccctcagccccacagcccttattcactaggctccagtgcccctctttctttttgctctagcattccttccgctctgagcccctacagccctgaccccagggctccctctctttctgtactcctcagaaccccaactacctgtgccctgtaaactcgatgttcagtgctgctttccccacgtctgtgccccaacacctccacccttaactgcccttccagtcctgccctgccgtggagaagtggccaggtccagggttcaaacaagagacaacataacttctgcctaaccacgctgtacagaagagcccactgtatagaaaatgcctgccctggcagtgcagcctgtaaggaaaggcgccttggttatctaggaggtcccaagcttctctacaggcagaagtacagcccctgtttctaatccaccctttccaaaattgagacctgagaagttcttccctcccaagtttagagcggatccctcctttccctcaacggctctggcctaatttcttccctccccacaaaaagccacgggggtccagaaaaagagggtggtgctaggcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtagcgatgcagcggccgccgcggctgccgccaccgacgccaccgacgccacaggcggccccgtcgctgttgccgccgccgccgtcgccgcgccgggcacgctgggcagctccgagcgcagctccatgacaggacctgacgggaaagaaggtgggagaggggagagacctggtgaggagcacaccgcgcgctaggccaaagcgccgccttgaggaacccaagctggagagggaaatttgggccgcggaggctgggctagaggggccagaattgctgggaggaggtgcagtcggaacctccttgtgagccctagcaccttcaccccagtctggccatggctgctcttagacctgatatacacgctaggggtaagattttgtctgaattagtgattccgctggaaaaaataaagagacatgtaaagtgtgaaagtcactgattcagatggctgtaatgagaatttggaaaagttaagatgataccccaaagcttagcctaattggggtgagacgggtgagagaaatgctcgtttgacgggactgggattagagcgacagttttggcccagaagttaggctgatgccaagggcaaaacaggaaaacccggagcaaaacggtcagtttggtggaagggtgaagaggagagagatgtgaaggcgcagatgtgaaggccggttgggccggagttttgtttctttttgtttgtttatttttaatgcagtttggggcagaagctttggagagaaaaatcaacaacagaaagaatagctttaggaagcagagtgaggacgaggaaacaacttgggcaaagttaggcccagtggctctgggacccgtaaaaatgtgagcgccaaaagttccacggtgagggcctccagagagtgagagacaaaatgtatgtggaatttagcttaggactgggaagtattaaagagaaaaattcggccaaagaaactttctgtataggcaaacccagcccaaagatgagcttcatgggcaaggaaaacagtgaaaagcagctgatctgggtgtccgggatccaggggccgcgcctgggagaggggaatgtgtaagaaaaaaccccacaggcaaatgctgggggaggggattgggtaaaacctgtggtgcagttttttagcttcgcagtctggagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctccgggatcctcctcctccgctggcgctgcacgcgcctcccggctccactggcgacgctggagctcttggccgcttccctttgcccccggccccttatctgaccacgtcaccctccttcagtcaccatgtccgaacttccggacccctcagaacgcagcgcagtccaaccctcccttcagaaatccgggtcggaggctcgtctgcgggccgcgtggttggaacccgcgacctgactctcgccgtgccgggtcccctcgcggtgcgcgccggacgctgcgcgcagccggggcccagttgcccggcgctgccagactctcaatgagccgctcgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaagctcagcgaagagaaatgagattgcacttcctgtcggtgcccgccacgtccctcgcgccctgagcctttcctctccccgcccctcttttcgcgtccctcagccccttttgagctctcttttcctcacttttcagcatctcgatttcttttccgtggtggtgggattctttttgtcgttattgcaaatgaacaaatagcccccccccctttttttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctctgattttatctctgtgtcttttcccctctaatttctaaagttctgtttttccctctaattctgtttttccctctaatttctaatgttctgtcactctcgtttttgttctctacttttctctctctccttcagaataaagaaaattcgtttaaataatgaggaaaatgagcgttcctgtcgttctccctccactcttgaccgtgcgtctctgcgttgctctttcgaacctccaggccggcgggaatctgggcgcgcagactcggcccgggtcgtcgcggcctcaggacgcagcccattccgcctggcacgactactgggccgcgtcttgtcagtctatcagcttctgagcccaggaatgggggtgggggaaggacggtgcgactaacgggcccccacccgaagaccgcagaacctggcgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatgatagcgataaaaagctggttactcgctcccagaaaatgccacttgctggagtctgtgaatgggtttaggagagagaagggtgtcagcccccgcgagggtctcccgcgtgaagtgaggataagggagtgcttcagggataatatgtcctctaggagcgcaggacccagaccccaccttccaacacctggaggttccgaggccaagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgcg

SEQ ID NO: 5350 - DNA, 824 bp, Homo sapiens
  source 1..824: mol_type = unassigned DNA
acgcggactgagcgaggaaatgctcaagaccacaggactgaaccccccggaagtctcgacgctgcccagccagccagagtccagtcgtcgacgcggatgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggcggccctcgcctgcgcctttgcgcgccacccaaaactttgcgcacactgcagccgccgccttcccgctcttcgcggtgagacgcgcgccgccaagtgccgcaggcagccctccacagccgccgcggcagccgctgcctggcttctggctccagacttttcccccactgcctccagttcccacccaggaggctccctcgcggccgcgagagctcggcgcccgacccacagtaggcagtgcgggcacagtgttgcagaccaccacctcgccaggtccgggcagcgcccactagacggacaggcgcccgcggccgcccctaccccggcgcgcccacctcgagcctctcacgccgcggcgggcgggcgcaacatattctcctacctccagccgccgaggaccacactctccgctcagccctctcgactcatcctccggctgcagtagagggcgagcgggctccgcttttgttccctggggctggcaggtccgtgtggggccagggcgcgcgggagacgccgcggagctgggtatcccggagaggggatgctcactcctagcggctccg

SEQ ID NO: 5351 - DNA, 824 bp, Homo sapiens; identical to SEQ ID NO: 5350
  source 1..824: mol_type = unassigned DNA

SEQ ID NO: 5352 - DNA, 1415 bp, Homo sapiens
  source 1..1415: mol_type = unassigned DNA
ccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatggggccttcgaccccagcgggctacctgaaccaaggcgtctctttaagtggggcgcccgaagtcattttggacg

SEQ ID NO: 5353 - DNA, 1415 bp, Homo sapiens; identical to SEQ ID NO: 5352
  source 1..1415: mol_type = unassigned DNA

SEQ ID NO: 5354 - DNA, 3039 bp, Homo sapiens
  source 1..3039: mol_type = unassigned DNA
ccgcgggaccagccttggctttcacatttcgctgcagccttgtcccgcgccgcactgtttcctccggccactgtggggtcactaagcgacctgcagaactcgctgaggcccaggctcctgcagctcccgccgaagactcaaagccagagtggacataaacgccgtgggcaggaccccggtgaggcctcggtgcccttcttgggggttctcagcgttggcccagaagcctcagcccgggtctaagaacttgggactctcctcgactttggcgatcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaaccgggaaataaggcgggttccctcttcgcccgccacttcccaccaagtaggctgtgcggccctgggggctgactgtcctcaagcagccaggctccaccgcgcgccgcgctgcgccgaggtccgctctgccgcagggacgctggcagcccgttgaacaccggcaagagcgccagaggctagcggccgccaggatctctaccaggctctgctcgcacccgcctgcctccctttcgtttggcctgtcctccgttcaactgaaatcgttaattttcttacccccttgttctcattttgatatattctacgctttaaacatgctccgttttcttttgtttagtctgctccctccctctttgtcctttcccccttctctagttatccgtttcgttcgatcttgctcctgctttttttattcgttcgttcctcatttattcattttagttcatcccagctcgccgactgccatttaccctctcgttctcgccgcgctctccgttgttttgttcaatttcccttccccttttcttggttgtcgctcgctttctttggttttctttctcggtatttcgttgtcaaggccacccttgccgtcggatcccggggtgctgggtttctcccggccgctcgttccgcaccagcgctctctgcagttcgcgcggcaccggtgtggtccgggggcccgagctgtcggtgccggatgcggcgcgcctagcagggacgcgggcctgggggggtggctcctgcccgacgcggagcgctgagccaggccgggtacctgtctctggcggtgctcaccgcactgcgcggcctctgccgtctggctgggatcagaggagccaggccaactgcttctcattaagtcccaactgtggtttttatcaggaaagcctctttcaaagggcacagacacgaagctccgcggactcgttcatttcctccgttgacccacacacacctccccgccctcccctacacattcccaccgccccggctgggcgaaagccggagatgcccggccactccgtggaggcccgcgaggcgccagccgggcggcggcagggggttgaggcggatcttggaggatccagttctgggcctaggctgcgggatatggcagcgcagataaggtgggtgcagtgcggaagccgagacgccttacaggtcatagggtgcggcggacggccgcagagctgccgatcagcctgccaggcccctgccttcaggcgcattctcggatgccggcgcggtccagccggccttagcacagggcaccggcccgtgagcccgcggcgccagggggttaggctgcccagggctgctcctgactgcccagcggtgatgatccagcgcggggaagccaagactgccagaagggcggctatcatagtgcataacggcagggaggccagcttagtatgagaaataagaatacagttattccgtcttgaggacagccctggcattgcacgaccagtcgcggccagactgtgccagtctgccgcacaggcagcacccttcctgtgaaggctaggcccggggaggagagacgggccaagaccaggccgcagtccccagccgaccccgatttgaccactctaggttgaggcccagcctcagggccctcaaagggcgccagacacaaaagccgcgcttcttcgtcaggtctcagtgtggctccacagccctcggccgggtctgggcttcagggtaggtggcagttccagtccaacttcggcagagcatgctctctccttcccaggtccaactgctttcgggccccgactggactccgggccgtcgccactgcaccttccctcgacctcccgccttccattcccgccgccgaggaacggtggttcaccctcccgccccacactggcctttgcctggcccgggccagcgccaacccggcttccgtggaagccgtggcgaaaggcgagaggggcaaaaagttgagaaataggcgagcgggagagataagcaggaaggcccgggtgggcccgggtaaggaagaagaagagagggtcgggctgcgcgctacgccccgcgccgcgcgttaccttccgcggggccctcgtagaagtggccgccgttgagggccgggccgggcccgaggtcctgcaggtacttggcgggcggcttggccggctctgggaggtagggctccaggggcccgcaggccggaaagcgggtcagccgcgggccgcggggcggcgcggggtgcaggtgaggcgcagcggcgggggttccctgcgggcccggaggctcgtcccccgaggccacataggggccgggtgcaggccccacgcggaaaggcgcgcagtgctcggggtccatgccggctcagggcgcacaggcctccggggctccggggctcgcgctgcccgcgccgcctgtgagcgcccg

SEQ ID NO: 5355 - DNA, 1277 bp, Homo sapiens
  source 1..1277: mol_type = unassigned DNA
ccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtgacaggtgagtcgctggccgcgccccgcctggctttaccgggccggccactgcaactttccctgttctggccccgccccagccagggagggctgaggaccaaggtgtgaggcggcgctgcccccgcatccgcccgaccctgcgctcgtcccgggctcctctcgccgctccagccgccgttgcctggcgacggagccccggggcccgctctccttcgcgcatcggggtccccagcggcgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcgcg

SEQ ID NO: 5356 - DNA, 2394 bp, Homo sapiens
  source 1..2394: mol_type = unassigned DNA
gcggcccggcctgggctgctccggtgcagcgcgccccgcacctggcctcgccggctcatctccggagaaactccttctgccctgtcgtggtccacagggttgacttttcggtattcgaaacgccagcagctctgggagcccagcggagagtcggagtcactctggggccagtgacgcctcccgctgacaagaatcccaaagttgcctcagcttcctcctctccttttcttcccgcgcccaaccctgacatcaccacccctccatcccccaggtatcttcctaaagccgtgtcgggactgcaacccgcccttcgatccagctggggccgggccccacttagccagtcaaggggcgagccagcgatgcgaacaccggtctggggggcacgactcccgcctacgttccccgcaggcgcgcaggggacccaaccccacacattttattctcgaactacgaggaaaaatactctattttttaaaaaaataacttgcttcctatacaaatcgctatttaaaaatatacaaataaggcccaagcataaaatctaactctggggctggcggtggagggaaggtgagggagggggctctggcacacgtccctcgtgtgtgcttgcgcgacggctgatgagggcgcgccagggaccctggcgcccaaggagatggggctgcagggaggcggacggagagcgttccaggcgttcggctccggccctgctccaatcgcagagcgcgctccaaagtcgagggtagccccaggtgccgccctgcggcctcaccagttccaggagaccagggcgggggatgctaagtgctggtaggcggggaagaggccaagcgccgagccgggaccgaaggcagggtagcccggcagagggcaggcggcggctggaggggcgccgcacttctcctgggccgcggcggttcccacctcgccaccgccgccgccgccgcacggctgcccgtcgcgaacaagcaccggcaccaccacgcgacgcagcaggccgggcgcggcgtgcagctcggcggatgctgccaggtcaggcgactccgccgcccctggagcgcgagcgcgcttcagcttgtagcgatgattctggaaccagatcttgacctgcgtgggcgtgaggcgaagcaggctcgccagctgctcgcgctcgggcgcagacaggtaccgctgctgccggaagcgccgctccaactccagcgtctgcgccttggagaatagcacccgccgcttcttccttttctcggcgtccgagcccggagacgcgggcctagcggacggccgctgcgacgagtctggcgggctggtctccaggctgctctcgtccgaggctagggacagcaaaggagacacgggtgggtgagacgccggaccctacgagggcctgctgcccttctggcgcgggcgtggaggcactggccagagggcacgcccactagcccgagactttcgggatgaggccatttcctgagtccacatctggacatccacctctccgaatgcggtgacctcattcataccacagcggtcatcagcgggcctgagatcgtgccccgaaaaaacccaccccggggccctcttaacatgtccgcaccggtagttgcgctggccgaccagtttatcacaagctgggtcaccagcgccggcctcctccaggtcgactgcactgcagtgtgccgaggtttgcggagccctgagtgggaacggggtgggggtaaactcgccaacactggccatcccagacggaggcctggagatcgtggccgtgttttcaggcatggagagggggcggggggtggggtgggggcggcaggtggcggcgcgttttaaatttcaattattccgacctctagaaatcgtcagacacagaaaccccaaatctcggagcaccagtgccaggcagggatctgctcttaggatgtgccgaccgggatgaatgcgttaggggttcgaggacagggctcccgtttccaagactgaggaaatctagactctgggctgggatttcggctttccggcccctcgtgggctgggcccttgattctgctgccccacgcctcctacctcccaccccgcaccgcaatccaccacgcacttacaagggtagtggccgcgctccgaatccagccaggcggcgcaggggtcgggctggggggcgcgtggttctggctcccgcctcggcaggtgttgcgcgtcctgctcgggtaaatctagaaggctgcgcacggtgaagctcaggcgtccagaggtggccatggccgaggaggggaaggaggcgggggcagggcaggctgggaacggaggggcggccgggacgccgctcctacggatgggcgtgggaggcgctcgccatgcgctggcagccgggatattagcgcatttacagcg

SEQ ID NO: 5357 - DNA, 1627 bp, Homo sapiens
  source 1..1627: mol_type = unassigned DNA
tcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgaggcccttccgctcccgccccattcctgtgtagcagcgggtccgcctcgcctgggtctcccagggctccttcccagtatctcctccgcacccctggggaccccagctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacggacgcctggccacctactcccagctctaccagggtgagcggccgaacccagcacttcccaagccccgcggagctgtctcaggggcccgagagagggcgccaggcgagctcagtctggctcctgcctatgacgcctcttatccccgacctccgccgtctcccgccagcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctcagcttgagatcagggcagggtctccgggtccctccaaggcaccgcccccccatcagcccgcccgcccgcccaggctccagctcacctctccaaaccctccctgcacttttgcctcgatcccccaactcctcttacccaagctcgatccagcacctctgcggtcccgcaccccaactccgcctcctgggtgtcagccgcccctctccgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcg

SEQ ID NO: 5358 - DNA, 271 bp, Homo sapiens
  source 1..271: mol_type = unassigned DNA
ccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccg

SEQ ID NO: 5359 - DNA, 884 bp, Homo sapiens
  source 1..884: mol_type = unassigned DNA
acgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaactcgctgctccctggctccggggagaggcagcgcggcacagagttcgctggcatcagccgcctcctgaagctcatctcctcttgtttctttcttccttctctttatgctggctgctctcccggccacttgctacacgcctccaatcttcattctctcccagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacg

SEQ ID NO: 5360 - DNA, 1007 bp, Homo sapiens
  source 1..1007: mol_type = unassigned DNA
gcgacggtgtccgtgcgtttcttcactagtgcatgtgcgaggagggctggaggcatgagcgaaagagggaaggcaatctcggtctccaaaaaatccaggggactctccctttcagcacaagcgctcacacgtgcgctcgcgcggacacacacacacacactcacactcacacacaaataaatccccagcacctgcctcggaaagccctctctcgcaggctggcccgaaggcgcggctccgccagcggagagcctttggatttaccgtggcattacttttaattaactctgcggcgcggcgcggggagcgcagggtgggccctaatcccgggcccgcctgacgtcacctgggaacgcgcggcggcgcggggcggcgcggacccgggacgacctcgccgcgacctggcctcgcctccgcccgcgcggggctttgctccgcgggaattaaaggaaggagaaatgttagtacacttttaattggaaaccgagttcttctttcagagcggcttgtttactcaggattgggcattagaactcaggggaggctctaattgaagtgacggctttggagattatggggaacatatggccctaccgccgggctctttatctgcattttctcataaaactgccgtccgtgtgtgtttctgcgcctggcctcttgcatttctaaggggcctttgaagacagggccgaatgcgcgcgggggcttcaggcactttgcgctccacggcgggtcccgcagcccggcccgagccggccctggaagcttcgccctggactagactggcaccgacgccgcccccagcctgagcgctgagagggaaaacgagagctagaaaggaaagaaatcggactggtgactgcctggcaggggtgtaattcaaactgttgtgagcagacggcaggagggagttgccaaggtaacgggtgattcccacccgccgccctttcgctaaggctggggagagggaagcctccgcgtgctgggttagggccaagcccgcg

SEQ ID NO: 5361 - DNA, 2191 bp, Homo sapiens
  source 1..2191: mol_type = unassigned DNA
ccggacgcgaccgcccgtagcctgcggcccctggcggttgaggagccgcggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacggcgccctgaaactcgccaggcactcgccagccatccccacctccgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgctcccggtcagactcagctcgcacctaggagcggggagccgccgggcatccttggggaagccccctcctcttgcagccgcgcggggtccccgctgccccgacgtccgcccacgcccgccccctcgctccggcagggcgcgcggagggtgcactcctaggaggcggcgggtgccctcgccggctccagcgcccgggcggagggcagggaggggagcggcgctgcgaggaatggtgcccaccccgggccggagccccccgcccctcgccggagaggaggaggcggcagcggcggcggcatggagccgggggagggcggcggtggcagcgcccggtctgtctgcctccgcggcggcagcagcagcagccgccgccgccgccgccgctgcatgaacctctgcaccacggctgccccccgcgtgcagcgcacccagcggcgggcgagcgggcggcccaagaggcaggcggaggcagcagcggcggcggcggcgaccggagctcccgccggccccgccccgtagccggaccacaccgacactcctcggcccggctgcctcggcccggggggcgccaggaggctgtggcccggggtggagagccccaacggctggagcagcacaggacgtgctccgcggaggaaactggctgtacgccatgagttttgtccctattcggctgccgtccgggtggggggggggtaatgtgtaagggtgggggtgtttaaagggccgctagcgccggggtggggccccgcacgtggggctgaggcggggcggggccctggtaggtggtgccctggggtgggggtgggggactagggcgggcccaagcgccaccgggtgggtgaggccgagcagggcgcggcg

SEQ ID NO: 5362 - DNA, 859 bp, Homo sapiens
  source 1..859: mol_type = unassigned DNA
acgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtgcgcgccagccccgggcagcctccctgcgtagcgcgccg

SEQ ID NO: 5363 - DNA, 791 bp, Homo sapiens
  source 1..791: mol_type = unassigned DNA
ccggggcacccgtgtgcgcgcgaggatttcttttgcagagaatgaaaccaccgttcctttccgtccgtggtctactccggggtccccatcccacgtaagtgctgtggaaccccggggtgatgagccccgggggaagccagcatctcttgccctccagtgccggcgcccggcagagccccgggactcctagtttttgccgccgctgaggacgcggcgcgggctgctggccgcgtcgccgagggagggcccggacagccctgcagcgcgtctcagcggagccctgggggccgcgccgctcctccaaacatgattcagaaccgcccgtcagccttggctccagcgcctggcgcgagcgaaccgggcttggctgtctcggccccgtctgaaccctgcgggccgcgggccagggcgcgccgggatccgctgcgccaggaccctgcagacccggccgcggccgggccgagtgcctcccgccggggccttacgcccacggtccacgcttgcaacaccagggctgtacggcgggtccgcagctgggtctgcgcctgggactcggggctccctgcgctcctcgtgccgcaccccttgccttaaccccaagcggacgggtcctggggcttcaccggccaggccggagccccagccccacaactccccccctcccaccgcactgccccctctgcgctgtggcgggagttggggactggggccggagaaaggagacgcgccggtcctcaagtctcttgagccatttcggttccgggcgcgccccccagggctgcagtcgcgcg

SEQ ID NO: 5364 - DNA, 586 bp, Homo sapiens
  source 1..586: mol_type = unassigned DNA
gcgaagaggagggagttccgaaaggagggaaacgagccggcaaggggcgacaggagcgagccgggaagggagagcagcggagggctgcagagctgcgggcgcccggaccgtgccacacaccccccgcggggcacggagggcattgcggggggagacacacaaagacatgcgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccg

SEQ ID NO: 5365 - DNA, 1678 bp, Homo sapiens
  source 1..1678: mol_type = unassigned DNA
ccgataggcgaaactgcaagaaccgggaggggcggctgcggcgtttaggcgcgaggcacacaccatacccttccgcagcttcccacctcctccagacgcacgtgtttaaagagtccctgctccaaccggtcccgccccacctccgctcggcctccagccctgcttgtactgctggcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgccgggcgcgccttcggtgccctggctggaggcgaggggccgctggtgcccaggtaggacaccctctgcagggcccgactgggcgtcccgggtcccgggcgccggggagtggcggctacaaccacaactaaccccttcctctcccgccccgtcctctcctgccggcgggaggcgaaggagaagcgccgccgtcggtcccg

SEQ ID NO: 5366 - DNA, 1600 bp, Homo sapiens
  source 1..1600: mol_type = unassigned DNA
ccgacgacattgtcactggaaaagtgctggccacggcctccgccttaccctctccacccacgggttcggagcccccaggagcagtcagaccgatcaccgctcctgcagcctcatttgtttccggagagacacccacaagccagcccacggagagtctggactcgcccgccccagcacccacgcctcccccgcgcccggttccagcgccgcccccgacatccacccgcgggcagccccttaccgccggtatcctcgaagcgcgggggcgggcggtcccgcagcgctgcgctccagcccgcgccggcctcgtcctcctccggctcctgtgcgtccggggcgcggggcggtggcggggcggcccctgggggtcccgggggctcgcgctcgtcgtccgaggaggcggccgaggaggagcgcgaggcggccgaggtgctgtagaaggggttcccgccgctgtccgggccggactcgccgaacacgtcgtccgagatgtgcaggctctcgtagcgcgcgcgggcagcctcgagcagcgccggcgccctcctccgcgcgcccccgccgccctcggccatggccccggccgccgcccgcgcgcccgcccccacagtgcctcccagccgcacacgccgggccctgggcccgcgccgcggcccgccgccccccaccagcgcagcccgcagcacagcgcccgccgccccgtgcccggccggcccgccgtcttggccgcctcgggcccagcgcccggggaagcgccctcggagctcgggcgccgcaggctgcgggccgcggcgggaggcgagccgcgcgcggggctggcaggggcgacccagagcgggcgggacgcagaggctgcggccgagaccaggcgccgccgccgccaccgccgccaccaccgccaccaccgccgccgctgcgtctcctcggcgcccgccgcctccctgcccgccctctccacggcctccggcgctcggctgccgaccttcccgggcgcgagccgccagaggcgggccctgccgcccctcacctcccgcccgccggccaatggggagcccggcccggacagccgcgggggagctgggcgggcccggcgcggggaacgcccccaccctcctccgcggggcggggcggggcgcgcggccggggctggcggttagggggagggccgccggcggcagtgccggtctcctcctacagggacgcgcagcccgggaccgccacgcgcagcgcgggagggggagggcgggaccggggaacaggaggggagggggacccgggtgcttccagcggtccgggcccgcggacggagtgcgggccgatcccgctcactgtccccttccgcagtccgcgtgcagctccagggagctgtccgccccggtggttctgaaccaggcgccgccgaaacgctccaggtaggcggcgggcccgaggtcaccacacccgcggcggcggctgctgccgaggtttcctgggggtcactgccagctgcgccgcatgctcccataaatacaggggctgtccagcttctgggaatctcgctctaattaggagcccgcctcgccggtccactgttggtcgctggtcagatgctaactccgtctcg

SEQ ID NO: 5367 - DNA, 2394 bp, Homo sapiens; identical to SEQ ID NO: 5356
  source 1..2394: mol_type = unassigned DNA

SEQ ID NO: 5368 - DNA, 1160 bp, Homo sapiens
  source 1..1160: mol_type = unassigned DNA
gcgcgtccggtgccccaaggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcccggtcgcggcgagactcacgcctgcggtgtgctagggcggcggcgacggtgacgggcgtggggcgcggcgctgcctcggctgccgggtcgttgcggcgagcgcgcgggccggcctggagtcaccgggctgaaccgccgcgcctgcatcgtgccgcacgccgcggaggcgctcgggtacagaccgcgcgggcgcgcacaaagcggcccggggcggccggcgcggcgcagaccctcggtgggcagcgcactccagtcttcccaggctagcggctgcagggagctccggcccgcggcccctccgcctcaagtctgggagctgccggtcccactctgtctttgcctatggggattcgagagtttcccagcggcgcacccaggggcaagagcattgccgtgtgagtagcgccccgggcgtgggtgagcgagccggcgggcgggaggccggagcgccggggtagccctttgcagctgggacactgggcagtctgaggctcggggaagggcggcgcgcgcggtggagctgctcgggaagtttcagtcattctttccctcgccactcgccccaacccgcactgccccgagacgcccaggatagggcactggggacagctgcccggggaagtgggtgagtggcggcgggaagggaggagcgcgggctctgccgcggcgctcgcccccggagggccccggccgcgctcttgctctcgccctgggatctgctcctcacgaatcccctcctctctgtccatgctccccctgcccacccacctgcccgtggcgcctgcgaccgcagtggcatgaggaggtcaccggacgtcagcccccggagactgtccgacatcagcccccagctccggcagctcaagtacttggtggtggacgaggcgattaaggaggatctgaaatggtcgcgctccgtggaggatctcaccagcgggccggtggggctcacgtccatcgaggagcggatcctgcg

SEQ ID NO: 5369 - DNA, 588 bp, Homo sapiens
  source 1..588: mol_type = unassigned DNA
gcggggctgggcgtcccggggaggagggcggagcaggtgagctgcggggtgggagcagggagtgcacttgtacgtgacgttggagtttgcagcaacctccaagtaggaggctgtgcgcgcgtgtgtgtggagtggctgcgcggccggggaggatgtgcgctgcagggcggccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggtaatgcgcggccgcctcgccccgggggtccctgcaccctagccggggaatgctgccaccctgaggggggctgtctggctgcggggcgccggggctgggggtactgctcccccaggacgcggctccgcagtgcagagcgccgccgcctgcg

SEQ ID NO: 5370 - DNA, 878 bp, Homo sapiens
  source 1..878: mol_type = unassigned DNA
gcgacccgcgactgcagccgtttcttaaggccagtccttcgctcgcagtctgtcccgggcggcagtcgtgtcagccccccgctaggacccgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcgcctcccg

SEQ ID NO: 5371 - DNA, 561 bp, Homo sapiens
  source 1..561: mol_type = unassigned DNA
gcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcg

SEQ ID NO: 5372 - DNA, 1235 bp, Homo sapiens
  source 1..1235: mol_type = unassigned DNA
gcgatcgcagggcttcgcctatcccttcctccgggacagtttggatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttccacgggatctgaactcccgagcgccctgcacggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgccgccgccgctgctgcgaagcttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggccgcttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcg

SEQ ID NO: 5373 - DNA, 5964 bp, Homo sapiens
  source 1..5964: mol_type = unassigned DNA
gcggcaaccgagccagatccaagaggggtcggcctcgtctaaattggtttcccaccaatggcctcggatcagccgcggctgtgctgcgggagccctcaggacgcggctggggttggtgcgcggggccccggaaccccaaacccggctcggttcggcaaggttcagggagacaaggtagagaaggctggggtgagcgagaagtcgggcggccgatcgtcagggccacgagcctcgccttgccttcttggaatcccacccaactttaaaggcccaaagatcctgaaaattccgaaagcgaaactgcgagctggtctccagaagtttgagaacggtctcccaggctttccagcgtcgtcccgggattctcggacaccacaaacgccatcaaccacgagcaccggtgtccgtggctattgccccgaatggtccccatccgcgtccccgggaactccctcggcttttcgcgcatccaggtccccagccccagctactggtgcgccccgagcccctaggtgccagagcggtggtcggccgggctcctgcccagtctcggctcctccctcctccccaccagaaggaaaaacttgggcccttcgagaaccctgtggaatgttctttgtaatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccccgggagggcgcgcccaaacgcaggctggaggagccacggacgcgtcctggccggcgtgtcgccatcgttcagcctcgctgcccaggtgggaggggtcacctgccgcggggtctccaagccagtgccgcttgctcccggcccccacccactgacagcacggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgctcggcgctcttttttttttttttttttttttttttttaagattttgtgtgtgtgtgtatgtgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccgggcgagctgccaggtagccgtgctcgccacggcgtctcatggggcacctagctagtggcgggcctcatagggcgggaaaagaatcgtcgctcacaccccagcaaaacgtggccctcgacggtccgttggagagccccggcggccgtgagccccgggcagggctggacgtctgcggagccctcgggcactttgtcccgggcgcctggggaggaacgcggagctcccagggccttaggtgcaacggctgcgcagagcccaaacgaaatgtccccagtgcggaaaagccggtgacgccctggtagcaagaccaagagcttccgaagaacgctgcgcccttaactagggggcctcgcagagatgcctgtgtgggcctgcattgtatatttctgcgaaatagcgaatggacacgtttgctcagggtttttatggttgccaaagggggtaaaattacccagtcccccaaatctgtgtcccatgaatccctctcatagtacccctctccagggggccaagaggtcctccaggtccccgtgggttcgcagctccacccgcccttcctcgccctgcatccctaaggagaggtgtccgctctgaagggctaggggccagccatggagtgaggggaccggggctgaccacgcgcggcacagacagaggtcctcaggcgggccctctcctggacggtggggccggagctgatctagaagaaatacggagggacgtgccgagaagccgctctccttcgccgcgaccctggagagcgcctctccacccaaaggatctgccgagctgagagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaagagtccagcgactcgccgcgcggcgcactttaaactctagcctgagtctgcgacccctccagctctccagtccccagctgttggggacatcaagccggagccctgggctctctgccctgtgggtcgctgaaagcagagactcctcaaaccaaccgaaccgggcgcattaaccctctcgcctgcaccccgctgcctcccggttgagccccgaggcggctccaggtagaacctgctggactgactgcggcgtccagaaatctggagtgtgggctccagacactctccacggtttggccccgggtctcaacacccaagtcgcctcttctggctccttcaccacacagcggggcctgtggaaagggaggggccgagagacccgtcggcgcaccactgtcctcgaggggtccccaccctgtgcactgctgaagcgcagggcgcgccgcggcaggaatggccccgagtgcggatcccctgccctgagcctcccactcttggcccgcgctgcgcctacccagtggccctggccccgcagggcgacagcggctgctccctcccatttgcgtcccagaccgcgcggcctcgcttagctcccgggagccgacaggcgcttgccctggtgccagcgcagggcttcccgggggcttggggtaggggtaggggtgcgggggggaaggggagaacgtaatttccttctgcaggagtcgtggagacgtgagctgcaaccagccaccgcg

SEQ ID NO: 5374 - DNA, 5964 bp, Homo sapiens; identical to SEQ ID NO: 5373
  source 1..5964: mol_type = unassigned DNA

SEQ ID NO: 5375 - DNA, 5964 bp, Homo sapiens; identical to SEQ ID NO: 5373
  source 1..5964: mol_type = unassigned DNA

SEQ ID NO: 5376 - DNA, 703 bp, Homo sapiens
  source 1..703: mol_type = unassigned DNA
acgcgaaataaacgactccaggcccccagtaaagaagcagcggcgcgtcccttttccccggcccagcgtgaaaacacggaaggcgaagggctgccgtcagtcgcctccctgccaccgcgaccgggaaacaaagacacattaccttttattttttgcgcttccaagggatccgaggaacttctggctgcaagcggctggtaccccggaacgggcgtcccattcgcccgggcgaaggcccttggcctactaggcggccttggcgcccgcagctggcgagcccccgccccgtccccgccgccgcccccgccgcgggccctcggcgtcagcccatagcccgctcgcgcctctcgcgccgagcctggcccggcgccagtgagccccgccgccggcccgcccctcgcccgcgcccggcccgccgcatggtgcgcccagcgcgccccgagccagtccccggcgcgctgctaggtcgggtgctaggcggccaccgcgcgccaccgccgccgccaccgcccgccgcccgatcctggacaacaatgcgcgcccccgcccccccagaaagccagggacgcccccagtcgccgccagagctggctcggcttcccagcccctctccgtggcacccgcaggcgagacaaagttcgctcccggtgaggctgcgcgcgtccaaagcgtgcgggatgcccagcacggaggtccccaagcg

SEQ ID NO: 5377 - DNA, 1315 bp, Homo sapiens
  source 1..1315: mol_type = unassigned DNA
ccgcgccctcttcaaacacacgcacactcttacactcactcgcgccgtcccagcctgcctactcccaacgagtccaagccggtgcagccgcgccccatgcccggctcgcagctcccgagccccagtccgcccgcgctgggcgccgctgtacctgttagtggcgcgcggtaccgcggtcgccgggctccggagcgtcctcagcgctgcgggggtgccgtgggtggcctccctgctttcctccaccagaatcctgcacagccggggagaaaacttaagttgctacaccccgccgggagctgttggctgaaaggctgggagtcgcgctccttgcctggcagggagatctcgcactccccggctcccaggccaggtccccagccccagagttggaagagccttagggcgggaaggaagagacagcaaggaccagaatggggagcatgagatcctgatgcggaacccgacggcaggtcccgctccacagctgcctcgcccacagcgatgcgcgctagagcccccgcagccctgaccggtccctctgctccccagccgccgtccaccggtcggagggtcgcctccctgcgaccccctcccccactccactctcaggccgtcgccgcccgtgggctgctccccgccgcggccaaaagtctccgcgcccgaggggaagcgatgggcggcttgggggtccgggggcgccaggcggggcgcgcggcgcggggcgcggccggcgggtgggtgggttacctggcgcggccgggcgcgtctgccgggcaccagagcaggcgcagcagcagcagcagcagcaggctggcgagcagggcgagcagtgcgccccccggccgcatcctgagccacaggcgccgccgccaccgctgctgccggggcgaagcacagcccgggcggccccgactcgcggctcccgccgccgccgccaccgccgccgtggccgcagccccgcgcacccacagcgttcacaggcggcagcgaggggcgcccgcagcccacccggcagagtctccgcggcgggcggagaagaagccgcgttcgggctcgccccgggctcccggccccggcccgcggagcgccgcgatcggctggcagatgacgattcgccgagctcgccgcctgtcctcccggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacg

SEQ ID NO: 5378 - DNA, 1316 bp, Homo sapiens
  source 1..1316: mol_type = unassigned DNA
gcggccgtcggtttctagccttgggatcattctggccccgacacggagtgacaggggatccccacgcgtccccgcatccagggcgcccctttagctgcggcggaggcacagagaggccttggcggcgctgtggcttcggtcggcaccgggtcccgcgcagccgggccctccaccctgagtggagctgccttctaagcacccagcccctgccaatcactgtgcccaacaccaagttcccggggcgccctgccctgcgccaccgcgcgctcgctcgcccgcccgcccaactcacctgctgaagaccaggcagcccaggtggttgatcttgtggtcggagcggtggcggctgtagtcctcccacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcccgcgccggcctcttaggttatcatcactcgcggcccgggcgcggcggtgcgagctccccgcctgcgggacgcacggagaccgcggtcagcgcgccgcctggccggcccagcgcgcccagcccgcgcccagccccgtccactcccgtccagccccgccgcccggccgcagtccccagggcgcaagctgggcgggtgccgcacagagcccccttgtcctcgccgcccgcccccggcccgggtcgtttccgccgcggtggccacggccccgccctcgttccgcgcccggactgggccacgccggatagcgggaaacaaaaaaagcccgagctggaaacttcagagaggtttagtttcgtttcccagaagcatcagttcggtcccaaaacgctgcaaacgcgcgctgcctgcagtaggagagaggaaaccgcgaagcgcgagaaaaggcgcccccgtccccaagcagcccgcgcgcccttccaggggccagacctgctccatcctggacggcgaaacgacctcgggagaccccg

SEQ ID NO: 5379 - DNA, 1110 bp, Homo sapiens
  source 1..1110: mol_type = unassigned DNA
gcgccgggcctggcttctgtggcttcgcaaacttttcagcctgtgtgccacggcgacgcgcagcggctgagtcggagcccacgcggcgcgcgcctcccgcgaggaacttttcggcttgtaggctgcttgtcactctcgctttccgacgcgcctccccctggctcgcgctcccggagttccctcccctcctggcgaggacctttcccggcgcccgcggctccgatccccgccgcgctgcgcccgctctcccggccccggctgccccgctgagggctcccctctcccaggcaccgcagccgcgcccccgcgtcccgcctcccgagcggctcgcttcgcccgatgccccggccccgtcccgcgcactgagcgcctggcagcagggcgccgagtcccggggcgctgcggggcgctgcgccgagaacggccgggcctgagccctgggcggcccccagagccgatcagagcgcggggaggcgggggcgaggaggaggggacccgccgccgggggctggctgcttcgctccgagccgacttttcgccaatggtccaaagggacatgtccaagtcgcctcccacagcggcggcggcggtggcgcaggagatccagatggaactgctagagaacgtggctcccgcgggggcgctcggagccgccgcacaggtagcgagagcgcggcgccttctccttcctttgtgagccgccgggcagggcaccgacctcgggttctcccggcgcctccactgcagggatctctagcctcgcacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatcgtgagtccgggtgggcgggagggggcccgcttcccgcagcgctttctacgatgccgactctcctggccacgctccgagccggggtgggcg

SEQ ID NO: 5380 - DNA, 1655 bp, Homo sapiens
  source 1..1655: mol_type = unassigned DNA
tcgctttcgcccccgctgacactttgcaaagccgcggcggcagcggcggggaccacgctgcggtgcaccaccttccgccaccctcccgcgctgggctggggtcgagggggcttcgcagagtcggtaaccgaaccggctctggtttgctttctccactccctagccactaccagaaccagcctccgcgaaggggcgagctgtggttaaccctttcgtgcccagggagaccccgccagggtcggggcggggcgcgatcgccccccgcagtcgggcgcgaaggcggcccgggagccaggtgggtgtggggcgcagttggcggagctgcccagggcgtgcgagcaggctgcgaggatggcgccccggcggcgcggaggtaccgccccgcgctcccccgatagctccccggcctgtcccctctccccgcgctctggggcagccggctgcctggggcgcacggggctggagtggccctctccctccccttcgctaggctcccccggcttaatctgttggccgcgactcctcagccagccccgaggaaagtgcagccattggacaggtctgtgcgggctgccggtttcagggaggaaggtgggagaagcctggaggagcgaaggggagggcggagggaggagggaggagggtgcggcggcagatctggcaaattgcgagctgccttccctcctcaaagtgtggagaaggagcgcgggggagcgtggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccg

SEQ ID NO: 5381 - DNA, 1655 bp, Homo sapiens; identical to SEQ ID NO: 5380
  source 1..1655: mol_type = unassigned DNA

SEQ ID NO: 5382 - DNA, 304 bp, Homo sapiens
  source 1..304: mol_type = unassigned DNA
gcgggcgctggaaggggggcggggtaaatgcggccggcgcagaggtggggagcaggtgggaaaggtggaggcgggctcgcctctggagacctacccctgctcccattgtcctccgcctgccagcttcacagacaggcctgaacgcgcagagagttccttggagtgccctgattttgtccccgagagggcccccaacctccgcatcctcttagtggctgtcctggcaggtgcgcgtcctgcggggagttgcgccccgggggctatcgccgagcgggagctgcctcctggaaccctgcccaccgcg

SEQ ID NO: 5383 - DNA, 1666 bp, Homo sapiens
  source 1..1666: mol_type = unassigned DNA
gcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggccgctgttcacttctcgctgcgccgcgggttctgtagaagcgcaagaatggggctgattattccggtgcccacatgccgcccccacacgcccccacccccgtccggcgcaagacttcccttggccaaaagaggcgtttaattagttctggggccgcggagagccagcgtggccgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaaggcggcgaatggctgcctagccgccgcccctactagtgacactcggccgccagcccccgcccaggatgtgcacatctgctggcagcactggcccgggtggcagtcaccgggccacccactccacaggtacaaccgcacccaatccaacctggaactcggagggctgtgcgcgccgagctgggatcgcgccccagcgagccgggcctttggctgcgccagggcccaggccgagtcatcccgccgctcgcgtcgccgcgaggcgggacaccgtgtgatacctttgccgtgggctgggcgtcggccgcggggcggagagcgggtgtcccacctcgcctcatcatttgatttccgccagcgtctgaggacggcgcacccaattcgttccactcgctgcgctctgtgaaccagcggcgggcagggcgggggaggccgggctgggggagggcagggtggtcccaatcccccgcccccgccccgccggcctcgcggagcacaagtgttgggattcccacgggcaggcgtgctctgcggctggaggcccgagcgcccagggcccaggagacgtggcggacacagaggggtttgtaggcacggtgacctccgtgctcctgctctgaaagggcctgaaaggagcggtttatggtgcattaccagtcaagggctcaggtaccagcgccttgtgtcgggaacccgggcggccgcccgtgctgcaggtgtctgctatacaaacgccccgggagggggagggcaggccgccggattgggggccggggaggggcctccggcctggcctgctcctgccactcgcgcggtttcg

SEQ ID NO: 5384 - DNA, 5030 bp, Homo sapiens
  source 1..5030: mol_type = unassigned DNA
gcgccacgtggagagccacacgaactctaagcgttcccgctcttcagcccctcgcgggaaaacggatcagggtgttaatgggtcctgattacctgcactagcgtcatctgcgagccgagggccaagagtatcttctcggtcttggtggggtacgggttgtcacggtgcttgtaaagccactgcttgaggggtcgcgccatgtcttgcagggcctgccgcttgtgcctcaccttcccgccattctgccgggcgctgggacatggggagaggaggcggccctggtgagcgacgcgtttgcccgcccggacgctccacgccccggccaagcccgggccccgcatccaaactgcgcattcctgccttgcgcccctgctttgcgcgcgcccagagtgtttgggagaggcaggaagtgggagccacacagtttctggatggggagatcatttcgataggtttatcttgaatagggggataccttgaacccaataccccaaggttagaggtttagaagacgaaggtcaagtgatttgaagaatactgctattccagtcgcgtatctgggcagcggggctaactgctacccttccctcacccgctggcgccgcaccctcgagtggccctggcctggcaggcctggcagggtatgcggctggctctcgaaacttccctcggggatctcttgtctgctcccagaggctttccgtcgcttgtggtcaggggaaaggtcgccgactggacatagggaataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggttaaaagtacggcaagctctgtcccatcatgtaaggtaaaaagacctcaggaaaagcacattcaaagggggaggaggcagaggcagccaggagcctggagcgtggcctggggcgctgcgctccctcacgggtccgggaggtgtcgcgcgcggccgccagcgagcccagccgctccccgaggcttgcgcgcctgcgccggagcctcctgggtttctgcctctttaaacactttgaaatgcaattccacccgaaacgactggtagtaacattttgacgaaaccgaatctctgttttactaagcagcgacgccgcagaacaagcagctgatgcaatcgttcaggtggaggcggctaggacggccgcccctccccggcggggcgcccggggagccgccggatcgggccaggcagagcctgccctccactcaccggcagtctgagcagctggcccacccgcaagctaccgccccccccagcatacccctcaccccgctaaactcaaacccggccccgcaggcccggggcctccccctccgggttcgccgcgggcccagccgagccgcgctcacgcccgggactccctggcgggaggcgaccttcccgactccttgggccaggcgagccgcggggctctggcgaggggctcgagtgaccgaagagaagtccgcggagcctgagcctggactccccgactgctcggcttcgcctgtttctctgcaccgagctcagtcctttttcctcgccctcagccgcgcaccggcacccacagtccggagaggggcaaataacccccaactccgaggtccaggcagcggagggccgaggggcagctcctggcgcccttagtctccaccaagctctttggagctgccccgacgaattgatccctcatgttttaagataggagccccttaacatgagaatgcgcgagccctggaggggcagacctgcactcccagggaactccgggccctttcccgtccacccgcccgcgttgccacgggaccccgtcacagctcaccacccccacccctccgggccgcaggcgggcagggcccccaggggagtgcgcatacccggtcctccggtgtctcaggccgaggttgtccttgaggggcgggccgtcgggaatgcccacctcggggcgggcgtgaggactgtccaggacaccgctgtagggccggccaccccgctcccgctccgaggcgcctccgtcctcaaacagcaccgcaccgctgagcttgttgaagacgatggtgttcatggtgtcggttggtagggacgcgcggcgcggccgcagagcctcggggctgggccgccgggagctccgcagcggggctcggcttctaggagaggaaggtgcatctcgttacttactggctgagagtgctcagacccctgcaggttcagggccttgaacttggccgggtcgccgggctgcggagccgaggggaggagcggcgccgccgcaactggcagggaccctgcggctctccccagttggctacacgcccccgcccctgcaggttccccggacaggtacctgccctcttccttgcctgggcgatcgatccccccaatcccttcactccccagaactacaaccgggaatcattcacccgcagaggcaaaggaaacgaattcccaaacgagcctctgggtttcagtttgaatctgggagaggcatactccggactgcggagcgcgaccggcgtgaggccgcgcgtggttcttcaatcacagcagaagactaaagcctctaggaaccccaactcggggcgtcaggaggggttggatggaagggaagatttggggtaatgtgccaaccgtatccacaagaccccccagctcatgagtcccaggccataccgggatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcatacacacacacacacacacacacacacacacacaccctttgcctcgccaagcgcccacactcgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgcgacgacgtgtttttcctagcgaagtcatcacgaggttagccacctcggacacttccccggcagccccaagcccacgcagagatcgcagacacagacacccggcgcgctgtaggtctgcaggcagcaggctcagaggcaagcgatggcaaaggtccgagcgctgtcctgtcgcaaggggtccgggggcgtgtgaaccacacttgctgaccctcccaggactcccgcgcgcggccacccgcgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccagaccttggagggaagttgggggaagggcgggagagcaccggcgcccagggcgcaggggccagagcgagcctggcgttccgccgcagccggctgagactcggcgacgcgggggctgtacctgtggctgcggggccgacggccggctgcagggcggctggctctcccgcctcgagactaggcgcactcccatccccgccgcatgttctccacgcgggctccagcgcgctcaccaccgccaccgccgtcgtctcggctttatttacccagcccggcgcgcgccgcccgggaacaggaatagcgaggccttctcatgtttcctgactgccggtcccagccggcgaacatcctgcgggcgcggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcg

SEQ ID NO: 5385 - DNA, 2868 bp, Homo sapiens
  source 1..2868: mol_type = unassigned DNA
acggttctacgcgaggaagagggcggggagcgcggaccgggtgtgggaggccgaggtgacagcaggtgagggccgggtgcggatggggaagtgagacaagcaccgtgtgggtattactcattccgctctactaaggaggctgctggcaagcggaacttctagcctctctttcaatccagctgaagttcaatctcattgaagtcacttcccatcccggttcgcttggggggaaaccaggcgtccctggaagggaagggaagggagtccgggctgcgcgggtcaggtagcctctctccggtcgccgcgtgtcctcgccgtccccaaacctgcccttcccctcatcaagggaactccccggggagtccagaccgcgatccctttccttggccccggggtgcggggggcggacacgcgaggcgtgggactgatggtagccctgcctccaggaagcaggcaggcggggacctctgggcgctcggaggggcagctccgagggcacagggtacagggagaatcagccagatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacggtgagtggcggaggggaccggggagcggcggagtcagggggagctgggcagccggggcgcccccgggggtgaggggggcgagccgggctgggggcagccggggcagggacggcaaagtggagtgggaaagtagaaagtagtgctctctgcccccctccgctgccgccgctgccggagccgcgccgcggccgctcgctctccctgaaccgttatgtctcttacctggtctctctccgcctagcggctcccgccgcccctgccgcctccctggaccgttagccggcgccgacgccgccgcatccccggcgcagggcgggcggccgggacgcactggccacttttctggtcccgggtggagcggctgttgcttctttccgcacttttccccactcttgtgcccttcggcgcctccctctccccctcctcctggccccctcagcgcgattctccctcagcgcccaggcccccgggagccgcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggagggtgggggagggggcggacggaccgacggacgcgcggggctgctacttgcaccgcagctgcagtgtttattgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttgtaagttgattgtatttctggttatctcggggcgatgctatgctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctttctccctcccctctgggatgcgaaacgcg

SEQ ID NO: 5386 - DNA, 2678 bp, Homo sapiens
  source 1..2678: mol_type = unassigned DNA
gcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggcggtgggaggcgcgcgccgggcgctttagaggggagagccaggcggggcggggcggggcgcgcggtgaggggcgggcccggagccgagtgctggccgtggccggggtctctgacgcgcgactccctcggcggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgctttctgtgcgtgggggctcaagctcgccacctgcccggcttgcggcgcagccgccggcagagctcgatctgcgggaatgagacccgtctttgcagtcagcgtggctcggactccaagcccacggcgccaccagccgagcctcagtttcctcgcctgtacaaacaaagcagaaggcgccggcggctctcagtaaaagcgaatgtagcctttgtacttccgacctctcaatggtgaaatgagctaatcacaggcccaccccgcggagtgggacgggagattcaatgagacccgccccacgccgcgaaattctctgcatcgtgtctgacaagcagacagtactcaataaatggtagctgtaagtaagtcctttaaacctaagtacttactgccttacccaagaaaagctccgtgcgacccaaagagctgagaactcccccaccccgacctccgactcctaggacagtactactggcgtctgccttctgggtccagaaaactcttcccacggagccgtccctcggcggtgcttagccctccggatacccccgagacatcccagatggccccagtccggtggcgaagggagggtgcaggtcggcacccaggagacgtgggggtgaggagagcgcccctttgggcctcgctttgtgaccgcaggctgccccagccacctctctgtgtccttcccagcacagcgtccagcgaagtggggtcagtcgccgcgtccatccaggggcctgccctggggacacgtccctgtccctggggagtcctggccgtcggggagtgggcggtcagcggctgcattaggcgggagcggtcaacaggaggctgcgagggctccggaactccgctggtgggagtaggtgtcttctgtgcattttttttccaaaaccactttggccgttagatggctgtgggccggcactccatccatccatccatccatccatccacccacccacccacccacccacccaccctgggcactgggcttggagccgggaaccccactgacttggccctgctcttaaagaactgaaggcagtgaggtccagtgaagaaggcagccgtcgggcgtccccaggcctttgctgggctgggccggggagcctggccgctcaccggccgcagcgctggggctccggcgccctctggtggcggcgcctccctccccgctcccagagctctggccagctccattcctgcgcagctgatgaaacccgggagggcgaaggggtccgcgggaaatctacacccgggtggaggggcgccctggagctcggagatccgaccctgcgggagccgcgcgcagcctcgcttgcccttaaatctggccaaagcaaacgccatcgcctctcg

SEQ ID NO: 5387 - DNA, 2756 bp, Homo sapiens
  source 1..2756: mol_type = unassigned DNA
gcgggagggcggcagcggccaggctaatattcgcgaccccgactggggcgcggcaacttctgccctcagtccccacaagctcccggccgcgattcgcggccgagaaattctgcggaggggccggtgggtcagagccaggccaggcagttgctgagccttcccctcccctcctggcgggagtgtgtgtgcaaggggccagggggcggagtcggagaaagggttgggggtgtccgtgtccagcgctcctccggacgcggctccacaatccagctgcgagaacagatggacgcagcggcggctcacctcgggggcttcctgctcgctgtgcgccgaggtccaggctgaagcggagatcgcaagcctctggctcccgcctctcccaaggggcctcgaggaaccggctgccgcgcccccttccccaagaggagaagagcgggcgctgaccccgcgagtcctagaaccgcgggcggggggcaggcagggggcggggggcagagggccagctaccggcgcggaacgcccatcccaggggctggttcaagacttccacaccgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcctcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctctacagtcctgttcgccttcgccgaggactacgccacgctgttcgcggcgcgcagcctgcagggcctgggctcagccttcgccgacacgtctggcatagccatgatcgccgataagtacccggaggagccggagcgcagtcgtgcactgggcgtggcgctggccttcattagcttcggaagcctagtggccccgcccttcgggggcatcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcactatgcggcctctgttttggcatagccctagtcgacacagcactgctgcccacgctcgccttcctggtggacgtgcgccatgtctcagtctatggcagcgtctacgccatcgccgacatctcctattcggtggcctacgcgctcgggcccatagtggcaggccacattgtgcactcgctgggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgcgtgcgaggacg

SEQ ID NO: 5388 - DNA, 990 bp, Homo sapiens; identical to SEQ ID NO: 5158
  source 1..990: mol_type = unassigned DNA

SEQ ID NO: 5389 - DNA, 829 bp, Homo sapiens
  source 1..829: mol_type = unassigned DNA
gcggtgcgacgaggtcaggcccgcgcccgccaagccctagggccgctgccgccgacggccatggaggacgagcagcccgacagcctggagggctgggcgccgctccgggagggcctcttcgccgatccccagaggcaccggttgcgcttcctggtggcttggaacggcgcggagggcaagtttgctgtgacttgtcacgaccgcaccgcgcagcagccgcagcggcgcgagggggcccggctggggctggagcacaagcccgaggccgccgtgtccccgcccagctgggccggccggctctcggccgcggggttccgcggcgcgcgccggcagccagcggcgctgtggccgcctctggaacactgcttcccacggctgccgccggagctggacgtgggcggcggcggggcctgaggtctggggctcgggcggtgggcgctgctctggccggcgcgcgtgggccccggcgaggcggcgctgcaggagctttgcgggcagctggagcgctacctgggcgcggcggcccacggctgtggcggcgccaccgtgcgcgacgctctcttcgcggctaagggccgcgcggccgactgcgagagcccgcgcgagtttcgggagcgggccctgcgcgcctgatgggtcgaggcggacgcgcggctgcgtcaggtaagcgaggccgggccgccggcgtttgaccgcgcttgggtggcctgggaccctgtgggaggcttccccggcgccgagagccctggctgacggctgatggggaggagccggcgggcggagaaggccacgggctccccagtaccctcacctgcgcgggatcgctgcg

SEQ ID NO: 5390 - DNA, 4119 bp, Homo sapiens
  source 1..4119: mol_type = unassigned DNA
ccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccccgccttactaaccccctcaacttcgcgggcggcgggcaggtgggggcgcgcctccaggccgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggagacccaactccctcgctacctggagtgtcagaaaagccgttttggagaggggttggactgagcctgggatggtatctccttttgccctccacacttaaaaacaaccaccacacacaccaagaaaaaaaaatcaacagaaataaaagtagcaaacaagttgctgttttttaagaaataagaaaaatgtctatttgccactgactctctcctgtctgtgttccggctgctgggaagccaggagttgctggtgtagtgttattataacagtcagtgagtcccctcgccgagctattaatcaattgctcctcgctcagttagacggaaagtgttgctctaagtatttatgggcaggtcttcaatacccgtgacgtcgctgcccatatatggactgaggaacagggctgggccaggcggcttttgccgtcacatggctgatttgcatacacgggctcggccgcgcggactccgccgggctcgcgacttccagctcgcaggcggcggggatcgctggggtcccgggcgcgcggccctagctgcagcctgggtccggggcgcagggatcgcgggggagagggcgcgccatggacccagtcacagccacagcaggagagcgagctgctccaggctgcggctcagcctcccggggcggggaggaattccggttctctgggactttccaaaaaaggcgaagatccggtgccggcggctccgcctccctagcccttgtttgggagccattccggaaaattaaacttcggaaagaaaccgagcggagccgagacactacagtcaaacccctactcactttcttggcagctcaaaaccgcaagcaaaaggaggcagcgaagaaaaaaaaagctacatgcattcacggaagctgactgcttttttctgaattacttggtggaaagaagtggctggtgataagagtgaatgcgtattgcttttttggaaagtctgttctatttatacaggagcgaaaacggaacaggtttgggttgtttgtttgtttaagtattttgggcaccttgggactgggagggtaaaccctaggaggagcagaattactgtggggagcttcgagagaaatcctcagccggagacaccctccttcctctgcccgcgcgctccccgccccccttcagctgctgcgcggagcgggcgcccttcccggcgcgtctgggcggtcggctgcgtgggggcgtccagatggaagcttggacactcaccctgcccctccagacacacatacacacacactcacactcgctccacttccgctacacactcccgcccccgctgccctcttcacacacccgctcacacaccttacactacacacctccctgttgactgcgtccgcgcgccgtcgttgccagcagtgtcccggcggcagagcgggctccgggctcgctggacaggaggttctatgaagacactggcctaaccttcactaccggtccctgcagccacagaatccccctgacccccatagcccaggatccaggaccgcgccctgcccgcacccgagccagaatacacgtactagaataaatattttctctccctccccaaaaaacacctcggtgagcccagcgcggtcctcagtgacggccgaaagcatctctaatcactttcaagacgccatccccatcccccaacccactcgttttactttgcgagaccccggtagaaacccttctgtttcgttcccaaagcaatttttaaaaacttttccaaagtccaaatagcagcaggttctggcttgctgggcgcaaagcttctacctcccagtgcgccccagcccgcaatggatagccgggcctgtccggggccccacaggaggctggtcccgggtgcccaagtccagcgcaccgccgcctgcatgactcattcatggtcgtttgtgcaggttgcgaactgccccagagccctttcccgctccaaagccgcggaggccagggataacgcgcagggtcagcctcgcaggcctgtcctgtccctttttcaccccgggcccggagcggccctagcttagtgtgggccggggcgggcgggagccacggcgccacgccgtggaggaagcgcggcgctgcaggcgggtcttcagccgctcacctgcctcgaccgctgcagccgtgcgccagctctcgccgggcccagcgcaccgcggtcagggccctgaggctgccgggagcggtctctccctctgctcttccactgaagcgctgcttctccccctccctccaaaacagccggtatccagcggccggccatctctctgacttaagtcacccagagcacatttgggaaagtttctcgctcgcgctgtgcgcttttttccaattggggatgaaaaggacatggaaagaaatcgcagcaaggttagcaccctagtagataccccaccccagcaaaaatgtgcaaagtcctatttctcaagaaagaaagaaagaaaagaaaagcaagaaaagatagctgcgttcttaccacgtgcgccagcccactccgcctgcgctctggcgggtcccgcggcccccgcgctgaccatgggcaagacgacgcctcggaagggagtccgactcgcatctcgggccctgagtccgaaagaacgggggaaagccgaattatgcaaatgcggatccctgcgatggggctcgggttacggcccccgccggccccttaggtgaggcacccaccggcagcaagcgcgggcgaggcgactgctcgcgcttcgctcctctctgcgcacgtgggcggaccggcaggcgggcgagttgcccgggccgccccgcgactggcgctgctgccaaacccgccggcggtcgccgcgcgccaccccgagggggagctcctggacgcccgagtgcccggccagcagggcgcggagggcaggaccggggctgggggcggggcggggtgcctgagcgagggaaaaccgcgaggtcttcggctgccacctttcccg

SEQ ID NO: 5391 - DNA, 1575 bp, Homo sapiens
  source 1..1575: mol_type = unassigned DNA
acgcgtccatggaaggtggtgcccgcctcaccgcctccgtggaaggccaaacgagccctcggtgtgaatccggagaaagagagggaagtgcagcgccagctccactccacacccccttcctgcctataaataaccccaagtgtcacttcaaagaggacggggagcgcggcagaggggctcccgggccggcgggctggggccgccggacctgctcaccacgccccccaccctgggcgagtttgcataaataaacaaatccaagccgtcggccccgcgggaggtggaggaggagtgacgaggaggaggaggaggagggaggggggagggagagattagtttgggaagtagcacggattgctcatccgatccgtgccgccgcagggagtgtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgaggtctgtgctctttgttgctggcttttatccctccccgcggcgccccctcgcgcagcctccagactgttcagccggtgtccgcgggcgctcgctctctgcgagccccaggttcgcgcgagttgcctgcgggaggggtcggggacacggacagacgctgccctaccagggattcggaggacctggtgggcaagagcatgacccagcgactcccgcctcgggcaagcgcccccggcttccagcgctgggagcgccctgggcacgccgggcaggtggaggaaggctgggcgcgcggaggctcgcggaggcgggcaagctccactcctccctttcgggacccggccagggtggtgtgacagccgccccgcgcccgcgcagcggcaagcgcgcccagaggcccaggccg

SEQ ID NO: 5392 - DNA, 2401 bp, Homo sapiens; identical to SEQ ID NO: 5168
  source 1..2401: mol_type = unassigned DNA

SEQ ID NO: 5393 - DNA, 1579 bp, Homo sapiens
  source 1..1579: mol_type = unassigned DNA
ccgaagtcggggagcgggagcgtacgtgcgcgtgttcaccctgtcctgggcccctcgctcggggaatcccgggggtgccagggcacccagggtcagggaagtaagatgccgggccgcctaccttctccaccccgtagcccgttccgaaaatcctttaaaccgagatttaatctggatgcctagccccgccctcccctcccctcccctcccctccccccggccgaggccccctccagttcagctccctcctccaccccctccccgccgtggaccctcattagcatgcccacttgggaggattcgctggggggcgggagacacccgaagtcatccaccgccagcgccttcccggcggcctcctcgggcgacagcgctccgggagccccactcgcacaagtgttgcttccaattaattgcctgggcgggggaaggaaaggggcctcgtcgccgcccccgcccggaggctggagtgctgctcgtcgggtcgtgcgttcgctcggcagcggcgtgcaccagcaccacccctgcgtgcaagtttgaaatgtgagctgcctccgattcatactcgctcgcgctccctcgcagcgaagtggctgggctgacggtctgcgcgcgcgagtgagtgcgggcggcgggctggggggcggggtgcggacggcgaggctcgcggggcggggagggcgcgcgcgagccggggctccctggagacgccaaggcaggtctgctcgcctttcatcttcctcccgcgctcctcctcctcctccctcccctccccccgccgcggctggcctggcctcccccggagcccccagccccacgcgggcacacgcagggtgggtggtcacgcccgcagggtccgcgagcgcggcgcagagcgcgggccgtgggaagtttctccggcgcgccccgtgcgcccccgccccccgcgcgcccccggcccatccccgtccctggagagctgtcgcttgcgcccgggcgcgcggctggctgcctcctcggcggcggcggcggcggccccattagcggagcctccgcctatgattggcttcgcccgggaagctggagacgggcgatgaataattgatgtgtgcggtgcggtagccggacggcggcggcggtggcgggcagcagcgagcgggagcgcgggagccggagcgccctcggagcgggcagcgcggagcgagcgggcgccggacccgcccgggcccccgcgccgccgccgccgccggggcgcggagcggggatgcaggcggcgcccgctgcctgcgcgcagcctttgttcggcgctggctgaatcctacccggagtcgctcgccgcggccgccgccggccgggccccaagcccccgagggcgccagggcgggatcgcgaccggtgcaacttctaggtaagtgcggggtcggaggggtcggcgcctgggcgcccacgggccgggccctgggctccctccgggcgcgggggtgagtgtgcgtgcctgtgtgtgacagaggagggccggtgcattgtgggtagcgccgtgtgctgcatggtgtcagccccaggcttggccgcgagagtggcaccggcgtgcaccgggccg

SEQ ID NO: 5394 - DNA, 919 bp, Homo sapiens
  source 1..919: mol_type = unassigned DNA
ccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggtgagtcctgctcgacgcccaaggcccaacggtcagaaccgcctctgcccgccggacccagcgaagctaggggaacaaatcccaaaaacagttcgggcctttccggtgcgctcacccctacacacgcgcctgctcgccacccaggagcggcgtcccgttgccaggcaacgagagctcgcgcctcaggagccagtgtaggcgccgcaaagcggaaggggcgcgcggataggtgagcagagggcacgcggtgggcagcgaagggggaacgcgcagcagagaggagagggcgtgcaggagtaggagcaggcggcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgaggggtcgaggaaaggcgtatgtggaggcgcgcggggtgggtgagccg

SEQ ID NO: 5395 - DNA, 944 bp, Homo sapiens
  source 1..944: mol_type = unassigned DNA
ccgtcggagcgcgcggggacggcggcggcggcgctacctggaggcgcggtggcgggcaggtgcccgaactgcacggcgatgcagaggtcgttgtccagggggaacttgtggcagtgcagcatctcaggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgcttggccagcagcggcagccagctgctcgcctgctgcttcacttcggccaggctctcgtgctccagcaggttgggcagccgcatgcgcttgtagcccaccgtgtggcagagcggcaggtcggcagggatgtcaaggcactgcggcggcttggagtaggagcggccgtgcagcggctcggcctgccagccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggcggcccaggtgttccggcgtgcgcccccggccctgactctacccagccgccgccgccgccgccgcggaggtcgcccaggtgggtggcagcctgcgctgcgggcgccccgactgatcctggcgcctcccacctcggggctccagcccgggcctcgccgtgcgccccagccaatctccggccgcctggccccagctccaaggcggggaggcagtgggggcggccctcagcccctcccgcaccctgcccgagcgtcccgcccagcgccaggtcttgcgcccctctcccggctcggctcccctgccgcagccctggcctcgcccagcg

SEQ ID NO: 5396 - DNA, 1096 bp, Homo sapiens
  source 1..1096: mol_type = unassigned DNA
tcggccacgcgctgggtccggggaagaggcgcggccgcggccgaggcggggacagggaggcggcagcccctcctgcgcagcgacggcgcgggcgggcggaggccggggcgccccagccccccgcccccgctccctccggccgtgacgtcagagccggacggggtaaactgagcggcggcggcggggcgctggggcggagactgcgacccggagccgcccggactgacggagcccactgcggtgcgggcgttggcgcgggcacggaggacccgggcaggcatcgcaagcgaccccgaggtaacacggccccggttccctgctcgcagggcgcggtgccggaggggagcgggcccgggggaggcagggaggcagggaggcccccagagctacgcgggcggggctgcggggaccccggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgctcg

SEQ ID NO: 5397 - DNA, 4048 bp, Homo sapiens
  source 1..4048: mol_type = unassigned DNA
acgctagagaccgtggggcgagagagggagagagttggaagcccactgctccggcggggtcggcagctcccggtctcaactcgcaaacgaacgagccgggtcaagaatcgcgaacgcaccgaccctgggacctcgaggctaagcgtggttgatggggtgggaggaccccgtacccctcactccaggatccctcctggcctaggaaaccgctgggagttttgctaagtgtggggattggtataaccgaacggcgcctttagcccgggaaccagcccctgcccgcttaccctcgcggtgctcttggggcgatcccagttctcccgacgcggggccgcgtaaggcagcagcggcggagcgctaggctagaggaatctgtctgtccttctgtcctaccagcttgggcgaggcaggctcgggattcagggggccgcagcggaggcggcgccggccagggactctgcagggaccggggtgccccggagggagtggtgctggtggaggaggaggcggtggctgagggggagtaggtggggaaagaggaggaggaagaagaggaggaggaggaagaagaggaggaggaggagaagaagaaactggaggaagaggaggaggcgaaggaggaggagaagccgcagcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaaggtacgtgccacgtcgcggaactgcagcgcgccgctcccgccgcatccttcactgcccccggcctgctccgggtgggcgcttggcaaggcctgggcggaggttcctccggctcgcgggccagcgcgccctgttgggaaactaggcggcgcggggccgggcgtggtgtcgatccccagtctccgaagctacgactggtttggagtgatggcctgcgggccgcttgaccctttgggaaggggtgcgaacggagaagttgtcccccagtgcgctcgaatcagagcaggctgggctgtgcgtgcccggcgccgcggagcccagagcccgcgggatccccaggctcctggtaccctcggcaatgcccccaaccgtcctggctccgaggggcgcggacaggactcggccgccaggcttgctttcgactgcgttcgaccctgttcaccacccactttgcgccccttcagtccagacccgcggcttcttagtcttccaccctcttctggaggcgagaggatcctcgcgccccgggagaaaagtatgggatttgttttttctttcctgcttttcggaggcctggggaggggcgggaacccgtgcgggaggaaagctccagggcttggcgctctcgccgcgacctgcttaattggggcgccgagcagccacagcgggaaggcaggttcggtctggtttttgtttttctttctttctttaaaaaaaaaaaaaaagaacctggtcaggaaactgtcttagagggaaatatctgttcgtgtgttttcatttcttgcgatattttttatttgtttgtttttctctgggtacggggtgggaggaggagagttaaaacttcagaaaaaggagtaattagtttacggattggagtcagtaaaagacctacctccggcggcagccgatcaatactccgcggcttgtccattcattaacccattgcgttcctgccggagcctagaatcgggtagatgtcacccccctccccatattttaaaaaatcaaaccaaaggaaaaaaaacccaaaaagccttttacccttaatcccgaactggatttgcctgcatcctgcctggactgtcggcttgtttttctttgtttgggttttcggtgaatcgatttcctatgctaatgagtgaacccaaaactctgaggctttgcttgaaaagtttagggctgcccttcctcattcgctatcagtcatgcttatggtcccctcaccagacccggagccgctgggatcttcctgcgttacagactgtcctggcggtgtctgcaagtcggtaaccccccgggtttcgatcccttcgctcgcgtttctcttctagttctcgggagccgggagccccggagcccagttcgcgagaggcagcagcggctgtagccaagcacacccgccggccagatttctgtcccgatcgggcttcaacgactcgccccgcctctatacttttccggaggggcaataaaacaaataatttaaaaataaatctccatgaaaactctggagagcagcccgccgcctttccaccgtgggtcaaagttccccgagaggttagaaagaagagaaagtagtttcttcgggttgtgggcgccaatcccctggccaggctctgcggctccctcccctgcctccagcgcccggcgaggaggtggcgaggcccgcggcgccagggcggctgcggagccggccgaggtcaggagcctggggactggctcctctgcgacagcggctggttgggtgccgcaccggtggagacccggcgttccgggccgggcagctgagcaggcgttcccttcgtgagcccttgggaggaccaccggcccccgcaggtcgagcggcgcggctatgcgaaggccctgagcacggtgccgggccagcccggctcgggagaagtgcgcggctccggtcagagcagccccccctaatgggatttctgctgtgctccccgcagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtgactgcggcccgggcgcgaggaacccatctaggcgtgcg

SEQ ID NO: 5398 - DNA, 3292 bp, Homo sapiens
  source 1..3292: mol_type = unassigned DNA
tcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgccggaccccaaagggtaggaaaatgatgagttctccgagggccgaggtcacgtcctgcctcttgggccggcgctgcgtggctctccagctgcgtgggggcggcgggcccctgtccagccccagggggcgggggagcggcagctgcgagcgcagataaccccgaggtgacccgggagggcctggtccgcccctcccccctcccgcaggcctggcggcgggaagcgggtccctgcgccgcaggggggagaggcaggcgcggtctccgggctcgcggccgttagtgcgcttcggccaagggcgccgcctgctccgcgtccctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggccgccccctaagcctcagccgcccccacggacgctcttcgcgccagcctcggctgccgccgccgccgccgctgccgctgccgcggcggccaagggggccctggagggcgccgcgggcttcgcgctctcgcaggtgggcgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggcctcatggcctgggacctggaggccggcgcgggttgagcctgccgtccccaggcgccgggcctcgctcaaggctgtgtcggtgtgcatgtgtgtgcgtccgtctgtctgtctccccagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcg

SEQ ID NO: 5399 - DNA, 3753 bp, Homo sapiens
  source 1..3753: mol_type = unassigned DNA
gcgcggagacccgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggagaggggcgcgcactgtggtgcctcctccgcccggtgggcccctgggagcaggcgaacacagacccgtgccggcttgggcttcctggggaaggttgagttgttgagagagtggaccacagcgagagggacacgcggccggccttacacccggctgtcctcaatcactgcacatctggtactttctttccggacacgaggtggagatctgcaagtcgggtctgggcagtctgtctccaccgtaatctctttctgagtcttcttcctcactcgctccgtatctctgcctttctctctctctcctccttggaatgattagcactccaagatgattgacaatggtgcatttcagagacggttcctctttacaacatttgacgaaggggagtcctgcgttagtccttagcgtgatttccaaacaaacggcctgtgaaatgatgccaccctataaagctcgaggaactcttccagctcaattaccaccaagcaaattcgccttttaaaaccatgctaatgtttccccctccagacctcctctccctgttgcccctggcccattcataaaggtgggagcacagagaccccatactccaagtagctgggtccctctcttgtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcaggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgcccgcagagccgggcgcgtactgtactgtaagcagggctccggagcaaggcggcgtgtttccagaaatatgaagaaatacaccatgtgtattcattagctcttatttatggtctctgccctactttttgttttgattgtttcgggtatttattggcattccctaagtcagagagcctgcttcctacctagaccgaaccagtacgctttgaaaaccattcggagtgagatgttctcgggtggtggtgggaaagggagttttggccagacaggctgtggttggtagggaaaaaaatcaggaaaacacctacaaaaccaggtacactcctcccccatatatacacctgtatatatgtacatgcatacacgctcggccaagccaggccctcagaggctttggacaattactaaattgcttcttttcgtttccctcatcccgaggatggtagggacgaaaaggggagagttcagatctgtaaatatttttaaaaagaaaaaaaaataaaacattttaaacatctttgctaactttggtgggcttggttacccggcatgataacgcacggaaggttttcaggtttttcggtggaaagacttgcatgcgtctgtctgtggaagtttggctcgctccacgtggagggtgggaccggggtcaggggttaaaggtcgggaccttggcgccgcccagactgcacgtggctggagctgcccgcccactctccctcctaacgcccagaatcgtcgcgcgggctggggcgcaccccggctggaatccagctcaagagtccgcgcggagaaagacaaagactgggaggcaggcctcgccatttaagcgattgccttctgggaacaagcgagctgggtgcccagcggcatattcccggcactgggctcgccttgagcttggccacagcagctcccgctatgacatgccctgtgccgcgcacttcctctccaggggtataaagcaggcgatggcgctgcttgtacctagtaaagcctccactttgctcgccgcgagcttggcgcgaccagcttgtcgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcg

SEQ ID NO: 5400 - DNA, 829 bp, Homo sapiens; identical to SEQ ID NO: 5389
  source 1..829: mol_type = unassigned DNA

SEQ ID NO: 5401 - DNA, 1328 bp, Homo sapiens
  source 1..1328: mol_type = unassigned DNA
gcggggccgctgcgcgcccccctaagtgtgttagcgggggaggcggggctggaaaggaaacctggtgaagggctggcccggagcctggggtggggatattcactgcgggatagggccagcaagaggacccgacacgcatcgtcccgagtgacacgtgtaaatgtcaagatacagagacatctgcaaatgtcacccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagttcggcgacttacctcgggcctcgcagggcgcgagcagagcaccggccagggcgagcaggagggcgcgggcgggggacacgggcagcgggcgcgctgccatcgtcgccggccttcagtgcagcagctctcgggcccggcggcgagcgctgcaccatcccacgcgggcgccgagccggggccgggcgtcgcgaccggagggatttcctgcctcggcgagtcagctccggagccctcgcgcagcgcccgcgccgccgctgagctcttctagcctttcatttttaaaaaagtttccccccgtgtgtgtgcgtgcgtgcgcgcgcgcgcgccgttctggcacaagccagccttgaccgttgcaataaatgagcaaactgtccgagttggcccggggactaggaagagcgttagtgagagaaggcaggcctgtgaaatggatccacggccagcagtcaccgttcttattaccgcggaacaaattattgtctcccccgcacccccgccagttggcggcgtcccgcgggtcctagagaccgctcgggtccccccgccagggtcccgccccgagccgcggctcgctcacccccgagggtgggcggctcagacgtggctcagtggcgtccgggcgcccggagcgcacacgtccccgccccaggatgatgtggccgcagggcccggggcgcccggctgccaagcgcacatgcggcggcacggtccagcttttcaggctgaagctggaaacgatgactctgctactcgctccccggctctctgggaaccctcggagtgcgggtcaggtctccaccgcggcccacagcccggcgcgcgaccccgcccggccctaagcgcccaaaggggcatctctcgcccg

SEQ ID NO: 5402 - DNA, 2957 bp, Homo sapiens
  source 1..2957: mol_type = unassigned DNA
tcgcctctttcgcacaggtgcccgactcggagtccgggaggcgggccctctttccaggtacccagcccagcgtcagcctgggtccatcctccgccaccccacagcgcggggagcaggggaggccgaaagccgggcagcttggggggccgggataacccgggctgcagcaaccccgggcggcagcaggactggagagctggtgtcggacgcactgcagagacgtccctgttttcggcgcgtcctccgacacccagcagagagcttggcgctctccgctctgcgcgcccgaggtcacagcgcggagaaacctggcggggccccggactccccggcttgggaaaagcgatgactgccctgaactgctggggcgttcgaaatttccagggtcccgaccctccgtggggtacgcgcgacttcggcgcagatgtcagtccgctgccttccgggttgagggagcgaggactccagacgaccccagggccgctgtccaggcccagccccgcgttctccacctcgccacctcgctctgcggctccagcctggagatctacggacttcattgcgatctcttgcgcagtgtagtcgccctctatccctagccccgagtcccgggtaacccaggggccccggcgaggcgagtttctttggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggtcgcacccgggcgctgctggcggccaagctggatgggtcgccagtgagtttcggtgcggcaccgctggcccaggcccgggcgcggctggacatggccacctactgcgacgacctgggcccctcctcggccccgcccggccaggcccaggccaccgcgcaccccccgggctatgagccaggggatctgggcgcggtgggcgggggccccctcctgtgggtgaacgcgccagcgctcagccccaagtcctacgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacagcggctgagcccaccacaggcccgcgtttacagtgcggcggtcccggggctctcaatctctgtgcgctccttcggaggaagaagcgggagagccagcaagctgggtgaccttgggagtgactcaacttccctgggcctcagtgccctacctggtaaaatggggaagacagcgcctaccccaaggatgggcaaaacaaataggatgcccgtttggaaagctctggagcctacctgggggcctggcgtggtctgcgctgtccttggcagagcggctggcggagtcccaccattagcatctcgcaggccttccttcaccttaacggggctcggcctttcccagggctcccttcctcctcctttctggattgtcactttcttcccagtcctgctgtggaggcccatcgggtacagagtgcccgtcaagggtggaatgggggcgaggactcagaccctctgtaagggccagcaggggatctttctgaagctgacctcctcgctggctcacaccacggcccgtcaaagctcgaaccttctgaactgggctgtttcttcttctgcaggtaaaggcaattactggaccctggaccccaactgcgagaagatgtttgacaacgggaacttccgaaggaagaggaagaggagagctgaagccagcgcggccgtgcgctcgggagccaggagcgtgggaggggccgaggcgccagcgctggagcccccgagcgcggcttgcctggacctgcaggcctcgccctctccatccgcacccgaggccgccacctgcttctccggtttcgcttctgctatgagcgctctggctggcggccttggcaccttccccgggggcctggcgggcgacttttctttcgggaggcggccaccgacagtcgccacccacgctccccagacccttaacccctcccctggcttcgcccctggccaccagaccgcggccgccggcttccgcctcagtcacctcctctacagccgggaagggaccgaagtttgaagggaggctggaggctagccgggtgcgggtccagaggtgctgagctcaggcctccggtttcccctggtgacagccccacgtgttggcgttgaaggccttggtgccctgggaggaagcgcagagccgggggcggctcg

SEQ ID NO: 5403 - DNA, 1860 bp, Homo sapiens; identical to SEQ ID NO: 5175
  source 1..1860: mol_type = unassigned DNA

SEQ ID NO: 5404 - DNA, 1422 bp, Homo sapiens
  source 1..1422: mol_type = unassigned DNA
tcgtgcagtccgcccggcggcgttttcgggcgagggtctggtgctggggagcgagcgcggagcgaggtgtctctttaaatacgctctgcagtgtgacggcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaagctcgcgccccgaggtgacactggccgcgaggaaagcagctccgagtaactttcggctccgctggggcgggaggcgccacggataatccagggcccccgccccgcgcgcccggcccggagctcgagccacatccaggcagagcaggcgccgcggccgggctggggcgggcgggtcactcggtgccggttcccggtgcaaaccccccggcgcgcctctggctttgtgcagcccgagatggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccgcggctgctccctggcggggtcggggctgcgagctgccctccgcggggaccctccgcccgccccgctgaccgccgctgtcttcacagatgggagcagctcccggactgcgcccgccccgccgcggtcaccctgaggccaggggcccgggagcgcgacctcctggccgccgtctgggactttgaccttccagaggccatggaggctggcggggagcagggcgccacctgatcgcctccccctggacgcctcctccagcggcgctcacgcttccgcaactttgcagcgctcatggtgagtacgggggtcccgggggtcctgcagctgggggctaggccgctgcgggggggcggccacccgtatggggactcccaggctggaaaagttgtggaatggcgagctggtgaccgggcttccgggctcagtgccggggtgggaggctctgtggagtgggggccggggacaggccgcgtgtctgggcacctctgctccccgcg

SEQ ID NO: 5405 - DNA, 1479 bp, Homo sapiens
  source 1..1479: mol_type = unassigned DNA
gcggctctttccaagttcgaagcagggactcggttctgcgcatctggcgggtgtgcccagattgtaaccttcgcactaggcatccaagaacgtgctttggacacactcggcggtgggagcgggtgcttggtttgcatcagggatgaggggtggagtagcgaaagcgcccggagcgcgcactcactcacactccccaagccagggcgcggccgctctgggcgcgaggtcccaagccaagtctcgcgctcggccaggagccggggagtaccccaggtccccggtctggggccgccgctatcctaccctgcggcgcgcactcctgacctggccccgccccccggcggccgcgagtagcgggcggagcgcaagcagagaggcgctctgggctgtgcggcaccgcctctcctcggtgtctggggagggacggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagagcgaggggaggccgcggcggcctcggagccgtgggaagggggacgaggccgaaggaaactctgggaagttgggagttggggacggccccgggttggggccgaatcccaccgggtgctgctcatcctttctcccaagcgtctagttcctttccttggtatggggtgagaagggcgggacgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcg

SEQ ID NO: 5406 - DNA, 446 bp, Homo sapiens
  source 1..446: mol_type = unassigned DNA
ccgccacccgctgataacaacggaaccgtgggcattggcccttcaacgccgtctcgcccgccctctccagtcagtttggtggatatttcggtgaaggctgcagactctcagagtcacccctccctcaagcagcgttctccgtactcttcggcgccgggaagctcagagggagctggcctgctcttaccttcaggtgtcggcggcggctcctgccgcttcccgcgggacaggaaggccttgggcagcagcagcgacagagccaggacaagcccagaagccagagcgactctctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacg

SEQ ID NO: 5407 - DNA, 2991 bp, Homo sapiens
  source 1..2991: mol_type = unassigned DNA
gcgcgcgcagccagcgtttcccgcggatacagcagtcgggtgttggagaggtttggaaagggcgtgccggagagccaagtgcagccgcctagggctgccggtcgctccctccctccctgcccggtaggggacctagcgcgcacgccagtgtggaggggcgggctggctggccagtctgcgggcccctgcggccaccccggggacccccccaagccccgccccgcagtgttcctattggcctcggactccccctcccccagctgcccgcctgggctccggggcgtttaggctactacggataaatagcccagggcgcctggcgagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcggcggaactgctacgaaggcgcctactacaacgaggcgcccagcggtgggtattccgggcctctccctgctcgctcctcctccttcatggagctgtcctggcctctatctaggacgctcccacccccactcacacacgcctatgtcctgggaagtggtgcaggagatgaaatactaagcaagtagctccctgtcttttggattgtcccggactctaactaaagtcctcagtttccaatctgtctcaaagtactgggcccgggggtgggaggcttgtcgcggccccacccctgcttactaaccgagccctccccgcgcagaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgccgtggctccggctttccctggacatgggtgtgggatccggaggaaaatccgcaaactgggccagctgtccctcagcgacgcctgtaggcggcaggcg

SEQ ID NO: 5408 - DNA, 928 bp, Homo sapiens
  source 1..928: mol_type = unassigned DNA
gcgggggcgagggggcgagggctggccgcccgtgaaaggaaaaataaatcctaaggaagcaagaaatcggacgaaaggatcttactttaagtgatctccttgaacgcgtcttttcaaactccgcgatagcccaaggagctgcgcggcgcggcggctgcggctaagacctgtgactaatgccatttgacctgagcccatggggttttgtgcgtcctgccattcactgttatgtcgttatcttcaagtttatttcggagaaatcactcgcgttctttgtctcaaggctgagctttctgtctatttctctttcaagagaaaagaagacgggaggggaaaagagagaatcggagtccctggtttggggtttaaggtccttgcctacgctgcgggggaggccgcagcagatccggctggggctccccgggcctaggtggccaaagctgccgaaacctgccttggatagtagaaagagcgtgtcggaacgcactctgggggtttcgttccccccgcgcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggctgcaacgctaaggtcaccctttgcaggcttcggacccccagtcctccatgctccctgccggagcagccaacagagtgagagcgcattttggaaagattggccggatgccgggcggcgacagggaaaagcgcccgacgcctggctttggggtggggggtgtggggagggggggcagggagctaacgggcgaggcgaaggaggagggctgcgaggctcg

SEQ ID NO: 5409 - DNA, 1267 bp, Homo sapiens
  source 1..1267: mol_type = unassigned DNA
gcgaatcccgagtaattgttttccgagggggtccgtgcgcgctcggtggcgccgcctcggtctgggttcccccgaggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcggccgcaggtcctgggactccgacttcggtgctccgggtgatagcggctgcggcgcctgcagtccagatcctcgcagttctgcgggcgaaggaggcgaacggaatcggcccccagtggggagcgcaacaagccacagtagccaaaccccgcgctcctgcccgggctcccagacgaacgcagccgcagcggggggccgggccccgagccccacgccgccgccgccgcgccagcggtggggggcgggctgggggcggggcggccggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagaccacggcggcgtggggagacctggagccgagctttgcgctggtctggggaacggcggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttccgtcccagggagtcgaaacccgcagcagggcgggcccgcgtgccccgagttcccgaacttgtaaggtgctgtggaaaccactctcgccgacccccgccaggctgggaaggggtagctgcgggagtcgcacccgcagagggagcgcttccggctggcgggcgcggccggggcccgggagggcgcggtgcggcgagggcagagagctgcgggagaaccctgggatcccgcg

SEQ ID NO: 5410 - DNA, 1225 bp, Homo sapiens
  source 1..1225: mol_type = unassigned DNA
gcggaagtcgctccggatcatgcatggaaggctaattgaaaagatcagtcggggcgcttgtggcagccttgtcactttgtgacagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcgcgggtgggggccggagcctcaactcgatgagaagtgacaggcgtttgggggatctgggctccggccgggaccagcgcaagcagggactttgcggggacaccgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggccgcagcgacaaacgctcagggctgcgcgccctggctggggcccgcccgagagacagcctgcggctggggagtctgagctccaaggggagagcccagccgccgaaggcgagcctaccggccaagccctggggtccggcaggttctgcacaactactcccgcaaagctcgccacctttgtgccctttcctcagctacgcgcttaccagccccggaagcaccagggggcgaccggcg

SEQ ID NO: 5411 - DNA, 1627 bp, Homo sapiens
  source 1..1627: mol_type = unassigned DNA
gcgcagcagagcgccggagaggagggacgcggaggccaccgaggggtcagcagggccgcggcgccagggtgggggcctccaggcggcgctggccacggttcacccgcgagggcgagcgcgcccggccggccgcgcctcctgccgtccgtgcccgggggtgggacccgcgccgggagctgccgagtgcgtggagggagccaggctccggctcgcctgatggattgacttggagatggatcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtaagaccgttttcaacaatttgctaatgctcttgtggcgcccggtgggggtcggaacctgagatcccgaatcgctgtgtgtgtgtgtgtgtgtgtgtgtgtgcgcgcggtgggggtcggaacctgagatcccgaatcgctgtgtgtgtgtgtgtgtgtgtgtgtgtgtgtgtgtgtgtgtgtgtgttgccactggacagttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgcgtcctggagaaggggcgcagcgccgcagttgaggccggagcagcccctcgcgggcgtaggatacctgtcagtgagcgcccggattgcacggcccccgggtagtgcctgccggcgaggggcgggagctcgggtgacttggccatccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccg

SEQ ID NO: 5412 - DNA, 1857 bp, Homo sapiens
  source 1..1857: mol_type = unassigned DNA
ccgcgctgcctaggcaaagggacccggcgaccaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgcctctccctctcggaaggagccatcgccgctttaagtggaagaggagaggaagggggcgggggagcggggggcggggagcggaggcggaggagggggagggggatccccctggctcccacgtggtccgggcgcctgtgaatcgcgcccaccggagggtctcacagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccg

SEQ ID NO: 5413 - DNA, 2423 bp, Homo sapiens
  source 1..2423: mol_type = unassigned DNA
gcgcgcgcgcgcctgcggaggggggtggcaaggatccagaaggggagcccaccccttcttccgagctcagctctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcggggggcgggcggcgccggggaaggggccgttactttcccagagcggcggggcgacgtcaggcggaagggcgcggggcgcgcacgctttaaatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacagtgcagttttccaggctcttgactttttgcaccttcggggtccaggctcccaagactcggggaggtgggggaggaggtggcagggggatgtcggaccagggagccgggagtggagctacctccacaagcttcggtcaccggaacgaggttgcgccaccggtgcgcgggtcggttgcctgcctccccaagtggatccacccccggtccagtgtgctcctgcgtccctggtctattccccatcgccggcatccgggctgaagtgaagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagagtgggctggaggccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccg

SEQ ID NO: 5414 - DNA, 1146 bp, Homo sapiens
  source 1..1146: mol_type = unassigned DNA
tcgccgcaggactcacgctgaccacgcccaagccggccccgcccactcgccccgcccaccgccaaccccacgcgccctcgcccggacacgcgtccccgcagccctggagcgctcgcacccactcacaagccctcgtgcccagcccccgtgcctcaggagcccacacacactccgacccccacgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcagagccgcgggcgcatggggcgggagggggccgggcgctccccgcgctgagcggggctcccttgcaggctcacagtgccatgggcccggccgcggggcgaggcgcgcagaggcccagatgccg

SEQ ID NO: 5415 - DNA, 577 bp, Homo sapiens
  source 1..577: mol_type = unassigned DNA
gcgggcacagtcggcccttgacggcgcccaaggccccgcccgtgcggcgctgcccattccccatcaccagagatcggttcgtccagcgggcaggccccatcccaatgttaggtcaaagctcctatcccttggacccgggcctggcgcccccgcccccggcgcgtcctcacccggcggacgcggccgcgcacaaggcccagcacggcccgcgtccccgcagcccggccgcggttgaacatctccagcgcgaagcgggtgggcgccagcagctccggggacggcggcccccaggcctgaaagctggcggctcggggctgggcgggggcggccactgcgcccgggagcagccccagcagcgacaggagctgcagccagggcgccatggcgagggcgaagccggcggcccggacccaacagacgctccaccgacccaccgggtaccgagcccgcggccagcggggcctgagtcctccctccagcggggcgacggcacgccgaccaatgggcgctggtttgcggcgcctgcgcgttctcttgtttacaggaggcacgtggggcgcgcagggtagggagagcg

SEQ ID NO: 5416 - DNA, 1721 bp, Homo sapiens
  source 1..1721: mol_type = unassigned DNA
acgaagaaccggctggccacgccgaagatgctcaccacgccccgctccacgggcgagagctccagcaggcctgggggcggggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctgcgctagctcagattagcttgcctgtgtaggggacccccggcggccgcacccagtcccggaccttcagacgcgagcccgaccccagcggttccccagcctgggccaggccggggcgcgtgtctcgggccccctgtggctgcaccgcgcgccctgtgcccacgggcgaaggcgctggaattcggcgctcggagcccgagtttctgaaggcgggaggcggcgcccgacctcaggggttgcgctgggctgccggagccaagagtgtctgcgtccccagccccgcgtcagaagggaccggagcccgagtccgccccggttcccggggcccccgagcaggtgcccgccgagggtctcagagtgtgactgagcgggttggcccggcggccgttgccccccgcccccgccccttcgcgcctggccgcgccactcactgtcgcgggtgtccgcgtgcgcgccgccgatgcggccgtcggggagcgcctggaggtggaagccgatgcccacgttgcagtagagccgccgcagccgcttgatgcccagcaggtagtcgccggcgccgctctggacggccgcctccttgggctgcgctgccaccggcaggcgcgccaacgagagcgccaccaggctctcccagcggcgctccagctcggcctccagcgtgccgttgggtgcagtgggtgcggcggcgccccctcggcccgcccagggcgccagcaaggccagcaggaccgccgggagcagcgctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggcccgcccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacg

SEQ ID NO: 5417 - DNA, 1721 bp, Homo sapiens; identical to SEQ ID NO: 5416
  source 1..1721: mol_type = unassigned DNA

SEQ ID NO: 5418 - DNA, 615 bp, Homo sapiens
  source 1..615: mol_type = unassigned DNA
ccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccgggacggacgctccaggcgcggcgccgagtggaggcgagggggctgcggagggggaaggggccacgcgggccacggggtttaacccctgactccccgcgacgccaagaatgcaggagggcagagttgagggagacctcaggtggaactttcaggtggggaaggctgagctgtcggggctgcgggtaccgggaaggctcagggtaaggcgctcggcggtgcgtgcccggaactccg

SEQ ID NO: 5419 - DNA, 1542 bp, Homo sapiens
  source 1..1542: mol_type = unassigned DNA
acggaggcgcggcgctctccacagccgtctctaatgaagggaagcgtgcctcgaagtcagtcccggtgcgccccctcctcccccggcgccccttcccaaaccccgtcggatctccaaaggctggaataggcggtgcggctgtagcccgcgctgtaatcgtaggacacctgatggggcggcggcggcgggggcagggcgcagtctggaaagaagggggcgaaagaggccaaatggccccgcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccg

SEQ ID NO: 5420 - DNA, 1542 bp, Homo sapiens; identical to SEQ ID NO: 5419
  source 1..1542: mol_type = unassigned DNA

SEQ ID NO: 5421 - DNA, 1768 bp, Homo sapiens
  source 1..1768: mol_type = unassigned DNA
gcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcgccgcctgcgcgtggcgcagttaatttgggtaagggaagaccgtttggtccacagctggctggaaagcccaggcccccggcggcagcagccccggccgatccctcggcctcccgggccccgccagaagagcgcggcgcaaagtacccatatccccagcggtcctaagccccgggcgagctctctgggtttattttttttagcggcacgaattgcgcgcgatgcgcgctctgaacgccccactcctcagcctgccctctccgccaggctggaagccagccgcgccgtccccgccgactccgggcgatgccaccgccccccgaacatctgacgcggagcccggcaccaagagccccgggccaggaagctgtcaggcaggggagggccagcgccagctgtggacgttccgggacagcccctcaccccagtccctgtccctgccctcggcgcggcgcaaacgcaaaagcctccgtggccgcagctccagccccggtggccgcccgacccccgtcgggaccccggctgcacccactggagaagcggcggctccgactcccgaggaggcggcggcggctgctcccagtcgtggccgctacagccactgctcggctccgctcgcagctgtcccagctgtggctcctgtccgcttgtggcacccacagtctctgccgcggctcccgcagccccctcctttccccacctcttcaagtatcgtccgcgcagcggtttctcgcgagagaaatactttttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgggaagaggtggagtagcggttttagcccgctctgcggctgcgaggtttagatccgagattaacctctcccgcgataggtgaagccctaccggagcagaaagctgttccacctgcaccaagaatgcgcgctggagacggttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctgtgccgaccgaggagagggctctgccgcccccacttgccctgggtgtcgagagcccactccagacgcg

SEQ ID NO: 5422 - DNA, 2656 bp, Homo sapiens
  source 1..2656: mol_type = unassigned DNA
acgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggaggagactgcgagagacaagcgcgagggggagactggagaggggcttggccgtgcgtcggcgtcggctgtgatggggagcccggagcagccaggcggcgagcagtagcggcggcggctgcagctcggagcagacaggagagccggcgctcctccccgcaggctgcgctgtgaactggcctgcggattgggatctcgcgcctcccgtccctctcctcccgctgctgttctcttcatctcggctcccctcctccgcttgcgaacccccggcggcggcggcggcggcgtcccgagcgcagagcgcttctgctcgcggcctcagtcccggctagcgcgcggtgggcgctgcggcggcagcagccgggggaccggctcgcccggagcaagagcgccgagcaccgggtgaagaagaccacgggggaggcgcctcgtagagccgtggatcgccagcggaggcaagggtgcgtggggatttgtagcgtgatgatttggctgcctggtgcaccgactggagcgcgcctgccggagcacagcctcagctgctgggtgcaaatgggctgcgaggtgggctggggaggcgagagccgacgaagcgcgtgggggaaacttttcaccttgtaaagttccaacctccgcgcagccccgagccgccgttgctaccgctgcaaacaggagaagagggtggcttggccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccagctccgagctcaggccccactcccgggcggttcgggacgaatcccctctacaggccagtgtgtgtgcagggcaagtgtagggggctgaggggcgctggcggggaggcagtagaggtggcctggaccatcttggcgcggcgcgcggtgagcgcgaggattccgccagtgggagtcgctgagctaaagtgcatctggccccccggcttgcatgatggcgagcccggatatttttagctgtgctgtgatctgaattccctcctctcctctctcgttgacttttgtcacatgtgctttccgagatggtttaacattgaacatgattgggctttgcggaaagcaacttttattcactttccaccgttctcctcttgtgggcggggggtggcgggggcgtgcttggggcaaggatgcaggggtggccggagtttggctgcgagctaagagagccgcttgggttgctcgggatgagaggaacaggggtgctcccggggtgtgggtgtgctggcggtgacatcctgaggctgcagctcgctggaataatgggctcaaaccaggcggtggagaggggtccccggaatggacgtcgggggcggggaggctgcggagaccctgcgaggtctccgtgaaggactaggaggggctcccgggagggagtggcgcctgcggcccggagcgtgggcggccggtggctctggcacgcggaatctggtggactcctagcgcctcggccgggagctccagctccatcccgccgccgccgcgcgcccaatgggactcagcttcgggtttgggcgaacctgcagcagccgcggcgggagggagggacgctgggaccgcggtaatgattgaagtctttttcccccctctcccctcctcccgctcctctccgcccccagactctggcgcgtttgttttccaagttggatcccacttccatttacaagtgtcagacaaacccgcgagaacctcccccaacccgccccggccccagccagactagggagggcgcccagggggagggggcgagctgtctgggcagtgcctggggaggtgcgacgcgcccacccggggcttgagcggctggggttcctgtgcg

SEQ ID NO: 5423 - DNA, 623 bp, Homo sapiens
  source 1..623: mol_type = unassigned DNA
gcgccgtagcgcctcctgcccacaaagttctgccagtcggagaaggtgtagttgttccaagagaagaagtgcgaggcattgggcacggccagggccgcctccgcgctctgctcgtcggcccggccctcgtggggctcggtggctcgcaccaaggggaggagacagagcagcaagaggtgagggaccattttgcaggagccacccctcccctgggagcctgcgggccgggcgtcccctcccgctgggatcggagcgcgcagccggggtgcggggcgcacagcatacaaggccgtcccgaggagccagggagcccggacgcgcggagcaccgcgccgcccgccaccagcccgcggtcggcacgccagctccgggtttgttggagcacttttatatctctgctcccaccaggctgctagggagcgcctctgcctattgggcagcgcggcgtctctcgcggcgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcg

SEQ ID NO: 5424 - DNA, 1967 bp, Homo sapiens
  source 1..1967: mol_type = unassigned DNA
gcgcgtcgcccttgctgcccagccgaaccccgctccctccagggctgcgctgcacggggctgcctccccgagccgccagcgcccggcgcccctccggcgcgtccgcccttcccactttgtgcgcccgcggcggtgggagcagagccggccggctcctggggactcagcggccgcgctggtgatgggcagcgctccttccccaaaggcgggcggcggggcgggggaggtcgcggctcgggtggtgccgccgcacgggctcggattccgagggggaagtggcttgtcagccccggctccgggaagagtgaacaataaggctagggcagccgccccagatcgttatattcctgggtctaataaagtcaggatcgctgctttgcttcccccgccccagaagaataacggtttgcaaaatggggcaaaatgggcagaatcgcacggccgttgttgttggtgtgaccgttgttgcaccccagtcgacatgacgttagtttttcatttgccaaattgctggttagttgcaaagcctaccctcggccgcgagcactgaaggatgggagggtcgagcgccgcgttttgacaggaggaagtgcggaggggcggagggcgaggagggcgtgattggggctgcctggtgtgtgcgcgcgcgtgtgcgcgcgtgtgtctttacacgcgccgcgtgcccagtgttgcacggggcgggagaagaatggcaggtagccgcccgaaacacctcgccctgtctcctttctttgggcgaggttcccgatcctggcaaagtgtgaacaatagggagctgggaggaagacagtagtgatgctgccgcgggtggcgggggttgcgccgccgcccagagaacctcggcagtgtgcagggaggtgcatttcattttggctatttccatcccggcctccctggaaaattcttctgtgcgtgcccaccctcccctccagctgtcatccccccacctccacccaaggatttgcgctttggctctgatggacgggagggaaggaagaaaagcaggggccgcagagagctgggtgggttgggcggacattctgggcggggggcgtgtgctgggaagcgatcgaggaaagccgggcggaggggctgtgtgtcgcggtcgcagctccaggtaccgttgtacctgccctggacggccgacccccggttggggagcgcacggggcgggccagggagcacccagtgcgccccctccgcgggcggcacaagagcagcgctcggccgccgcctccagccaactcgggtccctcccacggcgaccaatcagtgcgaagctggctgggcgggaagccgcgagaggcttttattgcggcgcgggtggcggccaggagctgccaggacagtctcccggtgcttcagcctaacggtctcgctcactcaccgccaagagaaaccccgccctgcggccggtcccccgcctgcccggcagtttccgaggaaataaaatggagactaggtggtcaccgggagtgctcctggtccggccgcccgtgctcgcccactctcgcctctttcacgccgacttggagcatcccaccgcccccgccagcgctcactctcgcgccgcggaatccgggcctgagcgcgtcgccggggagggcatcctggcaggcacacctacgcgcgtgcgctgaccggccgaccgcgggccgggggctctactgacggcggggcggggccgtggcagggcccggagaggaggggtggggaccaagcctagtccgcctggccctgggtctccgctgccacctgggcgggggccaccccggttatgcccctttccgcggtgcccgtgggtgccgcgacgcgacctgtccacatggggcgggggaaggggggtgtttttgagacatcctcgcccccgggtgggagcgtgacaatggagcccggatatttggtgggccttttgggggatcgcctggcggtcctttccatcatcg

SEQ ID NO: 5425 - DNA, 2558 bp, Homo sapiens
  source 1..2558: mol_type = unassigned DNA
tcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggaggatgagagggccgggtttgggctaggaaagcggccttttaaaacagatgtcagggggactgcagccccgagccatgagaaaaaagttaaaggcgagatgacacgcactgaattggggcaaacattggaagaggagacaaaactgcgtgcttgagcaccggggtgcggggagggggggacaaaacccgtatccagtgcaaattaaaatcttgggagtaggtgggggctgctgcgcgcccttcaccctcagttcccctattaaggattctgagtccccatgcactcctgtcctctggctccttccttcctctccgctcggccggtgagaggcggccgccggcgccccagcagcagctagatgtcaggcgaagcccggagcgcggagcgcggggaagggaggggaagggaggggaggggaaaggaggggtggggcggggagcgcgcgcgggctcggccagtgcggggtggtgggcgggctgagcccggggacggcgcgggaggggggagggaaggggggcagctgtgggcagggagccgggctcggccgccagcactaaagatggagaggcgccggggccttgcaggggagggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgccttttttatttggcgtgttcccttcctgccgctgcagccgtcgccgccaccggttgggggtcggctagaagggggagccccggctgtcagcctgggcgcagctgcctccccagcccttcctcttcagggcacggtcggggtgagaggtggggggcgtagcggtgtgcgggggctgagggcgtgagcagaggggtcggggatccggaggctttgtaccgccaggggctggcggagcaacagagcccgtgggtgctcttatgtatgcggaccggtgcgcgggcgcaagataaggttgtggtttatttatttgtgtgtttattcgccggccggctgggaagctagaatcggaggagctgacgagtagatctgggggcggaggggagcaggactgggactgcttacgttttgtttctctttgagaaaacgtggtgggctttttcttgattggacttgatccccaccccccttttgcaggggagggagggaagctccagagggtctgcagcgctgcgggccctcctcggctctcggcgggaccggcggtgacaccggagctcgccgtgcgctcccggccgctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgctctcgccgcggagtccagcccgcccggactgtcgccgttcctccccgtctctttcgctttccctcgtccctagctcagctctccttctttcaggagtctagctcctcgggaaaagttgcttccccaagtttgctgaagtcgtctccaagtctcggtgggggtcgctgggaactgggggggtgtgagagcgcggtcgatccccggagctcgggcgggttatcgccggctcttccccgcgccgcctggctggacgctgcagccagcgccagccggatcgcgggcgccgagcggcgggtgggggagacggctgcccgtgggcgcccagatttccctcaggacccaaaaggcttgtttcagggcgccaagcttccattcttttggctgttccctcctagttctcagaaaccccgatgtctgcgggaaagcacgcggtggctcggctcggctgaatgctcatcccaaccttgacggcctccgtccccaccccggggcg

SEQ ID NO: 5426 - DNA, 2558 bp, Homo sapiens; identical to SEQ ID NO: 5425
  source 1..2558: mol_type = unassigned DNA

SEQ ID NO: 5427 - DNA, 1508 bp, Homo sapiens
  source 1..1508: mol_type = unassigned DNA
ccgccccggggcgagaaggagaaaagttagagggctgaacaggtgacgctgagcttgttggagcgtgtgtgctccaccacgcaagggcgcggagttcggccgcctcatctcccgccatctgcgcgcccgggggcacgtcctctgcgatagcctggaacccagactacctgcgcctgcctggtcccgactcagtgcccaggtggcttcagtcggaaatgtctgccctcttccaacctcccgatcccggctgcctcgcggatcaggtacgcagcgccccagccgcaggtctggacatgccggacacctggacccacccctagcaaccccctctctccgggaagagggacacgccccccagcctgaagacttgtccccaggtccaactggccaggcgcggaagcggagaatctcgcatcttggggcgcgctgcccgaggtggccacggtggcgcaccaagccggggctaaagccggggcagaggggtggggtagggccgggggagggtgacctctgggtttggagaacaaacttgctatccgagggacctccagctctcgggactctcactatccccaccctgcctccagccaatgcgcggataagcgccatgcggtgcgccaacattcgcgccagggctggggtccgcggcgggagagggacgcacggacatagcggaggaatcagccgccgagtccgaggcctgaataagcaaggactcctaggtcaagagtcacggcctgaggacccctcgactcggagggcactccggggtcccagtgccaccaagccgcaggaagagggcaaggggctgggggaggggtccagggcagaactgccgccgtgcagggagcagggagatgaggggctcctttgccaccacccctacgggcgcgccccaaaacggcagacgcgggtggctggcggagcggtcgggggctgactctcactcggcccctgtcagggtgcctgcccctccccgctgcgccccacccggggccttgcaccccggtcggttcccccacgcacctggagcccgccgggcaccccgcctcgccgccagccgcgccaccctggccccgccgcctccgccgcccagccgcccgcgcaggtctcacctttgtgtaaagagtccaggagcaggaggaaagttaccagccacatgccataaagaggccctattctccggggaggtggtcctgtggccggccgtgcggcagcgcctctcccccgctcagcgcgctcccagccgcccgcactcggcgccccgctctctctgctcctcagcccagcgctcggctgcggcggcggctcctccctcctcggctccccggctcctgtcatccgcggggctgggctaggcggccgctctccccgcccccccgcggcaccccgggtggtgagcgccgcgcgagcccggagcccagacggaccccagccccacaagcccaggaacaggagcggcggcccgggccagaccgccccgacccggctccgctgtctgagaggcg

SEQ ID NO: 5428 - DNA, 1119 bp, Homo sapiens
  source 1..1119: mol_type = unassigned DNA
ccgggcgcgcaggcggcggctagcgctggagccccagccagctccctctccccacgtgcgcgctaggccttggttactctggcaactcgccccgctcagacggcaccaggcagctgaatccagccccttgttacgggggaaaatgctctcattgaagcgccggagcgcagcttctgccttttattgcaagcggcgccaccggattccatttgtaaacttattagtgtgcgctcgcggggagggggctcgggaatccgggcccgggcaaccggcgccgcatgctaatcagggggcgcccgcccccgctttgcccgtggccctcctttcccgattccccgacgtttcgggaggagtggggtcggagcgcagggctgggaagggtcttaggacccaggaaggagacgggtgcctcccagagaggaccccatcccctccgaggtccgggcggctcccggcctctccctggggtgccgtagcccccctcgacccgccttcccgcagccgcagtcgttcgggcctggaggtggccgggcatcggtgccgacgccgcgagggcagcgcccgcggcgggaatactaatgcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctctcctgccagcgcgcccagctgtcccggccgccgccacgcgggactgcctgccatgtcgccaccg

SEQ ID NO: 5429 - DNA, 1119 bp, Homo sapiens; identical to SEQ ID NO: 5428
  source 1..1119: mol_type = unassigned DNA

SEQ ID NO: 5430 - DNA, 653 bp, Homo sapiens
  source 1..653: mol_type = unassigned DNA
gcggagaagccaggagcgatgaggggcggggcggctcccggcgccctcttttccagccccgctcccgcgctgccgccggagagggactcggggcgcagccgccccgcctctgccggggccccaggaggaatctaagaaaagagagatggagggaggaaatggcatcgcttcaggaaggggcaggacctccaggaccgaaggcgttttctttctctttcctttcagcgacactgggaaacaaagctccgcggctgaaaagaacaccacgcgcggccaggacccgagcagggccctggggcgctaagggcggggaaaatagggcatccggagtgcaggagattcctcagggccgcccccttctccgggggtgccctgaggaaccgcggcggggactcgccgctggcagcctgcgggtcctggtgccagcgcgcatgggcgggctgtgcggacgtggctggtcctccaaaggtttcagatcccgtccgggccgctcagtcccttaaagctgtgtcccaaagcctaggggagacagcgaggctggggacgccgggaagtttctctgaggtgtggggctcctgagcagaaacgcgcgggggattgccagggctgcagaaactttggctcgaggcggtggctggcccgccttacttccg

SEQ ID NO: 5431 - DNA, 1768 bp, Homo sapiens; identical to SEQ ID NO: 5421
  source 1..1768: mol_type = unassigned DNA

SEQ ID NO: 5432 - DNA, 1101 bp, Homo sapiens
  source 1..1101: mol_type = unassigned DNA
gcgccaagccggctccccaacctggtctgctgaacgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcagggtgaggggcttcatgttgcacgacacgtttacgtggggctttacgctgcattccatctcccttgatcctcgcagcg

SEQ ID NO: 5433 - DNA, 1101 bp, Homo sapiens; identical to SEQ ID NO: 5432
  source 1..1101: mol_type = unassigned DNA

SEQ ID NO: 5434 - DNA, 2341 bp, Homo sapiens
  source 1..2341: mol_type = unassigned DNA
gcgtggtccggagagcgtggacaaggtaacctgttttggatgtccgggagaagggagtccggccgaaagggcccagcccctcgaggctgctccaactggggcgcgcggcggcccaggagggaggcggggaggtctccgggttgggccggggaacgccggcctccaggctgggtagggaggacggtccagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcggcagcggagggcctgagtggaaaaattcttattggatgcactttttaatggttggtttgcctcggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccccaaagtggagccccggcccccctcccacctcgctgcccgccggggctgcaggaggggacggcgggaaaccgggggaccccagggtacggaacggagtcaagggcgagagacctcggggtccaccactcccaccgacacccggggctcccgtggccccagcgctaggcactgggcttcctctccgcagaggcggaacacggcgggggcgggggctgcagtcgcccgggctcgggtccctgcctggtgggccctggggtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagcccccgtccgcacagatccctagcgccccgagcccccgcccttcgcgcctaggcgtgcgccggctccaggaccagggctcctggagctgtcgcctccgaaagggtcctgcgtccttcggagccgcctccgttgcaggggccg

SEQ ID NO: 5435 - DNA, 3857 bp, Homo sapiens
  source 1..3857: mol_type = unassigned DNA
gcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctctcccagccccttcccccacgtgtggatgacgtcaaaattccgcgaaaaagccgcgtggtggctccccgagcggaggcgcgattccgccgcccagcggccccctcccgggggcgcctggagggggagaagggcggaggcggccggttccttctcctcccgggaggcaggaccccccgacgccgaccgccggacgccccccgccccaaagcttattggaaaattcacttttgtaaagcaaatgtatttccagagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctccactctttgggggagccgaggggaaggcagtggctcccatttctgagcctgaactcagtcactacccgctccccacctggcctaggcgcccctgcgcggagaaggcgggactcgaactcgcgctgctcccgggccttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatcaccagtcctacatgggatatatatatatgtatttttttttccgtgaagggtgaaaaggagataaggaagaaccaacaatctaccccctcccgccgccccccacccccgcgccacggtgatcagtttggacttcaaagccagagcacaggctcttgcgctttttcttgaaaccgaagtctacactgaaagaaagtgtgcacttttgcctagaaggcaacatgcgttttcccgcgtgctaggtggagtgcattttaacaagacattagggttttaacacatggctggagtggcgaccaaaagggaaaactcagtttccagtccaagcctcctagagacattcctgccaacctccgcaccctctcacgccccaccccacgtgtgagagtctgcaaaaccaccggggattggattcgatggcgagcttcacgctcgggaacagtcagtaatcggaaggggaagtggacaggggaacttcaagaggcgagcctgccacgcgggaagcgcccgaacttgcgggtctccatgaatgcagagggcgccgggaagggggggcatccggccgcgaccctctctgcccctcccattcgctgcccccctccccgctggaatttctctgtaaagcaagacggagtagggggagggggagagggaaggggcgagagggccctcggctcactcccgagacgtgaggactcgccacccaggcattctcctcggggtgggctgggccccgggacgaccacccgcttcttcctcgcccccgctgcccccacttcgggagacccagagctctggatgcctttccccggagaagggggggtgtgcggagtcggggtggaagagaccttgctcgcagagctatatcaagtgatgtccagaggctgggagccccggcggcctctgtcccttgcctgtcgggttagatttatactttaaaaatacctcccgccctccctccttctctcgcctctccccgctgcaactttctttgatccgctcaaaggtggcttaggtgaaattggagtaattcccttatgggggtcttaaaatgtaagtgaatgtccttatccggggtgactcaaaagcttaagtcgggaagcccaacgtgactaaaaccaataggtgattgttcggggccgactgtgtgcgggtgtacacggtattcggcccgggtgtcatccgcggcgctggactgtttcattttgagtttgcaacttgggtttttcagcgagctttttttcttcctgaaagctaatggcttccacagcaattagacattttcctcgcccgccccttccctcccctttctttacatataggagatgggatactcattcccgctgctattgataaggtcggaggcggccgggcctctccccagctttcgcccgccccagcgcccgctctccctccgccctcccttggcttccttttgatgtagtggggaacgcgtcctactaaaaaaaaaaaaaaaaaaaaaaaaaaaaagtaatctgcccggtaacaatcagcgcgcagtagcaggagccccagagctattggctatgcaaatagagggaggggagacggcgccccaaactcttcctcacccttttaaagcgatatcccctcctttcccccccaccaccccttccgccccaccctcgtttaaagaggctggctccggggcctgagttaatcgcttgcacctctagtttattcgctcccctcctccgccttgcagggaacctagtgtacggctcacccagcccgcgccccaccccgccttgctggctctccgcgcccctgcccgggccccctctctcggtgagggaggcactcagtcggcctcggtgtgcccagagagctcgagccacgccatgcccgctgcacgtgccagcttggccagcacatcagggcgctggtctctccccttcctcctggagtgaaatacaccaaagggcgcggtgggggtggggggtgacgggaggaaggaggtgaagaaacgccaccagatcgtatctcctgtaaagacagccttgactcaagcatgcgttagagcacgtgtcagggccgaccgtgctggcggcgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcg

SEQ ID NO: 5436 - DNA, 1439 bp, Homo sapiens
  source 1..1439: mol_type = unassigned DNA
tcgccaccaccgccacccctccggaaccctctgggtccgcgctagtcccacttggtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtccgagggacgggcggagggtagaggaggcagcggcggctagcgcgaggtgagggactcacttgaaggtgaggacgcagagcggccggtaggacttgtggctggtgttctcggccatgcccttgccccagaagtcgttggtgaagatgccccagcggagcggggcgccgggccgcacgtcggggttgttcacgatcgcccacacgtcgtcgtgcacgaactcgccctgcagggagcggccgtagcacaggcagcttgccccggccagcagcgccgcggccccggccggcgctagcccgcagccccgccgccgggagggtgtgcggtccccgccgccgcctcgggcagaggtggtcaccaccatcgcgccgccgccgccgctgctgccctggcctctcccgggcgtctggcatcctcccctaccggggccccggcggcgcgcggcgtctgcccggaggggggctcgggcatggtgctgcggcagctggacccgccgcgagctccccgcgctccgccgccgcctgcgccgcggagttggcccagctgcaaataaacagcagtccccccgcctcccccggccatcgccacctcctccgccccactgcgcatgcccgctcgctctctcttccaccgccccccaatcccgggacgcgggccggttcccccgcacagcccggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgcgctcgcgtccagtcgccggctctgtgctctcctgcccgggctttctctcacccgcccggcgcggcgtcccgcttggcggaggaacccgcg

SEQ ID NO: 5437 - DNA, 1288 bp, Homo sapiens
  source 1..1288: mol_type = unassigned DNA
ccgacaggttgcagccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggaggcgtgggagaacgcggagaggcgcggcgaggctgggagcgggagacggcgccgggaggcgggaagcggaccagagaatgggagaagcccggcaggtggacaggaggaaacaaaacccaaacgccccaccctcgaagtcgtcaggagctgagcgaaggaaggagcgaggtaggaaagcgtggcgccccaaatatgccgcgggagcggcgcgggaggcgcagaaccccggagcttgcagcctagcgcgcggggtcccagcggagcgcgaggacgcgagcggagccctcccggttacctgtgctgcttccgccctggctgcccctgtcccgagggaagatgcccgagcacttctcccactccacctggccggcgaagcacagctcggtgacgatgtgcagagccttctggcacagactgttcactccgtcctccttgtggaaactcatcgtttggcttttctttcgttttctctttttttcccagttagccgtcttttcctcttcccgtacctctaacccctctggcgccctaagccatagtccgcccgcggtgactttggctggagattgcgccgctgagagccggcaactcttaggagccccacgttggccccatggcgggagcggagggcgtaggggaaggagaggcgcgcgaggaggctgcggctgccgcgaggtttgcgccaactctcccgccgcgcgagcgagccgaggcgcgctggaactagagacccggcatggagtgctgaggggaggggggagccgtaaaaaagccaaagcaagccctcgactcgcaagcacgcccccctcctctccccagcgcactggtgtttctggcgggtgcctggcggcgacgcgtccaatcgcagcccggcgcgggcgctaggtgacaggcggcggagcgcgcagacccggctccccgcgtcctctgaagaagggactcgcgagggagggagggagggagggcgggcggcccggcgcccctgccgaggccggggatgctcatcgttgcccagagttggcccgaggagccctctccg

SEQ ID NO: 5438 - DNA, 1006 bp, Homo sapiens
  source 1..1006: mol_type = unassigned DNA
gcgcgtgaagaacttagaccctccaatgcgcacatcattcccacacgcagggccgaggcggcagcgcggcccggagggggcccggagggaggggtcggactcgccccggcgcggctccgtcggggaattagctcccgagccgaataaaagcagccaaagactcgcacacccggtagaaggggggcggccccaagaaagcccgggctggggcggccccgcacccccccgtcttccccgccgcccgaacctgttgtaaaggcagagacaatggagaaagctccgggagacgcgcggagagactgctcctccggggagggaggggcgggccgggggaggcggggtaaggaggagggaggggccgccgagggcgaggccggcgctcagcgtcggtctcccgcacggtctcctggatgccaaacccggtctagggagcccaggagccgttgcagcctcagctcttctccctccctctctcgatgacccgggcaatgccaacctcctttcgggattgaaagctctaaatccaaggtgctaagttgatgggcggtctttgctctcacccctcgatttcgggcgcgtgtcttgaaagacaggagagaaaaaagaccacccagctgcaggaggcaaggctggagcgagtagcgctcgcctgccctttaagcaaaggagggaagcccatgtgcactcgtgcactgggctccggagcagccccggggtgcagggcactccccctccagggcgtgcggaggaaggccaccaaaacacgctgcactgccgaggtggagctgggcaaagtaggtagagactggtggggacggatggcgagcctgggaagccccgggtgtcctggtggagaggttccctgccgggggcggggcgctggagagcttccccggcgcggagagcttcccgggcgcggagagcgcagagaacttggccaggaggtgctggacagctccggaacccgcgcgccccctgccaaataaagcgtggagacccggactcg

SEQ ID NO: 5439 - DNA, 1185 bp, Homo sapiens
  source 1..1185: mol_type = unassigned DNA
ccggctctccctgggcgcagtgcgcaccgccggcgctcccagatccctggaccacccggcctgggggcgcgggcgcggctggggagggaggggagagctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccggcgtgggctgcgaccgcgctggggagcatagtgcggcgccaaccggtctgctgcgcgcccgccttgcgcccgcctgtcgcccgggcgccccgcaccgcacccagagccgcagcttctcgccgccgcctcccgcagggctggagcgcgcggagccaggcagggaggaaaggccacccgggacggcggcggacttggaacgatattatttatttgcgttgggcgtttttttaagggatgggaggagtgagtgtgggagggggaagctgtgagtttctctggccgacagcgtaggctctgggagcgcaggggggagtctttccccctctctatgcagatctggacgggttttttttttgttttttgtttttttctggacggacggaaggtgtgtccagcccatccattcatgtcaccagccccacaaagtgacagacgcggccaacaataagggtagtgctgtggcaaggggaggggactcgtagtgggaggaggtgggcgtggaggcgacgtgaatcgggcgcgctcgccacctccccgctgccgtgcagagccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccg

SEQ ID NO: 5440 - DNA, 409 bp, Homo sapiens
  source 1..409: mol_type = unassigned DNA
ccgtctctcggggaaggggtccctgaggcccgggtggccgcttgggtaaccgcagcctgcctgcgtctcttccttcctccgcgtgggttctagcaacatccactgcagccgggccaggcgagccggcgcgtaccatcggcgcggggggaggagagggccgggcctgggaagatgctgcggaggacgctgcggattcgcgagcccggggtaaggcggcggcgcaccgccccctcccgccgcttcccccccaccccgccccccaccgccgcccttagccctcccccgggatgagagagagtcgcgctgcggagcaaccccagtggatgggtccgcgggggctgagcgggcggaggacgcgggaactccgtgacaccgaccagctgacgctgcccgcgtgaaaccagagccg

SEQ ID NO: 5441 - DNA, 1813 bp, Homo sapiens
  source 1..1813: mol_type = unassigned DNA
gcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgccggcccggcaggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctgggggctgggggcgggaccgggagggggtgttgggggaagcgacgcagcggctgggagattttgcaagggggtctgaagaggagtgggggatgggtatggaagggtgggggaccactgaggtgggatgcgagagtggaagggggacccagagggggcgcgatggccggaggagggggagatggacgatggggcggggcggcaccggtcgccgcgtcccttgccgccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggggcttgcaggtaaagcggggctggggccgtcctggccgtcagtggtcaggaagacgcagcgaccccg

SEQ ID NO: 5442 - DNA, 1294 bp, Homo sapiens
  source 1..1294: mol_type = unassigned DNA
acgctccctccggatgcgcgtggagcgccccacaggaccgccgccctctgcgcgttggcgcgcacacgccccccgccagcctgggcgccgggctccgaacccccggtctgcaaacttgcgcatctcccctcgccgcgcccgccagacaacttggcgaacagctcgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcaggcggctcgctcttgcgggcggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctatggtaccaaaaaaaaaaaaaaaaaaaaaaaaaaaaaaaaaaaaaaaaaaagaaggagaaggcgaccggcgaaagcaggagggaaaaagcaggcggcggcgggcgggcaagcaaaagcgcgagggagcgcgcggagtgtctgggtggacgtgtgtgtgcgcccgaaaggggacaagaggcgggtctggccacaggcagcgctagcgagagcttctccagccg

SEQ ID NO: 5443 - DNA, 939 bp, Homo sapiens
  source 1..939: mol_type = unassigned DNA
ccgatgccgagagtggttctgctggagaaccgccgcgcctgcagttcctgcaccttttcccggagctgcgccagggaattacggacgaactggaaggggccgagaagaaaggtcttggccaccacctctagctccaagccttttcgctctttcagactttggatcctccccggggaggacctccaggagccccttggcagtttcccgccgcctagggccgacttttccatctcctcctctacctccggctcccgggcgagggaggccccgcgccgccccttagactggctgcggccggaagattgcagccgctttgagcttactccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctccggtgcgcgcaggccccaagcccacatgcgcagtcctcaccttgcgcgcagccccatgtacagccccggacgggctcccagccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcg

SEQ ID NO: 5444 - DNA, 939 bp, Homo sapiens; identical to SEQ ID NO: 5443
  source 1..939: mol_type = unassigned DNA

SEQ ID NO: 5445 - DNA, 899 bp, Homo sapiens
  source 1..899: mol_type = unassigned DNA
ccgaacgcagttacgcgcccactggctccctgtctctggcgcttctgggcacgggggagctggggcggccccgcctgcgcacggcggtgccgggattgggggcgggcacgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggtgaggaccccagggctgcagatggggcgctgtaaagtagcgccggggctgcccgcgcttctgccttagcctgactccgtctaggccggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccg

SEQ ID NO: 5446 - DNA, 899 bp, Homo sapiens; identical to SEQ ID NO: 5445
  source 1..899: mol_type = unassigned DNA

SEQ ID NO: 5447 - DNA, 547 bp, Homo sapiens
  source 1..547: mol_type = unassigned DNA
acggtagacctcggagggggtgcccaggacagtgacggctgacatgaagctagcggtgagggacagcgccacgggcactgcggtcattctgcggccgcccatcaggaagtccttggaggtctgctggccgcccccagcgaaggcgtagtagatgccgatggcggccgagatgaccagcatgcccgcgaacaccacgtagtcccacaccacgaaggtgccgatgccccgtggcgtgtccatggccgcacggtcgcctgagccctgcgcgcaaactggtggccccgcggcgcgcagccggagcccggcgcgcacttcttatcccggatccctggcgcgcaggcgtggcgtcccgcggggactggaggcgtcctccaggtgtcggcctccgaacgcaccccgaggcggggtgagggctggcagtcgcccctgcacccgccgctgcgagccgcgcccctcaaacccaggtatgggacctcggaaaatcgacccgctgccctgagtgctcaccacgtgaggaactggagtggccgagttcgccaaggcgccg

SEQ ID NO: 5448 - DNA, 2505 bp, Homo sapiens
  source 1..2505: mol_type = unassigned DNA
tcgagttaacgcgccctagtggcaggtggcgaatggccggagatccggcctcccagtggtgtccaccgccacgggcctccgctcgacaggcttatttccctccatgctggagcaaaccccggctgaaagagggccgcactaattggtttgcgtacccgaagtgggaatagagagggaggaaaaccatgtttcaggtgttacggggggaaaaaagtgaaatgcgaaccgcaggggagagagcgaccgtcaggcagacaccttgtgaaccgcggtggagagcacacctaggtggggaggtcaccggcccaacccaccaccctccgggagaatgcgggcagggacagcagcagggggcagcatccacgtctctacgcttgcaagggttccccaagtccctggccactgctccccacttcctgcagcctcggtgtccgccgggggcgtgtgtgaggggcggggccgcatggggaggagggatttaaaaaaaaaaaaaaaaagcgaggtaattagcattctccgattccactggctctccgccgcccctgctttgcatacgcccgtcccactggctgcccggggtttgctggggttcggcaaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggtaagtgtctgcgcgggtgccactccctctcacctaacctggccaactcttggcgcaagtttgcctcgcgtccccctcccgcgtcttcccagccacgcgctgctgtcccaagccgctgaggaggcggccgggctggaggtagccagaacaagaggttgcctgtttgctcctgcactcgggtgcgcgtatttcacgctgctggtgctgtcccaggtccgggagcgcgaggttccgcccccggtgcggggcggggcg

SEQ ID NO: 5449 - DNA, 1587 bp, Homo sapiens
  source 1..1587: mol_type = unassigned DNA
gcgcgtctcgatagcccccaagatggccgccaatgtgggatcgatgtttcaatattggaagcgatttgatctacggcgactccaggttagtgcgggcagcgccggccgcgcggccgtgaggagcccccgggcgcgccctgggcgcattggggaggtccccgggcgggcaggcggacgccctggggcggcgggcggcggctgccggggctcgccggggctcggccgcccgctgcccatcgataggtattaggaattgatctcgccgctgctctttgttcggttcagtcatcgattagctgccgcgaccatggagaagcgctagtgagccctcggtcggcggagcggccgagcggccaggcggccgggcgaggagcggggaaggcaggggctacggcctcgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcgggcagggaggaggaggaggagaggaggaggaggaggagagaggaggagggagccggggttggcgaggaggcggctccgcgccccgccgctcgccggcacctcagccttcgccgcccgcctggctgcgcagcccggacgcgccgccacccgggggccgccgccgccgccgccagagccgccgccgccggactggccgcaagcgccggcagacctcttctcctcgggccggggtcttggggttcgtcttgcttcttgcctttacccccccgccccttccatccccttcccaagtctagatgcagacgggcggtggaggtgggcccgggcgctcgcaagtttgcgctcctgcctccagggcggtggagagccgggagcggcgcagagcaggtgactcccagccctcgggcccaagggaacttttaaatgagagatttccttgcttgttctgcctcctgcgtttctccccgctgctcccctcgtctcctctctcccgtctctgcttttcttctgtttctttcctctcttccctgctctttctctctccttccctagggcgactcttcgaaaccccatcactttctccccatcctccctttgtgggagtctgtgtgcctcccctagatttggaggtgttctctgcggaccccgtaggagccggggctgggaggtggaatctcagagaacgcaccgtggaggcgcggctccggcctctgttctttcccggagtgccccggacgcgcctggcaaggccccccagccttggagtctcgcaaagtctcggcgggtgcggcggggatcaggggcgggaaaatggtgcggataacagggcggttagagcatcctgccttgaccgtgacattcgcggaagacgcgagatcatcagtctggagataaaaagggacccacttttttttttttttttaatccgccggcaaatctcgttaagtttcttctgataagtggttccagcacccgcgccttctccccgtcctggccgcttcccagtccccgtccttccgaacgccccactcctcg

SEQ ID NO: 5450 - DNA, 5693 bp, Homo sapiens
  source 1..5693: mol_type = unassigned DNA
tcgcggttgctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtccgggtgcgagatcatgtcggtgaacctggggttgtccgcggcgtgcgggccggcgagcggcggttccagcgctcccagcggcgtcgagccggggccagaggccgccaggaagctggagtcggccggggactgcgcctgcgaaggcgggccgtgcgcgaagaagtcgtagttgcttcccggcgcgtagtagtcgccttggtagtctgcggagggggagcgggaaggagacagggcgcggtgagagaaggcgaagtaggcgggggacccgggacccggggaggggacccgggcgggcgagagaggggagcgcgcgacaccgacccaaggttagagagacctgcggaggccggcgccccttgagacggtggacgtcgcaggctcacggggagggttggggagagagacaatgagagatctcgaaagggcaagagactcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagtcgatgcgcccagagaacgcaagacggtggatcagagatgagtcccaggaacctccagagaagcggaggctgacaggcccggggagaggaaccgggcagggacaaaccagcggacagagcagagcgcgaaatggttgagaccgggaagcgacctggccgggggaaactggatccgggccgcggcaggagcgactggtgggttgggccgggcggggcggccttggcgccctaaactcggtccctgcgccctaccaacccagtccaagtccttcgcctcgccaagtacggccgccgcgtcgatcccggtgagaccatttgtaccggcctagcctagcctgagaaagagaaaactgagctccagcgacttgggagagggggaggaggacacgaagattctctgggtcatggccagagctccgcgggctccttggggtagaagctcggtcctccagccttgccccgggttggttttgccagcacccccaggttctgaagcatctgaggacattgagatcttttgagaagctggtgatagctatgggctctctctcaaggaaaatgcaaggatgagaattttgcccataaattcaggaggtgtagggactccggattgcaaacccattctgcctcaacaaatctgtatcaactctctgaccgccccacatagccccttttccagaaccttcgggatatcctgccttcccccaccaggtggggccctgaaggactgacgtgggggacgtcacgaaaggaccaccttgtaccaggcacccgctttgtacggcgggaaaaccagcgagtccagaagcctgagtctcttctgcaaatccactccccctgctgagtcctgggatctcagtcaaggggcgaattcctgatgccccctgccaccctcttccctctccaaaccctgaaatctgtccaaatggggggtgtctggaggcgtggcttggaggcagtttaagcaacagctaaaacggttgccaattactttttaaaaccattaatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgggggcgaagtggtcctcggggaaaccttggttaattatccaggcggggaaaaattccgggccggtaccgcccccactacctcgctgctccgggcccagattttgtagggaaagaggcaaatttaggtggagagagtcggtgagtggagactccggaagacacgcccaccatccgggctctccagggttgggggtctgtccggggttgggggtctgtccagggttggggggctgtccagggttgggcggctggggcgctccagcctgagccctgccactgcctggggtctctgccctgaaaagcacagcctggcattttgcccacaatttctaggggccccggtccggtctcaaggtctaatcccccctcaggcttccggatgtgctgaggttagtgatggggttatcttcccttcccttctgcgtctacctgggtgcctagctcctgccttgctaacactgccactgaacccactttctaagagaaattgcctcttcctaacctgcgttacaactcagaagtgcagatgcctctcagacatagacagtcctggggtctctccaaattcagaagcttcagaatagaagaggagaggtgctttcttgagccctcagccctgggaagaacaggacagtgagcttggtgagctcaagcaatgcggctcagggtaaggagctgaaaaaatcggatagggggagttgggatggctcaccaatccagtgtgagggaagtgagaggaggaaaagctgaggtggcaaggggacagctcaccccaggcccaagcctggtaccaccatctgaagccctttgtaaactggggctcctcgctctctgcagccccaaagacggtggaaatctggggttggcccaacacttgtgcccccagtctgtaggaaccccaggggtctcggggctggagggtggactacagtcctgcccagagcaactgccggcatttgggctaacactgccagatgctgtgcgcacacaccccgccacatggaacaggagttgctgccttcgatgctagtgagcaggcggcttggaatgaatccagacccccatcccctcccctcacactaccctccagcgctcggaatccacctcatgccaagtacaccaggcacagggcggcaggaaggctgtgcgtctgtccgtgggggccgcatgcatgtggatttgccagtactggcctcagtgtgactggtgggagtgtgcgcgtctgtggagttgtgtctccgtgagtgtacctgtgtgtgagagggtggaatttacctatacgtgatcgtgcgatcgtgtctagacgtgtgtccctggagtctctgaacgcaagtgtgagtgcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggtgcggaacagcgaatcccggggcgccccttacctccgtagtaggtgtacggggtggaccccaacatctcagactcgtccaagcggccgcccagcggacgcatgcgccgcggactccggaagaaggcgtgcctccgggcgcctagggcgctcagctgtttcatccggcgttctttggaccgtcggttctgaaaccacacctgggacagaggagggggctgtgaacccaggatcaggagtgtcctctccccccctcttctcccttccctgactgggctgcccctgctgggtccttgcgcctcttccgcaccaggactcccccgaggcggggccgggccggattaggccgggaggggtggagagaggcttcggcgaaccagccaagggtgaaggatttcgcggacccgtggggcgactcataaagacttgggcttcctggtccccggctcgcccgcggcctgacggctctataaaggcctccctcccggcacggctctcgcctcggcccctcggctccggagccagcctctggccgtttgtctgcccgcgcttcggcgcagggagggagggggcatcgcctgtttctctgctcgaaaggtggaggtaaagagggatcccggaccccagagaggcttacaaccttccataagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggagctgtgcccgccccgggccgcacctggatgacgcgcatgttgaggccggtctcctgcgccagctgctcgcggatgtggcgcgtgggcttgggcgtggcggcgaaggcagccttgagcgtctccagctgcttggccttgatggtggtgcgggggccgcgccgcttggtgcccgagttctgctcctcgttctcgttgttggccgtctccttgtccgacgaggtcgagttgtccgtctctttggggtcgtcctgcagtgcgtcctggaggtccggggacaaactgcggtccgtacaggatgacactgcgggcggacggatcgggaaggggacagcggcgtcagcgacggccagacgcctcttcagtccagtggcgggttcccgccggcccaagctacggcctgcccaggctacggccagccccgctggattccctcccaaacctgcgacagcccctcccccagggacccggtgcccgcccactctctccaggcggggctgggcctttggaggggcgctcttaagccctctccgcgcg

SEQ ID NO: 5451 - DNA, 589 bp, Homo sapiens
  source 1..589: mol_type = unassigned DNA
tcgcctcgttctcggggcttcagggaggcggcgactggagccccgctgcctactcacaacaaaagaaagcagggctggcgcccctacacgcgctcccattcactgccggccgcggggagaatcctaccccgcgccctcgccagggtcccggggagctctgggctggcggaggcgaacaagatgcggtttgacagaaccaggccgtgcttctgcaaacctcaatgccgctccgccagccgcggcggcctcccagactccatttgccggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcg

SEQ ID NO: 5452 - DNA, 1294 bp, Homo sapiens; identical to SEQ ID NO: 5442
  source 1..1294: mol_type = unassigned DNA

SEQ ID NO: 5453 - DNA, 1373 bp, Homo sapiens
  source 1..1373: mol_type = unassigned DNA
gcgagcgtctggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgcaaggaggctcctcgcaaagttggaggccaggccggagcgatgttccgggagcggagccctcccagcctcgggcccccagccgcggacagctggcagtgccaaagactccgccattacctgcggctcgcagttgcgattcggccgcagagtcgggcaccgaggaaggcgtaaagttgagcttgggcaggtacaacggtccccagggactggcatcccccagcccgggctgcccgcgggagggtagcgagctgtgccaagggctccgccattaccgccagcgcacagctcggagccaagcgcgcggctgaggaacgactagggtcttgcaaagttggagcctgggcgcgtagacccccggaccggagcccccggcctgaggccgcccgctaggaggaaaatgaggccgcccgaaccaagttgggacgcgcagcaaagcccgagccttccgcgcacaccaggggctcgggcgggagcggggagccctggggacggagaaggggcgcgggacgcctggatcaggaactcacctgacgccgagccgggcagcgccgaggctgcctcttcgcgctgcgcacccgcccgcccgcctcgtactcctcctcttcctcccgggcgcccgcggccgccgcgctccgggttctgaatcctccgagtccgccgccccgcgcggctggagggcgccggttgcacccactcgcctcctggtaggagccgcgcgcgtccctccccttcccctccgctttgtgcctccaagatccctccccaccccctctcccctagcccccactcctcccttctcttcttccctccccttgcgtcccctccctcagcctcagcgaacccaagttcgggacggaggctgcgggcttccccggcgcagtgctgggcgccccgcgcgcgcccctggctcaccccgtccgctcggccgctgctcgctgcccggccgcccctcggaggagccgcggcgctaagtagctcctcacccagcggctggaaacgcggcataaatatgtagggactgagccgtgagctcagcgagggtcg

SEQ ID NO: 5454 - DNA, 1524 bp, Homo sapiens
  source 1..1524: mol_type = unassigned DNA
gcggctctgcggaccccaggcctaagggggcatcgtcccaaacacccgacgcgcccccatcaccagttcctcactggcaggccccaagcgggaacgggattgggaaggcttcgggcctggggggccttaccccgatgccccaggggcgccctgaacccagttccagccaggcggcggcacctcaggcagcgcagggagcgcgaccggctcggggagggggaggacgcggcgctcccgccctccctcggtccgcctgtccatctccaggtccctctgtccgccggccccctggctctgcccaccctggggctggtggtgggcgcgggccgggcctaggcccatgcccggccccccttactgcctgccctcctccctcaccaccccaccccacccccccagtgctcggcctcgtttcgtcaccggatcccctggaatgggggacgcgggcgcgaaatacgaacccagccaccggcagctccctccccacgtgcgctcggcccgcagcgcagagggcggcccggggtgggggcgcctcacctttgccctccatggcgtgcacgaagtccccctggtacagctggctgcgaagcttctcctccaggctgaagccgcggacgctgacgatctcctccacgtccgacaagtcctcgttctcgtcgtatcgctggcggtcaatcgggcgctgcgaggacccaaaccagagagcccgggacattattgtgggggctggaggtcgcctctcaacctgggcccagcactaacaggtgcagcagccgagcgccccctgcaccccaccattgcaacccaagcaactttgcgcaattgccaaagatgctgaaaagcaggacaaggagaggggcccgcaccccgagggtccagctgcgctctacgcggggtactcccctccggtgtcttcggaagcactgaagggacatctggggaccctcccctgccccccgcccccgaaatgtgctgggcttcgcccactcggccgggagcctggttatgtaacccgcgaagggggctccggacacgggctggcggggcaaatgtaggccccaggaggagccgctgcggcgcccggctcggcggtaacagcagccccagcggccgcggcggcagagccgggaagccggaaccgggggccggcggcatttctaaagctggagccgcccccgagctaccggggaagctggaaagctgaaatggaagggctgagaccccagccgcccccgccgcccgcccgccagtgcaagaagaggaggtggggggaggagaatcggggcttggaagggggagaggcagacggcccgccacaaagctcggatcggagaccccaaaacgcaccagcagctgcctcatctccccacaagcgcgcgcgcacactcacttcctaaggagactcccccaccactccccgcatccccctgcctcctccctccaccgcccagcgcccggcccctcagccccccagattccgggcgaaccccgagcccgctcagcccccctccacgcctttccccg

SEQ ID NO: 5455 - DNA, 1009 bp, Homo sapiens
  source 1..1009: mol_type = unassigned DNA
gcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggagtggtgggcccggcccgtcgcgggaaggacacagagggacataggctgccctggagaggcgctttcggacatctggaggggcgcatagtgctgggacttggcggcgcctggggcggaggggcgcgccggatccagccgggcgcgctcgggggccgggcgcagtgggagttgacgggcgtccagccggcggcgccctgggctcggctaggcgcaggacggccctggcagcggtgcagcagcccaggctagttcctggggggtccctggtccccgcctccccgcgcgccccggccagcaccgcccggagtccgggcggggaagtgggcgcccgcggcttgggaagctgctcccccgccctggagcagagtcgtcgctgcggtcgctgaggaaggacggagcagaggcccgcgctgtctggggagaagactgtggtgtcatcccgtcgggaatgaagggaaatgcagcggctgtttgcgccccgggactccaagaagtacagcaggtaaagagaatagccacggcccgccacttcg

SEQ ID NO: 5456 - DNA, 961 bp, Homo sapiens
  source 1..961: mol_type = unassigned DNA
tcgccttccccgacacctaaaagccccggtcctgcgtaatattgcggatccctcccagcctcccgtccgctcctcctcccgcggggctccgctcagggccggtcccccgcccccacgccgcagcccgggccagcggggcccgccgcggtggcgttcgcggatgctgccgcattggccgctgcggcacggacggcgcagcctcgggcgcggcccggcacaggcgccggcggtccccgccagctagcagcccggcgaggcgctggcccacccatggtcctcgggcggcggcccctgcgcccagccctgcgcgtagcctccgtctctcgcccggggccgccgagcccccgacacgggcgagatgctgaacggcgcaggcctggacaaagctcttaagatgtccctgccgcggaggtcgaggatccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcacctgcggggccaaaaggctccaggccggggcgaggtgagcggcgggcgtcagagacccccggctcgtccctgtacagatgtgtgtgtgtgtgtgcggcctccctgtgcgcgtgcccgtgcgcccctacgcgcggatgcggctcagggatgcgacctaggcggcagtcaccgcgatggtgggcacggtttggcggcgcagagaagatgcagccttccctgccggcggccggcaccgctgtgctgcagagctcaaaagcagagggggaaaaaggcatccgaagggtccctcgagtgattctcaccacttggagccccgggtcctcgcgcgctcacagcggcgacg

SEQ ID NO: 5457 - DNA, 961 bp, Homo sapiens; identical to SEQ ID NO: 5456
  source 1..961: mol_type = unassigned DNA

SEQ ID NO: 5458 - DNA, 980 bp, Homo sapiens
  source 1..980: mol_type = unassigned DNA
gcgtgagcgaggcaggcacacacggactcgcggcggtctgtttgcaacagcgctgggaatgcacattggaaaatcacatcttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctcgcccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcgcgcgcccggccgcccgcccgcccgcgggatccccgcgaggccgcgcgcccccacgggtcagggctgctctagggtgcgggcaggcgagggcggcccaggggcgcggggcgaggggcgaaggagccaggaggctgagaactgcatggtagccctgcctgcctgccgcgctgcgcgccccaccccagccggcggccccgggcttgcaccgggcggggcaggggagcg

SEQ ID NO: 5459 - DNA, 408 bp, Homo sapiens
  source 1..408: mol_type = unassigned DNA
ccgtaccccctgaagctcgctgggcgcgccctgggctgtccttccctgagcagccgggcctagagtcaaggcgcgatgattgccgcgcaagctagggtccacgcggccggggctcctctcccgcctcgggcgcaccagaggccagaaagcggaaagcggctctgccaggccaaggccgacagaaaccgagagcatgtcgctatttgccggagagaactgccctgccaggctgccacaggtgacttgcccgcgcgagccacggcctctgcgcagagctcctcccgaaggggagagtcagagccacccgcgggtttggtcggggctcttcccagcccggcgtccacgccccgcgtcctgcgctcgcccttgcggctgcttatgctcaggtgtttcggaagaggcgccgcg

SEQ ID NO: 5460 - DNA, 2190 bp, Homo sapiens
  source 1..2190: mol_type = unassigned DNA
gcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagccgagggcgggggcgatttataacctttccccagcccacttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggcaggttcagggtctttgctccgcgccctcttgcccttgcccctcctcctgcccatcgcgctcaggaaatccttgcagactccctccacccggcttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgaccccttcagactgtcccgagaagtctaggaaggcaccggagaccctcggcacaaggcactgaacctggagcgcctgaggggaactgacgcttgcttggcacctttgggaagactgcgaaccagctcaggtcccaggggagcgtgtccgtgtctttttcggccgcattgatgcacccg

SEQ ID NO: 5461 - DNA, 2190 bp, Homo sapiens; identical to SEQ ID NO: 5460
  source 1..2190: mol_type = unassigned DNA

SEQ ID NO: 5462 - DNA, 679 bp, Homo sapiens
  source 1..679: mol_type = unassigned DNA
ccgagtggagagcagcggccgcagcgcggcgccaggctcgggctgggctggccggcgcgaacccccgggggcgtctgggcggccaggccgggtggcggctgcgcacgtaggagtaccccctgagcccagccgctcggccggcctgacccgcgggtgaccggatacgagtaacgcgtgcgccccgatctgtgccctgcgcggggtcgggcggggaccggccgggggcgccgcgcgcccggtcgggttgactgtcgggggcgatttccgcggggcaaggcgggggcgcgggagcagcgcgcagctgcggggccattccacctgagcgccctgaggtcagggccggggcctgaggacacggcgctgggctccgggggacgcgggttcacgccggcgcccgagcgccacctccccgccctccgccggctcacgtagtcccggggttcggtacgtgaagtgccggcgcgaggctgctcaggccaccgcatgggccgggcgataaacaatcgcacaggatacacaacaccctggactgtcacaagcccctcgcaggaaaagataaataacatctgaggcgctgcggcgcggcttccccgggctgaacaaaaactaggaggtggggggcggtggggcgaagtaaacaacagaaccgaagaattgccgcacggagcctgggccggcg

SEQ ID NO: 5463 - DNA, 2013 bp, Homo sapiens
  source 1..2013: mol_type = unassigned DNA
ccggcagacctggagacgcccccggcctcttgggagctcctgagggtccaggtcgggtggggcgcgccttgcggcaagttcccttcttccagccaccgtcctgaggagcagaaggcgcggggacacacacatacacgcccgggcacgtcgccgcactcccccaactgaaccttggtgtcttcctcctgcctgcaaagacatcccaggccctgggcctgggagctgtccccgcgcggtcctgcctgaccctagcggggtcatagtagtctggcgcccggagcggctccagcgcggcgccgcgggcctaggtgggtgtcccagagagcgggcggctgcgcgactgaggagctggaggcgcacccctccgcccgccagacggcccggcccgcgcccccgccccactcccctcgcgttctcttctctggaaaggaaggccggagttgcaccctcaaagcgcctccgtccccacccctcccggcccgccgcgccccaggggctccacaaacttgctgcaagtcgtcggggctgcagctgcaggtaagggtgaggcggggccgcggcctgggctgccgagcacgccccctcccagccccaagcgtgcacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgccggcagaatctctaccgcgcgcccccactgcccggcgcccacactcgcgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtctgtctcgccgccgccctctcccgcgccccttcctccccaccgccctgcgctgcctctcacattctccgcattacagcgggtgccgcccgccgctcgcggggcccagggttcgagcgcgcagtgggcggcgaggggacccgccacgcccggccccgccgccccctccgctctccgcggctccgcggctgctagctccggcctggcgctagggtggcgacgtcccgcgctagcctcggctgccgctgacagctctcatctcgcccgggcttaaagggatagcgcacccggctcgaccggccccacccgggggccccggggaagggacctcgctgcgcgggaacagtccggggcggtggcacagccggggccgtgcgggcgacgccctctccgccgccgtggagcccggccctcggggctggaggtgagtcaaggagaaggacggtcagaccacgccatccagggggcgctcagcggccaagcctctgggccgacaatgggtgtgcggcggtgtaggctgagcgccctggactgcgtggcg

SEQ ID NO: 5464 - DNA, 1501 bp, Homo sapiens
  source 1..1501: mol_type = unassigned DNA
tcgaaagaggggcgcgggtgggcgcgtctccccgcgagcatctcacctaagggggaatccctttcagcgcacggcgaagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcggggaaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccgcccccagtgccagggcggaggcagtcccggctcgcaggtaattattgccagcggagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacg

SEQ ID NO: 5465 - DNA, 668 bp, Homo sapiens
  source 1..668: mol_type = unassigned DNA
ccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctcggcccgtcctcattgaaatgcggcgcttcgcacagcctcactccagcctctctctccagaggagggcggcggcggcggcggcggcgggcgcgctcccttttcttgtctcactcgctcacacgccctcccgtctccctcctcctcctcctcctccgcgtgcgcgccccgtcgcccccgcccttcttggcagggcgcacccaccacggctgcgccccaggtcctcctccctcccagcgccctcttcccaccgcagcaacctcg

SEQ ID NO: 5466 - DNA, 1006 bp, Homo sapiens
  source 1..1006: mol_type = unassigned DNA
ccgggcgccctgcccgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcaggtgagtggccaccttcccaggggatcgcggctgagagcgcccatctccttcccccgcacttggaaactgagtctggcggcagggctgggccacccagagcttgcatattccggaagggaaagtgactccagaagggagagaggaagtgttgagtttggggacaacctggcgcagggctgtcgggcgcaccctgctctctctccgcccacgcaccccagcttctcggtgctctgggggcggactcccctggccggacgatgggtttgaatctcaccccgtcccttcgctgggaaacaacactggcctctcaccttttctggtagtgattgcatactttttctccctgtcatttctcacttgaagttaagaatcaacttctgttcacgtaggaaaaaagatgagcgccttcacttgggcatctacctttcccttcccgcccaccacccggcgggtttcggttcctgcgcctggctgctctgcaggtgtgctggggccacggtgctggagggctgcgcggagcgggaggtcgcggtgctcgtgcccaggtcgcccaatgggtgggcagaatgacacggcgcgaccagagaggcgcgggctcgggatgggggctctgcggctgtggcg

SEQ ID NO: 5467 - DNA, 867 bp, Homo sapiens
  source 1..867: mol_type = unassigned DNA
gcgcggaacaaggcgctgactgtctcccagcctcccctcctccgcgccccctcggcagcagcgaaaacccggaaatctgatcctggccccaggagagccgggttccatgaggtgcactgagcatgctctgcagggtccggcgtgggagggacgcgctggcgctccccaggcccgggcggaagcggcgctcgcaggcgctgaaagcgagcgaccctctgagcccgggtggtccggcgggcaagggcggcgcgggagacccgcagggcgcgggcgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttggaaagagaaagtggcagcgtctgggtcccctcggtcagcccgggccagtcggctgcgcgtgcgaagtctcctctagcggagcgggaccggccgcggcggtggatcgtggcggtccctgcacttctgctccagccgcgcctggaaacctgagcccggactcgcggctgctgcaaaacccgcttccagcccacctcactgcgaactttgcttccg

SEQ ID NO: 5468 - DNA, 1072 bp, Homo sapiens
  source 1..1072: mol_type = unassigned DNA
ccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccaccgggctgccaggacaagccacaggcatagaacgacgcggttgctgcccgccccccccttcccccagaaaccccaaaggatgtcggtgatagagagttccaactaatgacgattgtgcgccgcatctggggaagggatacagaaaaaaaccctgcaaacaccgtgaggatgaaactgccaaagggatgcaagagcctctcaaatactaattaggggccgcggcggcggcgggctcggcgcggagacagcgtcggcgggatcccagcgcggtggtcgccgctgcgctggggggcggaggacagcgcaggagctgcagccgccgccttcgctggagcagccgaggggccggtgccacctttgctcgccccctcactaccatgtacagtgtgcgctgcaagaagaaggcgggagatgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgatcgcgccttaacacgtattggagcgagtgtgcgagtgatcatgagtgtgagcgggtgcgagcgctcggcggggctgaccgtcacgttggcggggccggcggggccaggcagtcttctccgcg

SEQ ID NO: 5469 - DNA, 1633 bp, Homo sapiens
  source 1..1633: mol_type = unassigned DNA
acgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagccgggcgctcactccgcgttctggttcgggcaaacttggaagaactgcgaccgcagtttgcccagcgccacagtctgagtggcgccttctccactcccgcccttgcgccggcaggggcggtggagagacgcggagggctcccccagcccctctctcccctatccgtccttcgggcgacagagcgcccggcgctcgggccgggggcgggcaaggctgggagggaccctcgccggggacctggcctctggacgccggcgtttcaaggctggtttggggacttcacgggctgcctgtttcagatgtggggcgggctttcccgttagggttcctcagtgcttccccagttgctgttggccactcagggcccggggacaccctgccacccggtctggagccggcctcgtctgccagcgaacagccaactttagcgggtggctcagctggggattcgggtccgggttcgggggccccgtgtcccccgcatgcccggccactggcattgctccaccaagagcttgagagcgcccaccctttctctcggcgccagtgtgtgtagcacttggtctccgacaacttgcgcggcagtctgggtgcttgttttccggctcttagctccaaccgaatccgagcttctctggggctctgtgaatgaaacgtgtcg

SEQ ID NO: 5470 - DNA, 1143 bp, Homo sapiens
  source 1..1143: mol_type = unassigned DNA
ccgcggagcccccgcggagacctgctggagccaggctgcccacccccacctccccacccgcgcgttggcccagaggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcccgcggcaggcgcccccgacacccacgcgcaggaatagggagggcgcatcgcggctcccgcgccccggccaggccggcaaggaccccaccgccccgctctcgggtggaggcgcccctccccacccctcccccgcgcggggcccccgcccgcagcccctctagcagcccctctcgcagccccagcgcccctgagccgtcctggcccggaccggccaaggaactaacgagcgcgcatcgcgggcctcgggcgcagggcacggagccggccgcgccgcagcctcccgggcaccggcggcggtgaccaacctgtaaccccagcgctcagagctgtcatggtgcccgcgggcggcggcggcggcgacagtgggcgaccggcaggatcagtgccaggcgcggcgcccagggcgggcggggacgcgggcccctcacctacggcggctcagctcaggcagcgcgctcggcccggctggggccgcggctcacgctcgccgtgtcactcactgagcgccgccgccgccgggcaggctgggggaggggtgggagccggagttttcgggcctttaaaaaattattattttatttaaatttttaaagttagctttgctacagggactgcagtgatgccgaagggcgggcaccgcagaggaggctgcgccgcagttggtggggagcgccagggtcggtactggcagttccttcttgccggctgccacccgcagtcagtctcacagcaacagctaggctctcatctgcgagctcctctcgggggtctttcgtactcaacagcacggcggcggtgtgcacgggagtccgccgggcacacgcggggtacacttaagtgcactgccaggaggccgggagcccagcgtgcgagcgtgaggtcagactgtgcacggtaccg

SEQ ID NO: 5471 - DNA, 1143 bp, Homo sapiens; identical to SEQ ID NO: 5470
  source 1..1143: mol_type = unassigned DNA

SEQ ID NO: 5472 - DNA, 1371 bp, Homo sapiens
  source 1..1371: mol_type = unassigned DNA
tcggttgagagcgtatggcgttctgagtagtgcaggcctcggcaccgagggcggaaagcgctctgagctcacagccgcacgacagaccgccggcctgggccctccaggaattccctgcagccttgcccggtccccgactctcgctacccaccagccctcccaggcacccaagagcctcccagcggcgggccagggccggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctccggagccctaacgcctgtgcgcgtacctggcagcagagacagcagcagcagcagcagcagccgcggcggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggccggcggcgtccgaccagatctgagcaggtgctgtcaccaccaccaggaaggagagggactcagtttctgtcccaggtttccggggcgtgtgcagctcccgcagggggttgggaccaccgggctaggcgggcgccgtaggagagacg

SEQ ID NO: 5473 - DNA, 1545 bp, Homo sapiens
  source 1..1545: mol_type = unassigned DNA
acgcgaaccccgcgggtggctccgggtggtgggctccctccagcgcgcagcttccgctcgctttcccctcggcgctgcagccgcgacctgggaccgaacggacaccgccttcccggggctccggcggcgctctgactcccactttcctccgccgcagcctctggcagggcacccccttggcgcgacgccgcgcccctccccgggaccgccccctcggtcccccagggtgcgctcagttgctgcccgtgcgccccgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggggttgagggtgaggccgcgtcccggggccgctggagcgcgggcgtcatgcgagactgtcccggctgcgcgccgccccagaggagtccgagcgcccccttcagccgcggcgcgctggccctggccgggactgcagccaggtgggcgccgcgcgtgtgagcgccgcgcgtgtgagcgcagacctggactcgggcggcggaggcgaaagtcgctccatccgcggggtgcaaccctgggcgcggaatccgggctgccgggtgacagtgaccagctgactctggagcctaccggaggcgcggcatcggaggccgtgcggaccactgccgaacagccgctggagacccgcagagaagggcgggccctgcgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggccgcacctggtggacagagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttcacctgtcagaaagcacgggagctgggcctggcccgcggggagcgtaagctcgctcacacgcggtccaactcaggcaaatgcagcatgcccgacctgctctgccgccatccctccgaaagcgataatttccttgggctaccgaatccatcagagtagtcatttgtcccctcgccggcggtgcggggagcgtaacatttgagtagcctaactctcacagcgcg

SEQ ID NO: 5474 - DNA, 1545 bp, Homo sapiens; identical to SEQ ID NO: 5473
  source 1..1545: mol_type = unassigned DNA

SEQ ID NO: 5475 - DNA, 1027 bp, Homo sapiens
  source 1..1027: mol_type = unassigned DNA
ccggccccggtcccagccccgacaacgcctccagtgcccgcagaagcggccctcggacagcgaggacagcccgccgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctcaaaggccatcaccacactgcccgccaccagctggggaaagaacaaagacgagagggtgaacgcgaagggtggaaggccggctgccggtcaccacccctcccggagcgcccctatacacgcaccg

SEQ ID NO: 5476 - DNA, 693 bp, Homo sapiens
  source 1..693: mol_type = unassigned DNA
acgaacaaacgttttatccccgggtagccggcgggtgcggagcgagtattcgtggggcgggataagtgcggaagtcgctgcgccctcgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccg

SEQ ID NO: 5477 - DNA, 1496 bp, Homo sapiens
  source 1..1496: mol_type = unassigned DNA
acgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatcggagcgtcttcctcggctccctccctcccttcctccctccctcctcccctccctcgtcgcggcctcctccccccgccccccgcccgggctgggagcggcaggagagcggaatctccccctccctcccctccccacacccgtctctctccccgcctgtcctctccctcctccccacccacccacccacccactcgccggctcgcggctgtagccggcaccgccacccgcagcctcgcggcagcccgcccgctccacgcctcgcagcgcggcgcccgctagccgcagcccgggggaaaccgagaccgaagggaaaaagttgcatttgagattgcgagggtcggggctggggagggagagttggcgagctggctgcacgacacggaaaggcgctctcctttccactttttggccctcgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagctggctgccgggtgagggggcgggcgggctgctttctccggattcgggggcg

SEQ ID NO: 5478 - DNA, 5820 bp, Homo sapiens; identical to SEQ ID NO: 5231
  source 1..5820: mol_type = unassigned DNA

SEQ ID NO: 5479 - DNA, 699 bp, Homo sapiens
  source 1..699: mol_type = unassigned DNA
ccgtggtgggcgaggcatccggggcttccttttctctggtccacgaactcccaactccgaacgctgtgggactgcatgggcctctgcccgggccaatgaaatgcgctgccgagaggaggctgcggcgcggcctgaggccggatctccacaggccggagagttctctgccggccgcggccggacctcccgggaaatgggaccagagcgcggagggagcctggccaggaggcctcctaggactcagccgcgacgctgaaaagcatgaagggtcggaattaggcactcatttagcgagcgttactaatccgaagttacagcgctaattccctgatccggccgctcccacacgcagcgccgggattagaggcgcggccgccgcccgccccgccctcataccccaaacgcgcccgccccgcgccctcgaggctgcgggctcagggctaatccgccgcgccgcgctcgcctggcccgagcgcgcggcgggtcgggctcggccagctggggcgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcg

SEQ ID NO: 5480 - DNA, 1845 bp, Homo sapiens
  source 1..1845: mol_type = unassigned DNA
ccgccttctcgccgcgcgctgggggctgtccccaggtgttggtctttgtgtcgagaaaactttgcgaggaggcgagggagctggacaaagagcgggcgagggagggcgtttgccagcctgaggggtgcgccgggcggtgcgcgcacttccctgggctcagctccgtacccggtcgctcgcggtggccagagcccagtctctctaggccaggagtggcgtccggctgcatccccgcgccctcgggagctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggactcgcccaccctgcccccctgcctggcgtgtccaagcgcagtgtcgccggggtcgagggagggcgccggggagtgtctcgggcgggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccggcgaccctgggttcctgtgcgctcgcagcgcggagacggagacatttcgggaaagtctgtaccgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagactcgcgccccgccccgcagccttcggctcgccgggccgggcccctctccggaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcg

SEQ ID NO: 5481 - DNA, 1844 bp, Homo sapiens
  source 1..1844: mol_type = unassigned DNA
tcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctagggcgcgtgtgcttctgtgcctgtgcgtgcgtgtgcgggtcagggtggtgggaccgcgcatcagggcagggtgcctgcgtctgcgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcagcgcgctccgctcggcatttcccgaagagccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggtaaggaccaggagctccgctccgtgcgccgggtctctgatcg

SEQ ID NO: 5482 - DNA, 1480 bp, Homo sapiens
  source 1..1480: mol_type = unassigned DNA
gcgggtgcggctttccgggagcccgcgggactcccccactccccactcccgtctgggaggttcggcgtgggttggcgatgggggtggaaggctcccgggtctgtggatctgcggcaggaggggcggctggtagcaggagtccctgcatcacccccacccccaggggcgttccggggtgggtgggggcatctagtgccccgcgaaaggaagaggaggagggggcgagcgtggagatgagttcaggagcggaaagcagcgcgcgcccctccgaccggcagcgggggtgggcgccttcccggggcgcgggagcgtccccaaagccgcggggcgtccgcagcgggtaggagctctgccttgcacctctccacggcggggcgtcccgcacgtccccccatgctggtccccggccccggaacggcgcgcgccccctgccccggaacgtcgcccctagccaggcggagcgctgggagctgggcccaggcggcgggaggagggcgaacgggtccggggctcgggcctcgatggccgcgccgccccgggggagccggagccgagctggccgccgcccgcgcgcactcaccaagcccgctgagctcctcctcgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtgcggggcgggctggcggggcgggcggcggtggaggagcggctacggcgcgcccggagcccggagcgcgagtgcacctcggctaggagccgctggcgcctggcagcggccacggcgcagggacgcgcgcccctccgtggggagacacctgcaggcggccggcgacactgttccggagcccgcccgcacggggagagggggccgccacgccgggcgcgggcgggggcctgggagtggagggacgcccccgaaagaaatccgagccagggtgagggtctgagacgcaaggagaatcccaggcaaggcgctcctgagaaaagatccccacggcggacgtggggcaacaaaacccgccgggagcg

SEQ ID NO: 5483 - DNA, 5065 bp, Homo sapiens
  source 1..5065: mol_type = unassigned DNA
acgagccggggacctgggggcccgggcggccgcagcttagtgggctgaggtgccgatcagggtcacgcttcggagctctgtcggggcccagctccctccttcacaccccaaaatgccgcctagggcgtgggcatcccgagtggcatccggagccgctgagaccccgccgagattgctccttgtgcgtcctcccacagccgagaggccagcatcgtgccgggacgacccggggacccgagtccgggcgccgctacaccgcctcgggcgctaggcctgggagctttgaggccggtaccgtgaaacacctttaggagcaaggagggattccaggtgtcctccctttgtaccccaactccctgcccggatctcttccactctctgccatagcccccacacacaaactttgttctggacttgttcagccccttcgggacccacagttgtcgcctccatcggagaaaacaagtgcccctgtttcaggggggattccactctggctggccacccgcaaacctggaaaactattctatgacttcttccctgacccccctggaagtagggagcaccacgatccgcagagggcgcataccgaccagaaagattttggggggcagagggtgcaagtgttgtgggaagagatgcggagataaattttgcgagccagaccccgacactttccccgtccgtttgcaccgtctccggaacaactggcggccagcagcactctccaccccggccgcaaccccagcgggtcaggcgctggcgccccgacaccagtccccatcttcttgcagctctgaacctccaaagacacccggttctgcctcgcaggccgagggggagtgtgcgtgggggcaggggggcgcagcgaactcccccacgctcggagttcagcccagcgcccgaagtaaacttccttaccgctggcagcaaggccgggcggcggaggccgggccgggtgccctggggccggcgccgggagcgctaggggccccgtgcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaatcggggccgcggcggcggtgaggtagggggcgcgggggccagccgcgtgtgagtgggtccgagtgtgcgtgagtgtgagtgcgtgtgtgtgtgtccacggcgcgggccggagcactcaccatctcgccgggggagcgaggccacttcggggtcggattggaaatgttgaggcttcgcttgcttcctccgcgacatgctggctcaaacatcagctggggcagaataaaaaattactaaaaaaaaatcttctcaaaattacggaaatcgagcggcggcggcggcggcggctccccccgcccgccggcccgcccgccccctccccggctccccggccccgggcgcagcgcgcatgtgtcctgctataattatgattatcaataatgcattgcgattaatcatagaggggctctttgaaaggcgattggcaccgggccagcgctattcaaacccgctcgccttaatcaattagttcgtgatttgctgcagacccctgtctctccgcgcgctggcccaataagccggccgcggggctggctctgcgcgccgcgccgcccgacactgggttaaccctctttgcgaccgcccgggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatcaggggggagggcgtcccgtttcgtgagtgtttcttcgtttctttaagagctaccagaaagcagcccacccccacccccattaaaaaaaaaaataagcgagtggggaagagccagccccacgccggtccgcctcccgcccacggctcggcctccctcccgcctggctcggcgctcctccgccccgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccccggttggctgcagggcgcgtcactccgcggggaggcggcggcagcggtggcgccgcagagccccgggcgggcggagagcggggaccggcctgggctccgagttcagctccggccggggggaggggaggggctgcggctcacactgagcgcagcagcgagcaccggcctagggagacacagcccgggcggacccggcactggactgggccagtccctgggacccctgggcaccccgccctggggagggggccgcgccccagccttccgggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactccggacctgtactgcgctccggtagaggacccttccctttctcttagcttcttaaatcttttcttttaaggtgtaaatgtgtgtgtgtgccgatgaatgtttctgtttttcatctgctgactttatttttttttattggtataacttctcccttctctctccctgctcgtccgttttccaccttttctcttacttatcttctgccctcgctcactccctaacacacacattcacaccctctccgcctcgctctcccgttctcgccaggtcctgatgggtacagtagattttgataaaaagacaaacgaagctatcagtggggctgatgttgaagaatgaagataataatgtttccataggtggtgcttcaaatgccattatttctcactgaatatttaaagagatccctcggcaaagatggatctgcgcactcctggggtgtgagcggctcgcatctcccagaccccggggaacgtgtacgggagcacgtgtaaatcccgcacccgcctccatctcacaaacaggggtcctcgcacacccaccaatccacactgtcccaggtacacgaacgcgtttgtgtgcacttgcacactcctttcccggaatgtgcccgtgtttggagccgcccgcatccttctctaacaatcttggcttcttgaaagtccgggcctcccgggcaccgcatgcagccaggaacctagcggagctggcggtcccgcaaagcttttctcctggtgcgcgccgcgtgcgcagcaggaagctcccgggaataacttcacacgtgtttgttacttggtctacgtgtgatttaagattaagtgtaggaaaaaaaaaaattccccccccccaaaaaaacaccacaacaaacaaccaaacgaaatgaacatgcgaaaagcagctacgcgatgcttaattaaaaatgggcgagcagagacgaataaattgggggatccaaactttaataacttttttcgtttttttgcgtcctcgacggcgtagaggcgggcgtttcgatctgcgcttggcgtcccccgctaatttcttgtttgttttctttccctcggtggccccgggaaaggagatgggaggtggaggagggggggatgggaggagggggatggtcggaatggcggggagaggagaattggtctttattgttgatggcaatacatcaattacgggccattgtctcggtcccaagttccgtggttcgctggtgcgggcgctgcagtgtcagggcgctggcgaggctccgcgtgccgcgatgcaaagaaatacatcaataaaaacagaagcagagtgggggttattctttatttttgtgcgggtcgaaagtaggcggcgagcgggagtgaggtgccactcctggagtccctccacgcgccctgctcaccccagagacctgcgcgctctacgtgcggtagcaccctcctaactctgggtggaggtggggtgggggggggactactggggaatccgggtagcgaagtttggacttgcaggttccgccagagggcctggtacttaggggctgatccgcaatagcgaatggggatagcccgaagtgaggcggcagctgcgccggggtcgcgacctcactggcggagaggaaccgcacccgggggaggcgcttggcg

SEQ ID NO: 5484 - DNA, 2372 bp, Homo sapiens
  source 1..2372: mol_type = unassigned DNA
ccgcgactgcgcaaactccggtcctgacactctagtctcaggtcccaactccggaagggttcaggcccaagcctgcacgtcgcgttgccatggcgaccgctggctgccctctccgctctgtcttttgagcacgtggcaccaggaccccgcgttctctccagctcgagagccaggtctggcccagagccgggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacatcgaaggcacctgcattgcgcccccactgggatgcgctgtgcgcaagagacggggaccgtctgctgcaaaaccggatgatcggagacgcagggagttaggagtgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggcgggtggcagcgcaggcggcacggatcgcagtagaagacatcgcactgttcgcacatgacggtggcttccttgggcgccttctcgcagagctggcacttgagggccgcggctttgctctgctggtagcggtcaattaccccttccagtacgcgattcttggggaagccgcggagcccccggtcatccaggatgaggctgcggtgacactgggggcaggtgatacaggagttgcggggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaactcctcttccatctcctccatggggaccggtctgggaggagacagcgacggctgcagcgggtgcctgagctggcgaggtggccgacgggcccgtcttgtccagcaccctggccagcggcggcggctgtggtggtggtgccttcccgcgcagcactggcacggacacccagagaggcgctagctctgtgagccgcagccgcgtagccgccgcgccgcgcgccagcccggaccgcccctacctgccctcctagtcccgccccggcccatgagcagcggcccattgggcggggggcaagagatcgaagctctcattggccaccagacccgtccgtctcctcgtctccgcaggccacagggggttcggtagagtctgaggatagggcagtcttcgctcgcggctgcaagatctctgaagggggccggcgtgcggaggctaggggaccgggaaggaggagttaggcgggatgattcatcctcgcccggcttacttccgacctccggtgcagtctcccaggagctgggggcgtgagaaacccctccccgcagcgagtgggctgccggagggggctggggcttctcgccagcgtttgcgtttggctcccagctctgagctccgcgcccacctaccgcgggcgagtgctgcgcagcacggaggacgccccttctcttccgctgctggcagccttcgcaggcgtctcacccgggcctaggcttctgcacggcagtggggcttttctccttctccgtgaatccgctgacgccgtgccctggagctcccccatcccgggagtctgacggcgctggcgcaagccctggcgacactcttggcttctttcatcctgcgtccctcg

SEQ ID NO: 5485 - DNA, 2372 bp, Homo sapiens; identical to SEQ ID NO: 5484
  source 1..2372: mol_type = unassigned DNA

SEQ ID NO: 5486 - DNA, 2372 bp, Homo sapiens; identical to SEQ ID NO: 5484
  source 1..2372: mol_type = unassigned DNA

SEQ ID NO: 5487 - DNA, 2142 bp, Homo sapiens
  source 1..2142: mol_type = unassigned DNA
ccgagggcagcgccccgcgcttgacctcctcgtaagcgcctacctgctcccaggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaagcgcaacttttgcgactgtcccagctccgcgctgcagtaggtccaggggccctaaaactcgttcacctatcttctcactcccctcacaaccccggagccccatgtcctcggagaggaagcctccaggtctgaagagggaacaccccagctccgcagacgggcacagccttctcgcggtcctaactgcaaagcccgctggccgccctagcaacgccaccttttctgcctgggacgcgtacgtggctgcgaacaattcttgctctcccctccaggtcattcttgctcccctacagcagcggggcaggcagcggcatcgctctctggccgggtaccaccgcaagggtgctggggggctccaggagtggggtctgtttcctcccctctggaggcagggtttccgtgagaccgaccccagggaagaagctgcgggaaaagtgccaggagggggctgaacttacgtagaggttgctgaatcgggcttcgtagaagtgcaggggattcgccagcttcaccacggctgagctttcgtcgtcgccttcctgcaggagctggtccccccacgactccccgtgtgggaagagctcgtctgggtgcagcgccgcggcccgcaacattagcaacggcagcagcagtagcactggtaacgacgacagcaccggccgcccggccacccggtccccctccatgctcgctcggccgtgcgcttacccgctgcacaacgcgtcccgccccggcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggctggcggggtaaaagctcctggccagggctgcctggagctgccccttccactccgcccccagggagctcccgggtcatcctctcatccgggctgccccgcggcccccaaggagccccacccccgggaccaaatggcccgcaaggtttggggcagcggcgttgcaggagatgagctcagcgcaaagggaaccccgcagcggcgagtgcggctgctggcctgcgcgctgtggccccaacaggctggcagggcgcgggcgggtggcggggttgcggtatgagctttgctccctgccctggggtcccgggcgctcctggctctggaggcctggccatcggtccgaaaagcaaagggacattgtcgtggtcccctcggccgcttcgctccacccagagacgccctgaggagaagcgagcctttgtacgaaggcagagggctgactcctaagttctgtccccctcccgaaggccggccgctagggaagacttggccaccctctggaagtaccttcccccgggaaaaccgcagcaggaaagaccatgaaatactactgtgtgtgatccgctccgtttggggagtaggatgaggcatcccgcttggttaccaggcagaaaggggcgagtcgcggggatgggaagaccctgatctcttgcccattgctgcggccgtcggagatgccctcccccgcggccacggaggcggtaacctgagctgctccgcaggactggaaaccgcacaacctcgaaaccagctgcg

SEQ ID NO: 5488 - DNA, 544 bp, Homo sapiens
  source 1..544: mol_type = unassigned DNA
ccgaacctgggcggccgtcgggcagccccctcgtccgaccatggcgactgacagtgagtgcgctccggccgcggaggccaggggtggggggaggccgcggtgcccagggtgggaagttcgatttcagacgctgcctttgtgctggctcgcggcagcagcggccgggtccctctccgctcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaacgaaggcactgcgcgtttttggcgctgtgagttcaaggttcgcctcgagttctgggtcgggtttgtgcgtctgccttttggggatcagggtggcttgcatggctcggctgcccggtggcccacgggctgtattcgcagcgggcagcacaaggccggctggagaccg

SEQ ID NO: 5489 - DNA, 2002 bp, Homo sapiens
  source 1..2002: mol_type = unassigned DNA
ccggaggctgtgccggggctcgtcaaaggctacaaacaaaccggacgggtgggaagcacgtttcagcggcgactggatttttaaaaatctgctggtagagtgaaaacaaaaattgtcctccaagttggcaaaatcggcgtcccagacggtgcgcaggagggccctgcgaggcctgtccccggagccccgcgccagtcctgtaggcccggctgggtccgcagcccggtgttccactcgtgggtcgggcccggctgcggggtctttccgcagccgggacacccaggacagcagcggctggggagccggggccaggggcttccttgcaattccaatgatttttattattatcactcgcaaaggacaaacgcggccaaggccgggcctcacagtggctgtgctggtcatcgcgtggaggagtgtgcgctaacccaggggcgaggggggcgcgcccggtgtcccggggagagcttagaaggaagacgccccaccgtggtccctacagtcagggacagtctgggtgctagaaattcccagagagaactcgaggggctgatgtcctgggtcaccagtccctggtgcctgtggggcttcctgcgcgcccacccccatccccctcccccctctcaggttcgacggattctcccggaggcttaggacagtgatttacagtaagtggtgacagtggaataacgtgacagtccgctgcatttgccagctggctcctgggcaggcctacccgccgggcccgaccccagagtcgagtcctcggagccgccgggtaaagccccctcccccgccccggtgcagccccgcgttccccgcgcccggcgctgccggggaaaagtggcacaacaggaaagcctcgccagagggcccttcccagtcggcttcctcgccataaaaagccagactccagccgaggtcctgaccccttccaaatatacgttcccttgcccgcggcccgccactcccgcccgggcctcgggctgtgcagcttcctcctaggcctgcccgggcccatgcctcccccgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcgggccggagccgcccaggcctgcacccgggggctcgcggccgacgcatgcgcacgcgcggtggcgggtctgcaggcccgaaggcccggcccctccctcaaacccggagcggggaagcccaggggctgagagcctcggcccgggtcgcaggagctggggagcggggacgcgggcaggctaggtcttcccacctgccgtcggggctcctccccgcagcagcaaaggggtcccagtgcccgtggcagtgcatgccccagcggacacgctggctcccaaattcagagatcagaggggcggctgagaacggggcgtccgctgtgtgtgacccctgaccgtggaggaagggcgggagccgggagtaggcggtggggcccggggtcaggccgcggtcgtcggctcccggcaaaggcgctctggccggggaagggggcgagggtgggcggccggcctctgccgtcgtagtcatacctgggacgttgaaatgggctttggggatagagctcactcccagcgcgccccacaggagaagcccgcagctcaggcctgggccgtgcagaccgctgggcgggctcggggcccgaggagagcaacacggcgcgaggtccagtcgcgagtaataaccccgacagcacggcccctcgaagacgtgttccgggcaccggggttgtgagcgggggagcctcgggccttgggcccgcttggcacggggcgggggcg

SEQ ID NO: 5490 - DNA, 983 bp, Homo sapiens
  source 1..983: mol_type = unassigned DNA
ccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcccgcatcccgcatccagagcccccgagggacgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccg

SEQ ID NO: 5491 - DNA, 947 bp, Homo sapiens
  source 1..947: mol_type = unassigned DNA
gcggagcgcgccagagcgcgagggacggagggagaggaggagcgcgggagctgcggaggcgatcccgcgaattcattactgtaaacatatccgggggtgtcaggaggggtaggggtgggggccgcggcgcctacattagcccggccgcgtcggattgaggcagtagtgtggtctgagcagcctccagacccacgccgggcgggcgcagcacttggagcgagccctgcgcccgcccccgcgcagcgccgcacgcccggctccgagctgtccgcacacacgcgtcggaggagagcccgcctagctctcccgccgagtcccgggatcctccaaatccgaggagctccggcgccgcggggcagctttctgccgccttccccgctcgctgtacttcttttggggttcgttggcttggcgaagcggagagggggaggcggaggaggagagaaggcgggggtcgcggcggccgaagccaagagaaagtggcatgcccgaaccctggaggcggtggtggcggaggacgggggaagacgatgccgcagctccgtaggggacgtaggcgagagcaagcgaggcgagctgggcgccccggccccggcccgctgcggggaggcgcgcgccgctctgaggctccggcctccgcacccccgcgccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctcccgcttcctcccagagcccttcctggccctcgcgggtctggcagaaagtaagagggaggcgaagttcaagatcccggggatgagcaccgagcg

SEQ ID NO: 5492 - DNA, 1362 bp, Homo sapiens
  source 1..1362: mol_type = unassigned DNA
gcgcctctttcacccgcgtccccaggtccccatgtacgccacgtgggtgggagcgtgtcccacacacccgcgcgcccaaagccacattcgccacgctcccgccggggcgggctcaccgcgcgcctctgggtgccgagcctccacaggccacatagccgccacctgctgctgcatccccactgcggggacaggggcactcagtgcctccctccgtcccccccgccccgcgaaggcctcccatcctccagggccaggcggaggccacgtctttcccgggccccctccccaacgcggagagggaagcggagggaggagcttggcccgcagccgccggccctccccgcactggagctccccctcccctccctccccgcccctcggctgccgcagcccggctcgcagcgcgcgtcagcgggggctccccggagcgagtcgctaggtaacggggctggctccgcagacgcggggccggggaagcccgcgcgcgtcatcagcagcggcgccgcggggcggggggcgcagagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggtgcgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggtaagccaggccctccgcctcgcgaacaaagctcccttcgcagggcccggaggccg

SEQ ID NO: 5493 - DNA, 1092 bp, Homo sapiens
  source 1..1092: mol_type = unassigned DNA
ccggactctgggaggagcgttggcgtggaaagccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcgggcctcagtttccccatcccgcccacgaagggaggcgattgcgagcgcttggggtttctgacggaccccgccccgggggtggggcggggagtggtcacgtggaggggcgccccgtccgccgagccccgccccaccccgccccgcccgcccccgcgctcggggccctccgcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcaggtaacggggcgtcccccccacgcgccccgggccgccaagtttggggaggttcggggccacggtctcgccctccacgctggggctgggcagtggcgcccgcccgcgatccgcgtcccggtcctttgtcccgagccggacacccccacttggtgcacgcgtcgggggcggcgatcgcggctctcccggggtggggcgggctgcgcgccccgcacccccgcggctcgagctgttcccgcccgggcccctctcgttggcaggaaggctgcgaggagcctgggcagcccgagtcgcccccttctgcccatcccccactgctgtcccccttctggggtcccggagccctccaaggccgggccagctcagacccgcgcgaacgtggatgggcacacagtctcgcccttccccactctgttttcccgaggcgccagtaatctgtctcttgccggtgacctcgggcgccccctttgccgccgcctgaggaaggctctgagacccgctttgtgaccgtgacccgccaagcgtcgacgcgccgcggtcg

SEQ ID NO: 5494 - DNA, 1092 bp, Homo sapiens; identical to SEQ ID NO: 5493
  source 1..1092: mol_type = unassigned DNA

SEQ ID NO: 5495 - DNA, 1092 bp, Homo sapiens; identical to SEQ ID NO: 5493
  source 1..1092: mol_type = unassigned DNA

SEQ ID NO: 5496 - DNA, 580 bp, Homo sapiens
  source 1..580: mol_type = unassigned DNA
ccgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccagccctgttcctgctccggctcctgcggggatggatgcttcacgcagtaagcgagtaagcgagccctggagaccggggccctgggtgtgcggtcggctcagtgccacgcggtgagataggcatggttatcaacccacgccaaggcggttgtgtacctggcatagaaaacactgctgttgaatgttgtttccatagtcattcgccagcgtccactgatgagaggtgccaccacggacacccggccttgctccgtcgaagctttggtccattaggaccaaagtcaggccccagcgggcctccctgccattcctggacggcctcgcgtcctcccagagcctgaccttctcttatctctgcagcctaagtcgcggaagcgtagacacccggcttttcccgcgtgctctatcgggctcccctggacacg

SEQ ID NO: 5497 - DNA, 888 bp, Homo sapiens
  source 1..888: mol_type = unassigned DNA
ccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggccggctctgcaaacgcgagcctgcgccaaggcgccctgcgggtttgctggtggcatcgaggggcagcgcggggccagcgctgggagctccgaacccacacgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgaccagggagcgggtcg

SEQ ID NO: 5498 - DNA, 1483 bp, Homo sapiens
  source 1..1483: mol_type = unassigned DNA
tcgaatactgatatcgccccaaagctgcaactctccggccccgccacggctccttatgtacaaagagagggaatcagtcgccggtgacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcccgcgcgcccgcgcgcctctccctcgaggactcggagccgcccgcgcactcgccaggggccgccgccccgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgacgcccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcg

SEQ ID NO: 5499 - DNA, 3714 bp, Homo sapiens
  source 1..3714: mol_type = unassigned DNA
gcgcgcgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggccaggggcgcaggaccggtgctcccgaccgctgcgtgcttctgtgttgcgtgtgtgggtggggggacgggatatagagagtgtgtgtcccggagcagtggagcggcgggaggcggtgctgtctgccggcagtgcggggtggggtttgggtgttgtcctcagtacccagatccagatgtgggctgacgcccgttttcattctccaggctgcgaagagacgggtaggggaagcgcttccggccccccaggctgggtggaaagcgactgcaggcttacggatctcagaaagagtggagagcccctgccactttattccatacccccttgcgttttcgaacccctaaggtcatcaacgacccggaaagccgggaggggatcacccaccccactttctggggagtgcgtgcgtgggcggggaggcttatccaagtaaaagggggtgggcaaaacggaaagggtcactttgacgtactgagtctctgcgaaggcctcaccgtatgtgccggcagccgcgtgtcctggtctccgccgggtcacgaccttcggagtttccgagtgcgcctcaggcctgggacgcgcggcgctgtctccccagtctcggagccgtgtgcgcagcggccggcagggggcactcgcgtcacggggagcccgcccgccgcgcccgcctggcttgacccgggctttggggctgacccggagcctggcccggagctgcctgcggccgcggatgccggcgacatttggggcccggctaggcacagagcaactggtcgccagggaagggcgggggggcggcctcccagccggagacaaacaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccgggagcccgagccccgcccttccccggccccgccctcgcctcccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcccagggctcctaactttggcaagagcgtcacgctggggcagggcgcgcaggggtctggatccgacggacgtcccaggctcactgtccgcttccgcccccacaccctgcaggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggtaagtgacacttccttaggccgacccctccgagcagggccacgccg

SEQ ID NO: 5500 - DNA, 1266 bp, Homo sapiens
  source 1..1266: mol_type = unassigned DNA
gcggcgaggagggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggccgggccaggctccccacgcgccgcagcctcggagcacgggctccccggaggggacttggggcgtcccagcccaggaggaaggacccggaagcagaagcggagccgcgagtcgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccg

SEQ ID NO: 5501 - DNA, 1316 bp, Homo sapiens; identical to SEQ ID NO: 5378
  source 1..1316: mol_type = unassigned DNA

SEQ ID NO: 5502 - DNA, 10783 bp, Homo sapiens
  source 1..10783: mol_type = unassigned DNA
tcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccctcgcagcaccgccctctccgcgtccacccgcgcggccgacgccgccaggggccctgagatcgcggagacagcgcgccctggcgcctggtggggccctcccagtggccagagcgctcctggaccagtcggctgtggtctgtgcccaaacacgatggaaaccggggctgggacgggcggtggtacgcacgtggaggagaagaggcatggcgggaaaaccacagccgaacacaggtcgactcgcacctcccaggcacccgccgccgtctgactcgcggctctccccaaggttccgactcgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcgtacgcgggatccgcgcgcgggcctgggctgctggcccacatttccccgcttgctcggatggcggcgctgaggcctattcgcctctttattaataacgatgcctcgggagggaaaaaatagagcctttaaaaatcagagtgcgagagaggagtgtgtgtgtgtgtgtgtgtgtgtgtgtgtgtgtgtgtctcggggcgttggtgaaagcaataaaactcagatcgcttccttggcgagatagcggcggctataatgcgccggggggatcaggggtttatttgcagatcctggataaaagatgatatatcgacacggtttagagtgtcactgcgcttggcctctcagggagccacaagtacatatttcctgaaataccgcccagcacagtatctaatccgcccgccacttaacaccgggaggggaacttcagcagcgcacaagcgcgctcccggtttcctggttctgggtggggagagcccaaatgagaaggatctggtatgcctagacgccccctcccctggcctttgtcttcagtccaagtaatcacttagcgatgggccttaataaatacgtctgagaactgtccttatgctcggtaaatattggattagcttttcaatgaccaggctcttgaaaaggctcgagaaatacacaccaggtctcaactaagcccaacagtcaataggtaaggaaataagttatttccccatctgaggtggggaatgttgggaagggggacttccactcttaccaaattatctgattctactaaatatgaccgttgtactaaataggaaagggggcgcatccaagtttcccattagtcggaatttccaccagctcagttctgctcattaagggccgagtgactttgtggggaacatatctgggttccagtttttatttccacagagctcagcataaactatttttgtttagtacatatggtttatttggggactgcttatgggagttttgacctggcaattgcaggggagaaggcatgacccaaattatttccgactgcctcgcgccaatttggaccgcttagaggaggcaaaaaatgggcaaattccttggaagccctgctgtgtctccctggtactgaattttgtaagcacgcgatacaggagacattgaaaattaaagaggaagtatctccctcctccaacatggggagagacgctgttggaagaagtttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcccgggactgagcggcacccttggcctctcagaacctttctcgcggtgagtggaagggcggctccgcgcgcgggcgcttcggggccggtcggttgcgaaatcagggggtggattttcatctacccaggagccgctaagcccgtaggggaccgagcatcacccaggccctgggtaccctgagttgcctcctgagccccaggacggtccgatggtgcagagctcccaggcagaagttagtttcctgatacacacacagcagtgagcaaagtgcgcacaagtgagccaaaccctgaagacgcaggttcgcggactcccatcccagcgttagagtcaaggagacagaagagaggaaggagagaagtgaggaagggagagagattatgagaaaaagagattatgaaagtagagaaagagattatgagagcgagattatgagaagagagaaaaagagagattttgagagagagagacagaatgagagagatccaactttcagtgtcacggggcctaggcggggcaagcgccctccgaagccatcaaagacaggggtggctttttctcccctcctccagcctcctccccaatagatatagcacgaatttttaatgcgtcttcctttcacagacaacaatacagggtttgaaagccggacacaatttaggttttgtgcgggtccctcctcgcgctccctcggcccagctggccatatggaatccagcatggagcccgtggatgacaaagggacccagtgacaggcccaacaaaaccccaaggagacttctgcctgactccgggattcactgccggcgataagcgcgctgaatggtgcggggtggggcggggggtggggggcgggccccttctccttcttcccctctctctgtccccgcgatcctttctctgtccctttttaatatgcacgcctctaacatctccggctcccagctttcccattgtgcggttttgtaccgcccgctgtagattgggcgaagatagactgctgaagcggaccccgcgccgggtgcgctcccagggcgctggggttagggccacacagggctccgcaggcgcttttattgactccatggggacccgaggacagagagaggcgggcgccgggtccacctcccgggctcccggccggccacaggagcgcacacccagattgcaggcccgcggtcctggccacagctccaaatttgtcctcaatgagcaagtggtggaagcctgccagggtgaggaccttccacgcttcccccttcctctctggaaacctgagggtctcttgtgatcattctcaccctggaagccctggggcctggaaaagtcaaaatggcctcaggccttctgacagctccgctccaagagacttgaaaccctcacctttcctcccaagaggattttgggattaggggaagttgcaagtggatgttgagtggttagtaccagggcaggttgggcgttcaattattgcacaacaaactatttgggagaaattcgttggcctttaaaaacagtaagacataagcccccaaacattgccaagctagtgtggagaacaaagggagaccttttagcatttagaaaaactgccctttccccgaggatgagcccggagatgggaaaggacctttactggggtattagaaagacttccgagccctcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgcccacttcccatccggggagctcaccccacccccaaacctctacttcctagcaatccacccagttccacgctcaagggctgacctggggggaccgcacaccctggttcggaccgccgaacgctggagggaaggaggcccgggatccagtccccggagagaggcctggaagcccggaaaggatgggagcgtaagggaagggagaggcatggtttgctgggattgccaaagattctcgctccctggcttcctggggccaaagatcctagggagggctgcagtatcccctccctcccccgagcccagaaccccgcgtacttcccccaagccccctaagccaaagcctcgcgcgccctgaccgttcccacccccagccttagcggtctcctaggtcagcaccagcccgcagattttgaaaaggagtggggagtggggagaaggcagccagtcttaacctcagacccccacccacccactttcttagcgtgaggtaagtcaaatgtaacaaagtgaaagtcatcgagtgtagtggcttcaacagcttctcaggctgaaggagccactcatagatttgggccagcgaggggggtttgctctcctcgcctttgcggctcccgaagtcacttttcctcccgtagccggacgctgccgcccggggttcagacagcgcgcgagaccaggggagatgcgggggagggtgggcggccctgggcttccggccgaccgctcgcaggccggaggccgagcgttctcctccccgccccaatcctaggcgcggggtgcagcctgtggtcggaggggcctgcaccgggagccccgcccgccccagggccccggtacccccggcctccccgcccgagaggaaccgcctgtgggagccccgcgggcggccgggcccggctcccaggcccaggcctccggcccggcgcagtaggacaaacgggagggcagggattttttctttttttcttttttaaacacaggatttttattaaaattcttatttaaaaaatcgaaagctttctgcgcccggcgctgttggggaaccgcgccgaatagctgagctccaagttcggggctgaaggcccggaggacagggcagagggctccctgcctacagggttttcttttccatatttgagaaatgtttgcacaataaaataaaaagagaaaggaagaaagcaggggaaaacgcaaaaacaaaaacaaaacaaaaaacaaacccaaacaagccacaaagaaaggagttggacccagacgggaaacaggccggtcctgaaggtcattttggcaacaatcaccaccgatatttacaacgaaaagcgaaatctgccaccagttgtcagaacgtttacatggccataaatatttagcattttcttatttttttttaaaaaaaggaagaaattctctgtatttttaaagtgttctccacttgctttagaagacggctgacaatatcgctactcacacaaacatattttacaaaatgcacgaaagcaggggtggggggtcggtctttttctcgttttcaagtgacgacattaacgctgggacggtttggtccccccggggagaggcaaagaagcgaagctgcgcaaacattctgtaaacacggcgtagagttcagccctctcccaaggttcagaaggagaggcatgggcagagctgggtgggtggaatctgccactccaaggagacgcaggcaacctcccggcgcctccctagtggagccgagagtcaactcgactccataataataattataataataataataaccaccataaggaccgaggcctcctcgccgccaccgccgccggggtggggcctgggcctggggccgcgagtctcgttggggcggcgctcaccaagtccactgctgggcctggaccagggggtgtgctgtcgggtactggggggtgctggccgagctgtactgggcgttgtactgcatgtgctgcagcgactgcgcgctgtaggcagaaaagggaatgcccgcctggaaggtggcggctgccaggtcctgggctttgagcgcgtgacatggtttgccgtccctgaccaagacgggcacggccacccggcgcggcgagggcaggggcgtcacctccatacctttctcggcccgggcgcgcttcatcttgtagcggtggttctggaaccagatcttgacctgcgtgggcgtgaggcggatgaggctggccaggtgttcgcgctcgggcgccgacaggtaccgctgctgccgaaagcgccgctccagctcgtaggtctgcgccttggagaaaagcactcgccgctttcgcttcttgccggcgtcccccccgccgcccggggtctccttgtcattgtccggtgactcgtcggccgagggctccggggacttggagcttgagtcctgagggggcgccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctgcggctgcaggaatggaggggaccacggcctcggcagccaagttttgctacttacgggagtactgaaggccctcggtgctggccagccagcgcgtgtacgggttgtcgctgctgtcgtagaaggggttcttcaggggcaggctctgcaccgcgtccagggcgccctgccccagcggcccggccctcttggctggctcgggcccctcgttctcttcctccggaccttcggccacagagccctcctcatcgttggtgtccggcaggtctaagatgtccttgaccgaaaaccccgtctttgtgttggtcagcgacatggttcgagaccccaaaatttatgtcgcaaagttgtagcttcacttggtcaattcgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggagaaagagagggagggagggaaagaaagagggagggagggggagcgagagagggagcgggagaagggtggaaaaaagggggaagagacattaaaaacgcaaaggttggccacgtgtgggcgggtcttgggagtcaagtggatgaagacagtatttgcagatgtgaaattgtgggttttggggagctccgcgctcccagccaacggccctctagagcaagatgagaggtgtaacgtgtcaattaattgcaaagacggggcgagcctttttttttttaaacccagtatttacatacaaagggccaccgcgtcgctcgcgagtccacacacttgaaagggccgttttaacaaattgcatcttaaaaaaggtgggggtggggaggaggaggggagaaaacaaaacagaaaccaggaggagggaaaaaatcctctttaacattcaccggttcctacctccccgcccccgcgcgcccacccccggcaagccggaaaattggcgatttgtggcgcctttggaaaagggggagggggcgaaggccgagctgcggaaatctctcctttccatcgttggtggttgcctaaacaagatccggttcaaatggcaagagcccaacttctgtaagcctcctaggtcaatattttggttgaggcttaaggatgagtgctagaaatgacaaggcaagtaattgattccagttaaccgcgagagagcccaaaacccaggagagagctccgctccgggccggccagagccaccaccaagcgacccgcccccttccagccgccctttatttgctaaagactcatttatttccttcactccgcctccccccacctcccacccccaaccccccgcctccacctctctgcggccaaggaggacgcgcagttcactttctgctttgcgggcggtcccggggagggcggggtaagagtgaggagctccaacttcgtctggggtcggaccctggccctgctgcctctgggctctgcgggcctctttccccgggtggaggaaagggcagacggccctgctctttcctgccctctattatccctccctctccggccccctccctctccagcctctggctagaggtggagcagcgggaaggcggcggggcgggattgcgggggtgggggtgggggttgtgtctccagcctgggtgaagacccagaaagctgcgggggaggggggtcgctgggtggcccgacgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagattggctacctgatgctcgttcgccccagaggagtgtcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccagcgctgggtgagggcacctctccccgagccgctcggcggctttctgcagccctagctgcctcgcccccagtatgtgacgtgggtgacaatggcccaggttagagcaagcccctcgtcggcgcgtcctgggtggtcggacccgggcaaacacaaatacaaaccgattgctaagctgcggacaatgagcgaaatgtagacaaatgtcccgctcccgttggaagcctttgtcccggctcg

SEQ ID NO: 5503 - DNA, 810 bp, Homo sapiens
  source 1..810: mol_type = unassigned DNA
gcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgaggcgggcttggagcggcgccgcagccaatccgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcg

SEQ ID NO: 5504 - DNA, 1142 bp, Homo sapiens
  source 1..1142: mol_type = unassigned DNA
tcgggggagaaacctcggcccacagccgggatgcgcccccgccggggtcaccgcggcggcgaacgtcccggacttcgcatcccggtgaccccttgggatgaaccgaagccggacccgcaccttggccgtaacaagcgcgctccacgccgccacgcaccagcggtgactcccgagtcctctgtcgccctggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctggaagtcgcccggggagcccgctctgcctcccggagccgccgccaaacttcggtcccggggcccggctcagctcccgccctcggagccacggccgccccgtctctgcctcccggtccccgccgggctccgagtgcgccgggagcgcggcgcagcagccgccgagggagggagcgaggcaggaggcgggacggagggaggggactgagcgcggggcggggagaaggggcgggcagccgaaagcgcagcgcctggcctcgcctcgcttcgggacagtggcagcggcgccaccgtcacggggcgtccaggcgcccaatcgggaccccgcaccttggatccgggggccctggcgcgcctgctggattgcgctcctcgcggccagttcctgagcccgcgtccgggactgctcgcgctacgccctccctcccgttgccttcttccccgtctgctctcccaggagcgaccaccctgcggccccttcgcctgcacgcgacagccttcaaggtccccgcgctccgctgccctggagcttcacgcaccaggcggcgcggcagcctcctagggtcgcgcgccctgtcagctttccccgcggtgcaagtgctccggtggtcccgggtccgcgcccctagcagcaccgccccagggtctacatgtgctagatattaaaaccccactctccgctgccccggggccgcgctccacgcg

SEQ ID NO: 5505 - DNA, 2885 bp, Homo sapiens
  source 1..2885: mol_type = unassigned DNA
acgctgtagacaggcgcgttgcagggcggcggccctctccccttggcattaccgacagccgaggaaattgggttaataaagccggatactgcggcggggccgcggggcgcaaaccggcgcggacagatgggtccccgggggcaccctgcccggctccctggatcccggatggtggcagagctgggagctgcgcaggacgggcactgcgcagcgcatctccgttcacacccggcggggcacggggcccgcagcagcttactcacccgtagcccggcctcctccctcggaagggagaggggatcggtggggagggggtttgctggacaccagggctagacggggccctcccctgaccgtcagggttaagtagggcgcgggctgtgaggaccctcctccacgcagccccccgaggcagagggcccgcaaagcggtctccatccaactccaccccgcggacgtcccaggcagcggatggcggcgggggggggaggccaggggacatttaggggacaaattcctcagacttcgaggcagccggcgacggcgtccaattcccaaataaatagaacaaactcctacttggaaaaggccttccccggggtcttcctgcgcccgcggtccagctcctctgcagacggccatcgtgggctctccgcagggctgcggagtctcggagtcaccgaggtgggaggtgccggccacgcgcgtcctcaggaacagagcactgccctgcagtttagcacgaagggccggctggagcgggagcgcgaggcccactgcaagaggatcaggagccagtaagtccggcttttcttcgtctccacctttcgtgcgcccggggccaggaccgcctgtccggaatctgaccagtgcccgtcctcgccgtggccctgggaccccgcggtggtcttcttttggggacgaacggcagtgcccgaaggatgctctacccacccccgttcctagacttgctgggtcccgacaatacccagtgggtgccgcgagttcccgggcgcagagtccagcgtccggctctcgagctcaatcccgcgccccgacggccttggcgcttcccgctgcgctaaactgtccaccgcgcacaggctggaagcgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcagcgtggcgatcttggagagcttgcgcaccgacgggctgtgcgcgtaggggatgacggctcgcagcccgtccagcgcgtcgtttaggtcgtgcatgcgccgccgctcgcgcgcgttgatgctgagccgcagagaccgctgctctcgcggccgccgccgcccgtccgccgcgctccctggcccgcgccgccgccgccgctgctcgaaggcgtcgtcctcgtccccgctctgttcgccgctgctctccgccgcctgagctggggcgcgaggtgcaggcgccgcggggaggtcgccgcccgggcccggagtgccgtagccgcgggccgcttcgggttctcgcgccgccccgtaggcgagacccgcagccgccgccgcgtagccgtggcttagtgccaggtacgcgtcccccgacagcgacttgagctcggccatggccgcgccgcctgggctcgggggctcgccgggtgggcggatgctcatgtgggtgagcagcccccgaggccggcccgagcccgccgctgccgctgccgctgcgatgaggctcccggctctgcgcgtcggtctggcttgcctgcgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcgcggggcggcgcggggcggcgcgcgcggtcctggagcgctagtacttgcttctcgactccccggccgccgcctccggccgccccggggattccgccaccaaacgcacgcgtcccaggtgggcacccgcctcggtccgtctttgagtctgaccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcccgcacactccctgctcggggcgccctgtggccaggcttgaggggcagagtgagagggagtttctagaacctgttgaaaaacgccacgagcgttgcaggccggggagggcgggaaggtggagggcagcgcggcctggggctccccgggggtgggaggggagctctgtgagctgcaggaccgcctcttccctgccagccgcttcctgggcatctatcagcgaaacgcgtgaggcttggtgggctttcccggagcctccg

SEQ ID NO: 5506 - DNA, 1460 bp, Homo sapiens
  source 1..1460: mol_type = unassigned DNA
acgcgtatgagagagcagagcggcagcgacgcggtcggatcggtcgcgggggctgcgggaggaagcgctgcagggacccgggcggcgccggcggcctagccggagatgcacgcgctgtaatagaccgcgctgctggcgtccgacagcgcggagatcaggctgctctcctctgggcaggacatggcgcgcgggcccagtttggccagtgccacgtggtacgggagcccgggggcgtcgggccgagtccggctgcagttgaggtactggtcgaactcggtgaggtccacgtcggcccacagatcggcggcgggccccagcggctcggcgctctccagcggcggggcctcgggcggcggcgacagcgggccggggtacgggccgggcgtgcccagggtgccgtagtacaggccagcgagcggcgccgcggggggcgcggtcctgagcgcctccgccaggggagccccgtagcaaccgccggggtcccgcgacaactcggtgggcgcgtagggcgcgcggaagggccgcagcgcgcagtcctcgggcgccgcgggcggtgggaagaaggcagcctcgccgggctccaggccgtccagaggcgagcgctcgggcgtgggcagccccaggccgtcgaactcggcgcccagcgggggcagctcgcggaaggcgcgagccgagccagacgccgcggggaaaggctcgggcggtggctgcgggggcgctaatcccgggagcaggaggccgggctccagccgccgggccttgcgcgcctgcttcttgcggcgcggccggtacttgtagttggggtggtcgcgcaagtgctgcacgcgcagccgttcggcttcctccacgaagggccgcttctccgccgcgttcagctccttccacgctttgcctgcgggccgtgggcgccagtgagtggaacgccgtcgggcgggtgggcgccgagccctccgtgcgcccgggacgccccgcgagggtttggcgcagcccccgcaccccgcggcccgggacccctgccccccccgccccaccccggcccgagccccccccgccctctcccccttctctgccgccctcccgccgctcacccagcatcttgctgagcaccgcgttgtgcaggtccgggttctgctgagccagccgcttgcgctcgtcctttgcccacaccatgaaggcgttcatgggccgccggatgcgcgactcgtctgccgcctggcgttccccgcggccggccgggctgaggccatagcgccccggctcggggctgcgcgggggactgcgctgcgggctgggcggcgaggcgggcgcggcgggcgcggcgagggcggcggggccggcggcgaggccgcgcgtgtcagcggcggccccgtgtcccggggcccatgcacagtcgcggcgggcgggcgggtcgtcctgtgcgccgtagccgggcggcgatctctgcattccagctgggcgcg

SEQ ID NO: 5507 - DNA, 1560 bp, Homo sapiens
  source 1..1560: mol_type = unassigned DNA
acgccttgcagtgccgggtcctgcggcgaccactgagccccttcgtcctcgccctcagtcccttcgtcctcgtcttcggtctccgctttcccagtcggccggggctcgtcgtccacgaccccgcacgtgccgccgacgtcgccctgccgattccgccgcaggaggtggaactgtagtggtgccggcggcttctcccctggggcggcggtggcgaggcgctcgctggcggcgggcagcggctggatgaaatacgcctcccccagcaggtagaaggcgccgcgcacgccctcgcagaggctgagggcggcagccgagctgggatcgccattcacggtgccggagtagaagcagtgcgccaggtcggtttccggaagcggcgtctcggacccggatttgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcgcaaagttggagacactgagaggcaggcgcaggcagagtggctctgctgggacaagaagcgctctggggcgcctccggggctgaggcaacgcggagattggtgcctggcgcccctcttcggcctccgccttggctgcgatgttgctcactctgctcagggctctcccctctccgtccggtagcgcaccctggctttgcaatagcccctggctcggagccgctttccagcgagtgcaagaaccgggcagccgagcggtccttttatagtggaccagtgaaacccccacccccaccccactcctcccctttggcccttttccatcccaaagacgccgcccccggctccgttggtgctaaaccgcgctccgcgctgcgggctcgggagggggagggggcagcctccgcgctggctccacgccactgctcgtcaatctaggggcggaaggggcgctgtgaccagcactttgtactgctggggccgctccagggagaagactctcccttccaccgcttttctccctcgccggtttcctggaccacccttcctccccaccgcccggttgcggtaactcagttaccgcgctgggctgcggttcccaggagggagggttcggttggagaacg

SEQ ID NO: 5508 - DNA, 5118 bp, Homo sapiens
  source 1..5118: mol_type = unassigned DNA
ccggtgccgggagccttgcctcccgccgccacccctggtcagctctgcgcaagaacgtcgttctgtttggcagccaggccgagacgcagcctgaatgtgagcaggaactcggagaagggaagggagagaatcagaaagaaggcccgggagggacccgggaagcagtgggaggtctgcgccctggagccccgcgagagcccgccggtttggcacgggctcctcccgggccgcccggcggtccaacaaaggccggccccgacacgcacccggtcttttgtgggagagaaacacaaagaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccagggccaagggagcccaggggcgacacagacctccccgacctcccaagctactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaacaaatgtctgaattcgaaatgtatgggtgtgagaaattcagctcggggaagagattagggactgggggagacaggtggctgcctgtactataaggaaccgccaacgccagcatctgtagtccaagcagggctgctctgtaaaggcttagcaattttttctgtaggcttgctgcacacggtctctggcttttcccatctgtaaaatgggtgaatgcatccgtacctcagctacctccgtgaggtgcttctccagttcgggcttaattcctcatcgtcaagagttttcaggtttcagagccagcctgcaatcggtaaaacatgtcccaacgcggtcgcgagtggttccatctcgctgtctggcccacagcgtggagaagccttgcccaggcctgaaacttctctttgcagttccagaaagcaggcgactgggacggaaggctctttgctaaccttttacagcggagccctgcttggactacagatgccagcgttgcccctgccccaaggcgtgtggtgatcacaaagacgacactgaaaatacttactatcatccggctcccctgctaataaatggaggggtgtttaactacaggcacgaccctgcccttgtgctagcgcggttaccgtgcggaaataactcgtccctgtacccacaccatcctcaacctaaaggagagttgtgaattctttcaaaacactcttctggagtccgtcccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaaaggtgcggctgcgtggggcatcaggttagtttgttagactctgcagagtctccaaaccatcccatcccccaacctgactctgtggtggccgtattttttacagaaatttgaccacgttccctttctcccttggtcccaagcgcgctcagccctccctccatcccccttgagccgcccttctcctccccctcgcctcctcgggtccctcctccagtccctccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcg

SEQ ID NO: 5509 - DNA, 1423 bp, Homo sapiens
  source 1..1423: mol_type = unassigned DNA
ccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgcgggccgcgcgggcaggtttggacactacgcgccctgctcgggtttaggacgcggctggcggctccgggaggaagaggaggaggaagaggaggaggcggaggaggaggaagaggaggagggaggcggaggagcagaggctgggacggccggaggagagagtccggccccagcaggaaaggaacccagcacgcgactactggaggggcgaggagcaagggaaggaccagaggggaggagagggggtcaggggagggaaagtgtgggagggggagccgcgggggtgcgcgctcctcctaactcggggtcgcttttagcgagaagtgatatttttccagcctcattgaaaaccgttgcaaacattgaaaatagtaaaagtgaaaacggttgcgacactaagacgtttataaaatgaccgcggactgccctcgatgctgatgagaactgggacgacgtcgcgcagagcgtccggagggagaggcgcggtgcccgggacctcggtcgtggggaggagccggatacagccgccgggacgcggggatgccgagggcaccgcggcctggtctgaccgacgcacgcggtgacagccgcccttgggagacgacggcgtctgcaaccagcagcctccaaagggtgcagccaggaggctcagcttgtccgcctccggggctcggggctaagccccttccagaagttttcgtttctacgcgaattccgaccgcaaaatccagcttacctgagcgccgctcctcttctctcatgtccctcgggggccgtcacgaccgtcccggagcgatctctaggaacctgtcccgcagcg

SEQ ID NO: 5510 - DNA, 1384 bp, Homo sapiens
  source 1..1384: mol_type = unassigned DNA
gcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcg

SEQ ID NO: 5511 - DNA, 1361 bp, Homo sapiens
  source 1..1361: mol_type = unassigned DNA
gcgcccccgacccccgccgctgggatttcccgccgcagctcctgctccagtctgtgctgcgggtggggtcgggttgagcagcccggcgccccccaccgcgccccccaccgcaccgccctcgatctaaccccgcccccgggcgctcattggcctgcagcaccccctccccagcctgtgaagtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtggacggacgcacctacgcggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtcttcgtttcccgtggcgcggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcg

SEQ ID NO: 5512 - DNA, 1175 bp, Homo sapiens
  source 1..1175: mol_type = unassigned DNA
acgctgtctggtcggagcgctccataactcggccaatggggagggagtcgcccgctaagcgcctgtcaggcctcgaccaacgggatgggcccttcccgccagagcacactgctccaatccaggagcggctgcaggacctgagccaatgagacgcaacctccgctagccgcgcggtgcccggccaataggaggccgcccgtgcccggtagcgtgggaggtgtggggtggcgggcggcgctgcgaagctgagggagctgcgcgcggacgagccacagcctgctacagggtgggtgcgcccgccctgcccagctcgcccgccgcctcccggctcttcttgcgcggcggcttctggatgggggtcttcttccggggggtctcaggcgcgggcaagtcggtcgccgccttctcaggccccggggtttcggtcgctgggggcgcgcgggcgggcgaggctggcggcacggagcgcttggctttctgtgggggcgccggcttttccctggggccctgcgcgcccagggccacctcggcgcggcccaggctgcgagtcttgccgcgcacgtcagcggccaacatggaggcagcctcggcgcgcttcgcgggggaccgccggcgtccgtgggctccaagaggccggggcgcggcgcgcgctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtacagagcccctccgggcccctccacgctggacgccgaccgctcgctgtcggaggacgcggggaggggtatcgcctcctcggcggaggctggcgtggtcaagggcacaggggacggcgccggcgcctcggcagggacagtggggacttcggggtcccggctctccg

SEQ ID NO: 5513 - DNA, 1087 bp, Homo sapiens
  source 1..1087: mol_type = unassigned DNA
tcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcaccgcctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtcgacaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctccccgcgccccctcggagttccgcccggtcacctccacgcggccgagctgcaagcg

SEQ ID NO: 5514 - DNA, 693 bp, Homo sapiens
  source 1..693: mol_type = unassigned DNA
ccggcagccaacgctcagcccccgcctcctctctccattccggaccccgcaaccgcgaggcgagagagcagcgccggcgaggcactggctgggctctgactgtcacgttaattccctgctgctttttctagtccccagccgcctcgcccctcctccctcattcccagcctgggtttggaggcgatttccctctattgactgagccgactgcatctctgggcaagcggcgctttgcctctctcctgtctttgtctgctcttcctgcaaggctacggcgcctggagcagggtctgcagcggccgccgcagcaacgcgagccaagtcgtgccccgcacggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactggcgcaaggtaaggtgcagccgcctgttgcttttcgcagagcgcgggatcatccctctgcccgggtacctaggccg

SEQ ID NO: 5515 - DNA, 5065 bp, Homo sapiens; identical to SEQ ID NO: 5483
  source 1..5065: mol_type = unassigned DNA

SEQ ID NO: 5516 - DNA, 307 bp, Homo sapiens
  source 1..307: mol_type = unassigned DNA
gcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacg

SEQ ID NO: 5517 - DNA, 1563 bp, Homo sapiens
  source 1..1563: mol_type = unassigned DNA
tcgggctccgaaaacggggggagggggacgacgccccagaggcccctgagcccctggttcttcccgaccctaagggcttttctccctcggttcccaggcggcgacggcgggtagcgcgaagcagcaggcgcaggggcgctgggatggggatgtctctgcaggtctaaggttccccttgggagtctaaacaaagactacggcagcgccgtcccctcccccgggaacccgacgccgcgcggccacagggggcctggaggggcgggcagggcctcgcagcgcacccagcacagtccgcgcggcggagcgggtgagaagtcggcgggggcgcggatcgaccggggtgtcccccaggctccgcgtcgcggtccccgctcgccctcccgcccgcccaccgggcaccccagccgcgcagaaggcggaagccacgcgcgagggaccgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccgccgcggctgctgcgcgcgtccccgcccagcccagcccagccccgagcacgaccccagccccacgcacgaccctagccccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgcgggagcaccg

SEQ ID NO: 5518 - DNA, 512 bp, Homo sapiens
  source 1..512: mol_type = unassigned DNA
ccggcccaagtcagcgcaccccgccgactccctgcccagtccaaactccgaggctgggcaaggcactggatccacggctggaccgacccggggcagcctctgggtgaacagcagcgtgtccgtcggcagagaaccgagaccagcgagccgaccatgcggctgcacagacttcacgcgcggccgagcgcggtggcctgtgggctcctgctgcttctcctccagggtcactatgaggctcccgcggaggggtgacagggaccgggctcagatctgccaaatgctgcggaggcagaacctgacagtgcgggagggcaggcgcctgggaggtaggagctggtggagatgacagcgtggaactcgtgagccccacgcaacgcctccctgccgcccagggtgggctcctagaagcacagaaatggtcgggctgcgggacaccacagcgaggaaccagcggagtacaggggccccaggagcgccgggacatgccaggccgggtagacagcctcgggtcg

SEQ ID NO: 5519 - DNA, 1070 bp, Homo sapiens
  source 1..1070: mol_type = unassigned DNA
tcgcgagaagcacaaaaggggaggggcgggccgtgtagccaagaggacggccaaacggggaggcctcctctttgtcctcgcagatgctggagcagcgactggcccgggagatccgtgccctggagagaagcaaggagcagctgctctcggagagtgagcctcccgcgccaggtgggcggggggagggggatgtgcccgggcctcggccctgcccctgacgcccgcccaccgacagggaggctggtgcgcgccaagctgcgggaggtggagcggcggctgcactcgccgcctgaggtcgagggcgccatggcggtgaatgacgggtgagaggggaagggaggagtgggcgaggagggcaggggcagggcggaggggaacccgcccaggtcccccgctccgcccccgactgccgcttccccggcctgtgcctccctcggcgtcgtcgggtctccgcgtctcggtggcttcctcctcgtcccctggactctcgctctcttcctcctgtctcctcggccccttctccgcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatgctcgcgttctccgcggagtctgtgctacaccgtggagcggggcggggcgtgctgggatctcgaggcggggcctctgccggacccctcccaccagtcgagccccgggcgccg

SEQ ID NO: 5520 - DNA, 766 bp, Homo sapiens
  source 1..766: mol_type = unassigned DNA
acgaaccatcatttaatccgctggcgccgctgctgctgtcactggctaaggccgcggcgaccgacgcacagcagaggcagcacagctggagcgcctgcaagagaaaaggtgacatcgcgcgtgaggggcgcggcggggctggcgtcgggcgccccctgccacccgctctcggagctccgctcggcggcacctgccttggccacgcgccccagtcccgccaggcccctcggcgggcccgaacccgcagccgggaaggcacacgcgagcaggagggcgcactccatggtcaggtgcggacgcggcggctgcgggtggccagacgcggcaggcggagcgcacgggcggcgcgcattctttccgcggccccggagctcggcgccccaggtgcggctccaggtgagagccgccgccgttcacatcgcagcgggggcgcgctgggacctcccctcctccggccgcctgcgcgccctcccttctcccggcgcgggcctgccgagctgcagtttgcggcaccccagagggtacggggggctccctgggccgggactggagcgcaaacggttgggagactgtcggtgtctgcccgcccgtctgtgcgtctgtctgtgtcggtgtgagcgtctgaggcgatggggaagacagcgccagctggctcccccagcgcgccggagccgagcgcccgcctctccaccgcgcggtgattggcgaccagcggctcccgggctcgtccgagcccccgggctggtgcaagggcgtgggattcccg

SEQ ID NO: 5521 - DNA, 363 bp, Homo sapiens; identical to SEQ ID NO: 5294
  source 1..363: mol_type = unassigned DNA

SEQ ID NO: 5522 - DNA, 2919 bp, Homo sapiens
  source 1..2919: mol_type = unassigned DNA
ccgagccggacccccgcggagcacttatcagggtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggtcgacttgctgcagcagctggttcttctccgactccaggacgtgtctctgctgcaccctcttgaagcggcaggactgggcatagccgcggtttttcagggtccgcctcttctgcttcagccggatcacctcctccttgctgaccccgcgcagctgccggttcagctcgcgcacagacatggtcaccagctgctcgtcggagaagcggtcgtcgaagtgcaggccgccggcggcgtggtgcgggtgcagggcgccccccgcccccgccgcgcccccgccgcctccgccgccgccgccgccgccgccgcccccagcgctggccgggccaccgccgcccgcgcccccagcgccaccggccgaggcggccgcgctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggccagctgctgcgccccgcgcgcgtagccatcgaagccgccctggagctggtggctgttgctgatgagcgcctcgaccgcgtcctcggggctgaagcccagcgcctcggggttcagctgctgcgggtagccggtcatccagtagtagtcttccaggtgcgccttctgctcgctgcccgagcccgggctgggcgccgagaagctgggggaagggggcaccgagctgcacggcgtgctcatgggggtggaggacagcgagcccccggcgatgagacggccgcactggctgatgatgcggtcggtctccaccggttcctttttcacttcaaacttcatcagatcgaagtcattaacatattccatggccaggggactggtgggcaggtcggagttgctcattgccagttctgatgccattctcctgccgccgccgccgccgccgccgccgctccgccagatgggctgcaggagaggggccagcgggctgtgctgggtggccagcgggtgagccagcttgccgggctggggcgcttctagcttgcgcggcggtggctggcccgaaacctccgagcgcgctcacacacacacccccccgccctgcccgcgccccccgcgcccgccctccctcccccctgctcacgccaatgtgctccctcgctcgccccggcccctccttgctcgctcgcctccttgcgcgccgagccggcggcttcaggctcgggaagatcctccgcgagctgcggtggcggcggtggtggctgcggcggcgaagctggaggagcccggcccggtgcgcggcgtcccccgctcgccgctccgctgcgcgctttgcataaggaagggctcgcctcgccggcccgggctgcaggcagggcgcgcgcggcgtccgctcggggctggaggcgcggcgggcgtctgtccgggcggcgcgggccttggcacgggggagttaacacttcatgcttctcgcctcctcttctgcttggctctctttattattttttttctttcctctctctccctcgcgcgctctctacctctgtgcaaagtgcaaggcagaggtgcagcccgactggaggagagggaggggggagtttagttctttcttgcctttttttaaaaaagcaaaatagcgaagtcctggggaaagacgaggcagagagcaaaggggggagggggaggccaagccgacaagcagcccgagctacagctagaagatgaaaaaagattttaaagcctctgatccagcaagaagagtttaaagcaattgctgagttttatagcactcgtgacgtcaggtccaaatgagaaattgactggcactccgggccaatgggaggcggcgagagcggccgcgattagcataatagtatagaaacaaggaaacttttcggagctgtcaatcagggcccaatcagctgactgtcagctgggacgggctggcttaacccttcctgcgccgctgcctacccgggagggaacgaggcccggcgcaaagtttggtgtaagaggggaaggagtttttccagaggggcttcggcaatccgggcggacctgggagggcggtttgcttttctttggagcgcgagacaggcctcccatccggagccccagctcgctgggggctcactcggctgggattggcctgattcccctcccctgcctgccctccacccccaggattgtgaattcgcctcccagcttttcctcctcgcaccaactctggtacccaggtgtctgccggggaccttccttccctgagcctggccgtgcccggcgctcaaacttggccccaactctttgtccgtctctcgggcgcccgtgcggggaagggaccgggaagggagggatgcagtggggtgtccggatcggggctgcgggctgggcgccgcccggccatgcgcctgcccagaaggctgggcatccgtggagagggaaagcccattttatccctctctttacaacgaggtaaaataagttgtttagaggccattcttcacggagaccggctgcccgctggcgtcgcgtgcccttggacagagcgagcgcctatgcgagataactccggggaagctcaaagtcaggtcagccgggctcagccttccggctcctgactggccggagtttggcctttgagactcatattgcgcgctcg

SEQ ID NO: 5523 - DNA, 2267 bp, Homo sapiens
  source 1..2267: mol_type = unassigned DNA
ccgaaaaaccggcccccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccacagggtgaatgaggggtgggcacagcccggccgcggccccagcacacacgggcggacgcaggggcgggggagcgccagccccgcagtgtgttcggagcccagcggctctgagtcgccgccaccagcctggccgccttctgctccacgtaagtgaagtcagccgtctagggctgcgtttccagccatctgtccctccacagaggctcacacctccctccccgctgttcccacagcctggctcggggcctgcccaacacagatggacgcttcccaaaggctgtgcgcgccatcgctgccacccggctgtgccgaggcccgcggccgtcaggaccccagggaccgcatgccaggcagggtccaggacccccagcgcggaccacctttagcctgcggggcagcgccggggacccgggcaggagggagaggagcaggagggagctctggacccccctccccagaccggccgccgccacctctgcctctcccagggccgccctcggcctccccactcccgggtctccgtcacgcgggccgcggggcctttgttaggaaaaccgggcggccccaggggagcccgcgagactcccagcgcccgggcgcgtcgttcccctcgaagtttcgccgcagcccccgcaggtcaggctctgctcacggggggctgcgctcagcccggatgggtgggcgctgggcgggttggctccaccctgccgtgggcaccaactttgaaaacggcccgtgcgctcggcgcggctgcggcgcagatccgggaacggcagccgcgggcggagtcggggtagagcggcggcggcgcgcggggcggacacggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgccccgcgcgctccgcctccgcctcctgccccccgccgccgccgctgcgccacctgcctcccgcccggcgcccatggcgctcagctccgccccggggcgccggcctggagaggggctccccgccgccgagagccgcccccaacgcctccgccaccggggcggcgccctaagaactggccgtgggggccggggctgtgcggagcgccgggagcagggagaggggagaggggcgcggggagggggcgacgggcgcgccgcctcctgcggggggcggcgcggggaggcgcaggcgggggcgagcgaagaggttgaggggtgcgggcgccgtggagggggcgcggctctggggggcggcccccgcctgcgcccaccctctccccctccgcaggccgcgcacacccacctcgcagcagtcggcggccgcgggcctcgcagctttagaaccgcggcttctggcggccgcgcgggaggctgaacgggagttggggggtgtggggggggtggggaggtggggagttgggggggaggtcgctccttcggccgccgcccccgccccctgccccgcgctcgcccccagcgcggcgcctggcccggcccggggccacctccgtgcgtggccggcaggggtcgcgctccccccgctcagcctcccgggcgggtccgatgcgaagccctcgcttcccgcgggtcccggggccaggtcatttgcatacactttgcattcatttgcatatcgtgcgtttcatgtccacctgcagaaacgccccgagccgctgctctgccctctccgcactttctctgccggcaggccccctcccccgcccg

SEQ ID NO: 5524 - DNA, 265 bp, Homo sapiens
  source 1..265: mol_type = unassigned DNA
tcgcggctcgcgtgggccccaggcgcgggatggcggcgtccagcagcgcgggtccgcgcagggcgcgcagcgctgggggcaacagcgtggggtccggtcggcagtggggcgcgggctgcgcggtaagcagctcctcggagctcagcaccagccccagcactatgcagggtacccacgaggcggaggccagcaggcgccgggcccggccaaagccgcccgcagctctcagcacccgcgcctcctgctccatcggtcgcaggctgcg

SEQ ID NO: 5525 - DNA, 374 bp, Homo sapiens
  source 1..374: mol_type = unassigned DNA
tcggggagggcagccgcccgccctcctcggcgctgggagctttcggctggtactgcgggaggagctcccgggtgacccgcgggttctgaaaccgccgctcgggagctcggggcctgcgctgcgtctacggggcgagcgagggagaactgacgcctttcgcccggatccttctccccttccgagaaccaggtaggtcgcgtttattttcaagtccgactgttttcgcggtaacatttgtgggaaacatcacggtggatcctgtgggtcgctgagttttctgactcccggtttgtcttattttgctttgtcagtgggctctgcgctcgcgttaacaattcgaatgggcacgtttctgcgtttcagaacgctgttcg

SEQ ID NO: 5526 - DNA, 1133 bp, Homo sapiens
  source 1..1133: mol_type = unassigned DNA
ccggcgcgggccgccctcgccttcagctccaatgctgctgcgccccaggccgccccgctcctggcaggccccagcctctgactcagccccccgcctagcccctgagagcagcctctccgcgggactggcctgtgcgcgcgcgtctgcggcaccgtcggaccaggggccgcccccgagcggggagcccaggaggacggccaggtggcctgaggcagaggcgccagggaggatggagaagggacacccagggcctaggcggggtgggggcagggagggcggcgggacagcaaggaagtgggtgcacctgggtgacccagctgcgcatgagcgggcaggggctcggggcgcgcggactccaggcgctggactgcggcgtggagcagcgctggggaaaccgcgccgggttcagcgaggattgctgggcggggcgcgcgaggagcgaagctggccgggggcggggcctgagtcgtgtcggggcggggcctagacccgggctggccgtggtgggcggggcctgagtcgtgaaggggcgggccttgcaggggcggggcctcgaggggcggagcttgcggtgaccagcgagggggcggggcttagagccactaagaagcgggacccagtgagggctaaacgtggggcgccgggggcgtggcgcggggcgcaggtgcacgcaggttggccgcgggcgcgcggggtccggcgggagtcccggggtggtccccgcgtggggccgggggcgtccgcgcgggcggggcgaggtcggggagggcagctgcccgccctcctcggcactgggagctttcggctggtactgcgggaggagctcccgggtgacccgcgggttctgaaaccgccgctcgggagctcggggcctgcgcggcgtctacggggcgagcgagggagaactgacgcctttcgctcggatccttctccccttccgagaaccaggtaggtcgcgtttattttcaagtccgactgttttcgcggtaacatttgtgagaaacatcacggtggatcctgtgggtcgctgagttttctgactcccggtttgtcttattttgctttgtcagtgggctctgcgctcgcgttaacaattcgaatgggcacgtttctgagtttaagaacgctgttcg

SEQ ID NO: 5527 - DNA, 2358 bp, Homo sapiens
  source 1..2358: mol_type = unassigned DNA
acgacacctcggtctgttgccatggaaacaggggcggattaaggctggagcgtggagcgcagggatcaggcccctcggctacctgagctcccgcctcagccgctcccgcagggccggggcagccagccgcaggcgccgcggcttctcagcctcctggccgggccaggcgcgggggggatcccggcggggcgccacagcctgctcgggcctgggaggggagaggcagacgcagaggctggaacagctggtggcggggcccgtgggctcccggcgtgatcacctgccctcccagggcccgggggacggcgccccgcgtggcaaccacgtgggggcgcggcgggacttccccggtgcccgcaccaactttgccgcgctccgtaccgggccgggctgctggggcgtctagctacggtggtcgcgaagccagctgtcctcaagttgagctgtgcaccggtcgcgcacactggcggcacggctttcgcgtccctccgctcccagcataatgaaagtttgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcccgggccgcgcggtcactgaccgctggctgcacgggggcgccgtgcggactcggcctccacaaagcggcagaagcaagggcgtgtgcccgcgcagggaatggaggctgcaagtgcaaaactttatcccagcaaagcaaaggtcccaggaggccggctccccttccaccaccggccgctcactctggtctccgactgacccctccgggccggatctctaggcctggccactcgatccatggagaaaaccccgtgtctcacaactggccgctgacgggagctgagccccagcagcagcccctcggcgggtgcgcccggcaaaacccaccagcccgccgggggctacttcccagaccgggagccccggcgccgggcggcgcccgggctcgcggctctttccggagcgcattcaacttcaacttgcccctgcggctccaactcacctttgcgaagcatgttggccacggggccgccgctccgaggtcggcctaggcgcactccctcccggggtccagattcaaatccctgggcgccagctgcagctaatccgagcgcgtcgaggcgggggcaagccggggatccgctcgtgcccggtggcccggccccgcaggggcatggtgagctccagccccgcgccgagggcaccggcgcccgcaagcaaccgtggtgctgcccggcagccccgcgcgcttgctcagccccggggcgagcggcttgctccgcggagccggcggcctgcttctgccacccggagcacttcgcaggcggttttgaggggggacgccgccccctggccggccggccgcagccccctcctctccgccccctcggaccaccgccgccgcggctgcagcaaaagggcgctcgcacgcaccgccgagctccggggaaagcgcccggcgcgcgtttgcaggaccgagcgatcggcggagcggggcgcctcccttcctccccccggcttccccctcctctcctcctccctccctcccttgctctctagctccctccctctcgctccgctccccgcccccgctcacggagcgcctcccatacaaaatttatgaaagtgctctcagctcgcagtgccgagcgccgtcctattcccaaggcagcagcgctcagccgcgcggcgccgcctcccaaggtgttttcactgcgcccgcccccggggaagatgctcggcccgcgtccgtccaggcacctgcccccagtccccaagccggtcctcggaccactccacgcccctccccggccccgcaggcctcctggagcccgaacccgcagcccagcccccgcccgctcgcccttcgcggctggaggtcatcgggagacgcggctgggacgcgaggaccgccgcccagagtacggatcgcgagtccgctccctgccccgtctcctccctggccagcgccccttctcccagtctcgacggctcttccccgcactgaacagctccagcgaacccggctgccccgcaccccgagtcccaggacactgttctttcgtggggagaggaggggagcaagcattcggaaagggccagctgcaaattccagggagaaggaaggacccgtgcgggttcgggtgggccgtctccgcctgggtggggtggcggcggggggtctctgatctcccttggtccacacagaccccgccggggggttcgcggaaaatggaggaggcgccgcttggaaagcgggtcccg

SEQ ID NO: 5528 - DNA, 1050 bp, Homo sapiens
  source 1..1050: mol_type = unassigned DNA
gcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaacgcttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttcctgggctctgaagggtcccggatgaaactctctgcaggcctctgggtctctcaggtctatctccccgatctccctctcctttccatctccttacttccgcccctccggtgtctctccgagaggtgtccccccacgccccgcgccctccgcaccgcgggcctcgcttcccggtcccccctggcttcctcgccacgtccgccccactctaggtgcaggaccccttttccccgctcgcactctccggcccggagctcctgggcgatcgcacagggaagcgaggccactgtcctcctctgtcccaggggctgtcgcgctccagtggacgctgcaccccgcagacgcccggcgggcagatgcggacacgcgtcttggaggggccccaccgagcctcagcagccgcagctgcccgcccg

SEQ ID NO: 5529 - DNA, 1731 bp, Homo sapiens
  source 1..1731: mol_type = unassigned DNA
ccgggcccgccccgctcaccggtaccaggcgaggcccttgtcgtagctgcggtcgaagaagtggggctcggcgcccacggcgcgcacgtcggggtgcacgcgcaggaactccagcagcgcccgcgtgccgcccttcttcactccgatgatgatggcctgcggcagctgcttgctgccttcgtccaggagcagcgccagggtccccggcggggcctcggccacggtgcttccggccccggagccgcccggaccccctgacaggccaggggactcttcttcccaggccgcctcctcgccgtcgtcgcggggcgcgggcggccggcgcctccgccactgcggcagttgcaggaggcgctttctctgtgccgccgccggccacaccgccagctccctcgggcctccggccaggacgccgccaccaggggcccccgcctcctcgccgccgccggacagccccacgacggggccggacagggtctggcagcgctcggccaggcagtagaagacgtaaagggacgtgagcagggagcagagcatcagcaagaacttccggaagatgctgcgggacagcggctcggccgaggtggagagggcactggccgggcccggaggggccatcctagccggaggcgacgtcgggcaacgcgccggccatgctaggcctggaccccgacaggtgccagagcatccccccggcgggccagcgcgctggacggaggccacatcgccgtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgccggaatcggggtcttggcagcggtgtcgaaggcgtgcgtctcagccccggccccgagagacttctcggcgcggatctccgctcagcgatcctgcatcactggctcggtccccgtgagggcacgcgcggctgccgggcctctgcgctccgtgcgctccagacagtggcgagcgacagtgacttccagccccggctttctctggtccccttgcccgcctgggcgcgttctctccgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccg

SEQ ID NO: 5530 - DNA, 3535 bp, Homo sapiens
  source 1..3535: mol_type = unassigned DNA
ccgcccctttgggcccgccccttgttccgaagccaatagcaacccctgaccgccctacaccgcccagaagcctttccacaccccctcgtcctgggagcgggttggctgctgagctctcggagaagcgcctgtatttgcatggcgttcggggtttttggtaggtagagcagcccgtcactctggaaggccgggaccgcccactccacctcggtccacagctctcttcctgcgcagttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaaccatgggggtatccgactcgaatcgtattttatgactcgttttaaattttttcctcccggagcccgagacgctgggaatgttctgagcccctttggtcggtctccgccctcaaggaacttctagagcagcttctgcttcccagatggggagagggggtgggggccgcggcgtcccggcgaggccgcagagtctgttaactttttgttacagtccgcctggttaccggaaccccaagggtgtcagacccgcctcgctcgcgagccgcctgggctcgggagggtgagccgggcgggtggcccggcgcctccgcctggcgggcgggcggcgcgcggagcgtggagctgtgctggtccctgtcgggcaaaggcgcgcactgcaaccggctggagcggcgcgaggctttgaaggcgtccgggcctccgggcaccgccgcccgtttccgcctccctgccctcggtgctgggatagggaaagcaaggacgcgtgtctccgcggggcttttacacgtccggagcaaagaatattcggggcccattgattgagaaatgagggttgcttcgaggtcgcggcttccggaaattctgttctcgagtcgggttgcgggtcaggttccaaagggacagtggccccggggtcacaatcactacctctgcccactgctttccgcagctgctggtctttggggtgagctgttgggttgcccgagcttcgggtaaggcgcgagtgggcaggaggtctagatttcggcctccgataactgtcttcgactaggggcccaggtaacgacccccacattttcgttggggtctccacccgtaaccccagccagcacgacattcagacacccctccaggcccaattagcttcacagacgctcaagacttgggaaaacaaaagaggagaagataactgaacccctctccctgtgcccaccccactgtcgggacctgggtgggttggagaataaaagagggctgaccccgcggattaaaacggctcccttcccagcctcgtcctaccccttcccctttgtccttaatggttttttattattgtcaggagttgcccaagtctcgaggtttagccaaccgtgacagtcatctttcccaccgttcccgggctgtgacccattctcgggacactggtggataagaatggggtctctggagtccgacgcctggattcacgtcctggctagtcgcgtgaaccttggtgctctcatctgtgcagtgggaataatgcaggttctgggcagggatgggaagagtgaatgcgctggtacggtaaggtgcctcgcaggcacgtgagggcctctctaatcgttagctattgtcaccgattgtattgttatgacttctaccaccaccactccccctcctcctgggatggtgattccagggccaggcggcaggctataactagcgcccttccaggtggaacccgccagagccccgaggcagcctaggattttctgagatcagacacacttgggccgggttgggaggaactggcaggaaaaggactgaacccttaatgtcaggcggttttgaagcacctggggcaagctatggaaatccccacaggaaggctcacgcagtctcttaggcggctgccctccacctgccacgttctttttgattgactaaaaaacgctgaatgaagaacgaagtcgcgtggaaaccctcgccgcgcgcctgcagcggacagcgcagcccgggaggttcggctgccgacttgcgcccgggggctgcgctgcgagcggccacgcatggcggctggacccgggcggccgcaagggcttggctgggccgcgggaggcgggaggttcttcgtcctcccgagccatctccctgaactgacaagcaggactcccgggtccagggggcacagggcccggggcggtgacccggcggatcgggctgccggaggagcccactgtaaatgccgcaactggccccaaacactgcgttcctggactgcaccagcagctcctggcgcggccg

SEQ ID NO: 5531 - DNA, 2896 bp, Homo sapiens
  source 1..2896: mol_type = unassigned DNA
gcgtgggcggtgagcggccgggagaggggcgggccagctgagcgctcaatcacagccccggggctcggcgcccgccagctgcactcagaacccccctcaccgtggccctgccctgtggcgcctaattacgtgcccccagggctctggagcggctgctgggactgcagcgaagaggggcccgcgccacctccgccaggctccacgcgccggccttgagtgcgctcccctcggccgccgggaaacctagaggcgcggtttggccccaaggtccccggtcccgctcttctttgtctcggcctagttctcggctgtctccgggccgcgacccacctctcctggcggtccttgccgcatgcttctgtgctgcgccagaatcatcgagtctcagttctcgctgccttcccggccagtaggcgtctcccccagctggggagggtcccccaaaccctgtgcttctaggaccgcggggccggcaagcggcaggatctccaagctgcgtctctgatgcggctaggggaggcgcgcgatgaaggcccccctcttctccgccttctctctacgccccaccgctactacacgtcgcgctgcgccgcgaccccggcgctgcctgttggcgccttaagcggctcttctgccgcggtgcgatccccgacgccaggaggactaacccccacccgccaggcctcagaccccacgcagatccagccacacacgcaaccgcctgcagatacccaccacagccctttaagttaacccaaagccccgtacaggcgcactgcccctacatgcgcagccccacggccccacacacccaccagcccactcgcaaacaggcccacatggccacacaactgccctctggacactcagccccacgcaggcacaatcccatatacacacaaccgcacacaggcgcaatcccacccacgcagtacctcacggagtcacacaacccccctataaacaatcgcacagacacagccccacgcagcgccacatcattcagtcaaactgagacccagaaacacattcactagcttgtatccagacccccccccccaagccccgtgacattcactcgtaggacagaccagaaatatacagccacattgatacacacacggacctaaacgcacagccaagacctcacccgcaggctcgtaagtcactggaaaaatattaaagcgttccctccctcccctcctctatctttgacatacacacgcctgcgcgcgcgcgcactcttacactcacaccccccgtccctaagcgcgtcggagcctcgcagcgggtgaccccgaggccccgcggtgagagccaagggagcgtctccccggcgccccctcctcccgctcccttcccgagctcatctctcgcccccccgcccgcctcctccttccctgccccctcctcctcctcccttcccccgagtctggggcgcgggctgcgcgcagccaagccccctcatcgcgcgcccctccccgcgcgcgccccgcgccagcatcgcgcttaccgagtggatgcggccacggggccgtctctaattacctcctgacccccggcggcctgtgaataatggctactgagggcgctcgcaggggctgctaagaaggaaacgcggggcgcgagaggcgcggcgcgcgcgggagcgcgagggaaaggagcgagcctggggccgttgcaagcggctggcgagagaaaggattcgtgcgagcgctcacatttgtttctcccaaggatctcatctggccaccgcgttctggaagaggcgagagggagagcgtgcgcgagaggagagagacggcgggggaaagggagacggcgagacgcgcagcgccggcgcccgggagacccaggaggagcccgcaggtattgttggcggcggagctttgtgttttcggcgggctgctgtgggcgccagggctccccgagcccccggcccgccgccgcgcgcagacctgcccggagtccggggctgcaggctggggtcgccgcccgccgcggacacccctcccgcggcgccaggatcttggctggagttgcggatttgcatgtttgggggttttccacgctggttgagggaatcggtctcagaagaaggaatttctttctttcctttttttttttttttttttggccgcttttggccacagtttggttgtgctggggattcccccctcccctttcctccacaaagcattggtgagcggtcttgacgaatgtggtattggcggaaggcatggggctgagatggcggggctggtggccacggatggggaggcgagagatgccagagaaggaaggagttctgttcaagttcgcaatctgcgccccgaagctggtcggaccggggagggcgatccgcgcgtccgatcctgctccgggcaaccgatgggaaacttcccgagagcgcggcctccctggggactcggcgcccctgacgcctccaggcgcttcctcgggccgctgcggcccctcctcgccgcccgccagcgcttaaggtcgcgctctccccacccccgccttcctcccttcctcggcggcttccggatctggacagagctgcaggagtggcttcaaacacttcccctggagacccctccccactccccgcacgagagcctgcccagtggcccccctgccctgcgccccagtctcacgcgcggtcgagtggccaggctgacaatgaaatctcgcacctctgccggggggagtggggtggggaggaggtccctcctggggctgctgaccctgggcctcgggcagggggagggggctcctgggggaggggcttgttttggttagagacgtcgacctgggatggcgccggggcagggagggggctggggggtgggcgcggcgaaggcggcaggcttgggttcgcggccgggggtcg

SEQ ID NO: 5532 - DNA, 2567 bp, Homo sapiens
  source 1..2567: mol_type = unassigned DNA
cgtccccaacgcgggagcgcagtgcatcccagtggacaaactcgagaaccgcacgctgctctccgcctccacctctgtcctccccgctcgcggttccaacccgggacccaaatgcacgagctcggtgaatgccccggcaggagggcgagggctcagaggcagcctgcccagcaaaaacgacagctgtgctctggtgggccctgggccaccccaggcagaagccagagaagcccgagaaccccggcgggctggcaaagtttgccgagaagggtctttctggacacccccaccacgggctctaggctcgaaccccctcttccatctggccctggagtcccagacacagacaagccccgggcgcgccggcgggcgtatgtgcgtgtgtgtttacagcggggtggccgccggagctccccaagaaccccagctctcccgccccagctgcccgccagctgtgagcgcccgtcgggcccggaggtcacccgcaaacagctgggtcggcagctgggagcctgggaggcccctgctcagccccggggccccgagaaaggagaagggggagcggagtggctgtttggctgtggtttcctccaactccgcctgcgaagctctcgctgggagcccggagctttagctttccccggcagccccggcccccgcgcccgccgcgcccagcggccggcgcctcgccccgggccccggggaggaggcgcgccggggcagccggccaggacactgcgctgctggctcctagagctgcgggcgcgcctggccggccccacttcccgggttgctggggcgggcgccgctgccccgaccccggacgcgcggaaccctggagacccggccgctccccgccagggccgcggtgctgctccaggctccgggcgggcgcccctttccggctaccggtgcaccccgttgcccgcttgcgggaagcgaagaggggtcccttgatttgcaacatagaggaaagcgccgcttccgcccagcctggcacccacgcgcccacacgcacccggcgccggccgggtcgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccgcgggtggtggggggcgctgtgcccagcaggggcgacagcgcaggcggggcctcctgcagcccccttccccatccccggtcgcgtcccggtccccaccttgcgaaaggctcgagagaggccgcaggctaggattggaccgccgggcgccgccggatggtgttgccagggtaaccggatggcacgcgaagccgttcgaggttccgacccggttacgggggcgcccagtggacccggagagctactttggggagggggcggccccgaagaaggactgggtgggggcgcatggagcgggggctgcgcgaaaagtttcctggggcggagctgagccacgcgggccgcgcaggagcgtctgtccgagggtcgcctacgagggactcctctgctcggctgcgcgggcttctgcgttgatgaagtcaccgcgttccgggtcggagcttcggcgcttctgccccgaacccagcgaagcccggtcctatgcccccaattacccaacggtccctcatcgcccagcgc

SEQ ID NO: 5533 - DNA, 573 bp, Homo sapiens
  source 1..573: mol_type = unassigned DNA
cgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcgc

SEQ ID NO: 5534 - DNA, 383 bp, Homo sapiens
  source 1..383: mol_type = unassigned DNA
cgcccgtcggctcctacaggggcgaaatcaggcacccaccgtgacggcgagcgtgacagcgtccggctcgaccttgcccagatgtccacagaagatggagctgacgaggctgattataaagatcatcaactgcgcaagaaactgcggaggcgcggaaagcaaggcgcgttcacagccgccctccctcctggaagcccgcgcccacccctgcgcggcggccgctccggaggcgtcgggctgggcgtgaggacgccgcactcaccactgggcccgcgagcgccgccagctcagccgcctccccccgcaggtccgggggcagcgcaccccgcaggccccacaagccgtcacgccatccgagggcccggagccgctatgggggccgg

SEQ ID NO: 5535 - DNA, 853 bp, Homo sapiens
  source 1..853: mol_type = unassigned DNA
cggcgcggggtgaggtccgggggccgccttattgctgaggtccggccggttggggccgccgctaggcgcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgcgagaagtcgatcacctcgtcctccgtgccgtggatgatgagcacgggcgacgtgatctaggacaccttctcgatgctgcgggaggggcgtggagcgggtgagacttagcgcccggcccgggccccgccccgcctccgtccccgccccgcctccgtccccgcccgggccgctcacttagggaaggcgtcgaagcagtaggtcgtcttggtgtcagggaaggcgacgcgcatgcccgaggtgagcggcgagtgcagcaccaccgcggcacactcgtagcgcgaggccaggtccacggtgggcaccgtgccgatgctctgccggtacaggatgatgctgtccgggctgatgccgtacctggcagcgccggagcagggtcagccgcggcctccgacgcgcgcacacccttcccaccagcgggcgtccccgggcccagctccggatgcgaccctccagtctccccactcagccaagtcagtgggtcaggcccaggctccacaccagtcccgagggccacccccagcccccaacaccgcggcggtgggcgaagccagcggccccgccccgttccctgcgctgccgttcactggcgtttcctagctaggatctgcagggatctcgcctacggagtgcccctggggcgg

SEQ ID NO: 5536 - DNA, 1062 bp, Homo sapiens
  source 1..1062: mol_type = unassigned DNA
cgaggaaggaaggtgggcgcagaagccaccctaggcgtgacgcgtgacgctcggggcacgggcgccggggggcggaaagcgagggcccggctgggccagggatacccggggggggccgaggtcctgggctccggcggagggaggggattgggagggaggccaccgcctcgggccacgcgggtgacccggcgggggagctgggggaggggcggcggggctgggctggggtccccgggccgggactggggtcgggccagcttacctcctcgccctggccgaagcgcagtccgagcgccgcgacgcgctccacgcgcaggaagccgtcggggtcgcggccgcacacctcgaacacctcgcgcaggcggcgcacggagcgcagcagagccgcgggggcgcccgaccagcccgcgccgcccgccatccgggccggcccgcagctcagcccggacccctcgcccgccgcgcccgccgcctgcccgccgccgccatcgccgcgcgccctccggggccgcccgtctgggtctgcgccgcgcagcctccgcccggtggcggccgcggccgatccgtgtcagcagcggcgccgcagccccagccgctccggaggggaagggaggggaggggagggaaggagaagagtggggaggggaaggaggaggggcaatagggggcggggaggggaggggcgggggccgcggcgaaaatgggagggagagggggaggcggcgggggcggcggcggcggggacgctgcagacaaaaggagcccgcgtcctcccgagtggggcggcccacgcggggccggcaggcgcagcgagctgccaacggccgcgtcctccgcgacctcagtttccctccgcgtccccagtttccctccgcgtccccgagcccaccccttcctctggacacccggagccacccaaaggccctgccctgccggaggattccgcggggtcgcgcccctttccgctatccgtgcccgctgccgcgcctggcgtctcccgagcgctcaggatgtcctgggggcctcctgcattggcgcgttccgtgactgcattcatcccgg

SEQ ID NO: 5537 - DNA, 918 bp, Homo sapiens
  source 1..918: mol_type = unassigned DNA
cgcgaagtttccgcggcggagagcgctgcgcggggagacaaagggaagggacagggatcgcagggacagggacaggagcggctgccgggctctgggtccccgatcgccaccagacatgtctccgagcagccgaggcaaagggaacggatgggaaaggaaaacagaggagcggcccagaagggcggctcgctgcggtggtggggcgcggactcgggaactcggggcgggcagggcacgggcgcaccccctcctctcccctccctcgctcgaggccggcagcgccccccgccccgcgccatgcacacccattgtggtgatgagagctcgcgccccgtgcccgtcacggtcactgtgcgtccaataaaaacaaacactgccgaggagccgccgcgatgcggggcggacgcgcggcccggaaaggggagggggccctaggaagagctacacccgcgagccgggcctgggccaggggcgaggggagagcgccaagactgccccgccgccgagggcgccgatggaggcacaggggttcccgtggggcgccccgagagacaccgtgcctggccggcgggacgtgggctggcttctcacccgacggagagaagcggcactctcatcttcgggcaccgggtctgggctccgagcgggggctcctggaacacaaggcagtgggggcagacgggcctgggcccaccccaggctgggaaggggtctgagcggggcgtcctgactggacccggccctggcggaccgaaggctccaaaagatcttgcattctcaaagacttctgcagatcgtcaccgcctaaggcgccccaggcccggctccactcatgggaagggtaggaaagaaagctgggagcgctctggggcgcggggcagagacagcggtgttggaggcgcgctgtggaggcggcgg

SEQ ID NO: 5538 - DNA, 865 bp, Homo sapiens
  source 1..865: mol_type = unassigned DNA
cgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggtaggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaaggtggtgagctgtgaggggccccggtatctgcgcggcctccccgggggctgtgcgggttgggggtacttagaagcccggcattacgtaagaaccgtgctgttagcgcttccgggggttggggagcgagacagaggttgcgctgggtcccggtggccccctggtccccctaggcagctaacaccacaatcttccctgggagggggtccgcagaagggcgcgcgctgcttctcccgcttcccaagctgtagcggggcgggtcgggagccagggttagggtctggagacttgggaggggaccggtgccagaagcgaagagctagggttagaaagttaggtcaattaaggggggggcggtgcggataaagacggggtgggggttggccggggcagtcatttagtgacctcatccctggtctccggcgggcgcgcacgt

SEQ ID NO: 5539 - DNA, 408 bp, Homo sapiens
  source 1..408: mol_type = unassigned DNA
cgaagcggggagaatccggctgggctgacggagacgccacaccgcgccaggggagcaggagctttttcggagcgggaggcggggcgccgtgtggctgcgagcgcgcctcttggatgccccggccggcgcgggggtgggtgggcgctcccgccccatccttggccccgggcggccagccgcggtgtgcccggagggctctgcgagggctgtgggtggcgggcgagccccagcggcgtagcagaggaggggcccccgagcgagcgtactagggagaagggggtccgtgcaaatcccaggctgacgaccgcgcacgcgcccctcgggtcaccagccctgtcgctcttggtggggcacaccgaggagaccgccgtggggaaccggggaccggattgcctgacagccgagcgc

SEQ ID NO: 5540 - DNA, 2245 bp, Homo sapiens
  source 1..2245: mol_type = unassigned DNA
cggaccctgcggagtcccgagccccgggtgaggcgatgcccagactggcgcgaagcggggtgtcccggcagcagcgcagaggcccacccgcctctccggccggctgcagcgggcgcgcctataccctgcaaaaccaaaacgctctggaaagcgcttggggctgcaagtgacgcctgacacgagcggcgggccggactgccggcctcccggcccttccctggctcacacaacccgcgggccgcccccaccgcccacgaacttcagcgggcagacgctggacgtgcggtctggctactttcctaaactccagcgcccgatccgcgtcgcagggtcggccgcgcagcgcggggatcgcgggtgcccaggctcggagaacgagcgtcgcgctcccagccgcggtcggggaacaggaactgccgccagaggcaccgtctcctcccccgagactgcgatattgatcaagggctcgcaggcgcgggcggcattcatctctccggactcgcagctcgccgcggaggggaaggggcaggacgcgctcccaagactagggcgggggcgtgcggagtcggggagctgtttgggggcgctggggcgaggtgggaaccccgcttcagagtctccagtcccggggccgaggtctgcaggaagggcgtgggaggtggaacctcccctcccctaggcgtctgcccgagagcctagagcgattcttggcgcggagccggctacccgggtgggcggaccccctcctccgccaacatcccggcggcttcgccacgatttcttttctcacctgagtctccccctgcctacccaaccctggctccaaaggtccagagagttaggctgccccggagcccagccttccccgacctaagcacggctctcccagcgcccccgcccccatcacacccacagcccagccccgtcccgcgtccgccaggggccgggggcgccagcgctcgagggatggccggcgggctgttaccttgacgagacggagctgcgggtgccctcccatcctcgggctcgctcggctaccgtcctgaatgcccgggtcctacggacatcccagagggaccggcgggcggctgcgggctcgggcggcacggggtgggcggccgggctcctcggtcgctgcctggtgaggagatgcccggctcggcgcttcccggccccgcggcccggcccggcccggcccggctctcgctcgccccttcccggggaagtctggccgccgtttcccgacgcagcccggcccgcggccgcctcttgccggcctcgcccccgccacctcccccacggtccgcgccgctcctcgcctcggctccccgccccctcgcccagctcgtcccctccccttcctccccctccctctcccctccgctccccttcggtccctcctccgcgcctcgcccctcggctccctcccagctcctcctcgcctcctccgttccctccccttcccccggcccgctctctgtgtcccgccgccaggatcccctttccctgcgcccggggtttgcggcagtcctcggggcgcgctggcagcagtggcggccgccgcagcccggggagaagccgggaatgggggaagggggccgcggtaaaggatcagcctcccgcccggccgaggtcggggcctgggaagtcccagggatctggggtgacttgggccagggtgctcaggtgaatttatgagggcgaggctattgggggctagggaacagggcggtccctactgagcggagccgccgcggaacccagtgaggctgcgacctgcgtttgggcagttcccgccctgcggctggctaggaggagctcctcgccgcccccattccagccgcgccgggcgctgggcccgacccccagcacctttggcactgatgtgcctggtgcgcgctgagacgcgaacgctctgcaagatgagcccttattcattcgttccttctttccttcatttgttcatcttacaaactgagtgcctggccactttggttcaggcaagaggctggatctgggaaccctttggacctgggagccccaggatgaaagggagacggcggtgccctgcaggacaagcgggcactgaacgctgcccaggggaaagccgggcgcgcattgcgttgcagcgcggcgaacgctgctaggagcccgcgggcagggcgtggggaggacacagcgccccctcccggccggccgagccctctgggcagcggtgggcctccccgccagaccccggggccgt

SEQ ID NO: 5541 - DNA, 2972 bp, Homo sapiens
  source 1..2972: mol_type = unassigned DNA
cgattattcccgcctccccacgcggtcccccagggaagaagcgaggcgcttgagccagactgggctggaacagtgcggtaggggcccgtcccccgcggagctgcctccccatccaccatccacccagctcagcccggccgctcacgcacgcccatttgctgccctcgttccatccctattaggcgcattagccagcccggcggctctggttacagacgtctgaatgacaaagtgcctccattaccggcgcggcccgccagccgacccgccgggacgcgctctggtttcagccctctctctctcaccgcggcccaggaagaaactcggaccgcgcacagccatcccagaccgagcagccgcgcgccgaggcggaggcgggagccgcaggggctgcagacggcaggttcctgtcggggtacaccttcccaagcgcccaggtcctccacgcccagctcccctccttccttgggtcttcgcgcggggaccctcgctcttgcccagacccggagcccaagtcgttgcccctctgggatccggtccctcctccccgctctcctggtctacgctcgcccacccgcgtctgagcagcgtctctaaccagcggcgttagtcagcagacgtgcccgcggtcgctcccaaatccccggacgcagccacaggtcctgacagctccagggaactggggctgagctttcgggctggggcccgcacccggacagaatctctgcccacctcacccgcaggctctaccgccgacggactctggggacagtgtcaaccccccccgccctgctgggaaacgcagccgtgaccccgagctgggacagcggctgccccctgaaaaggtgggggagtaccgagctgggaatcaggtcggggagtctagccacgactctggcccaacttgctgtgagatcttggccaagtcgtttaaactctcagagcctcagtctccgtatctgtaaagccggaatttggggcgcagtgctctgatgaaagatgctggcggggagagtgaagacgcctcctccgttgccagaccttccagggcattcggttcatggccataaagcaggccacatctgacaatctcgtcggaccacccggaggacccgccgacctttgccgagtcggtggcccgggataccgcgctacagaatccgaggcgtccgggcgcccccgtctcgttaggtgcccagcggcttgcaccgagagccaggagaggctcagaccggatcccgacccttcgaggcgcgggagcccacggagcgcggtgggcgcggcgctcgggtcgcgcagctaggtggggagcggcgcgcagccccagactcgcaggcaggcagcggcggactgcacttgcctcgccccgcagcgccccctgcctgccgcctcccgcctgcgtagccagagctgcgcgcggccaggaagggtccccgcctagtgcgccccggcgctctgcaccccgagacgtagccaccgccagcccgggtaggggcacacccgctccgtccctcgcgatccgctgcgctgcttcaagccgtgagaacacgcgcgtcggaggagcccgccggccgtgggggaaccccgggagcgggttcgccccggcgaagtgggcactcccctcccagccttagatccgcagccccaattccgggactgggagaggccgcgagcaggagcgcggggacaggcgctggaaatgtccaagcctctgctctctcttctcgtctcactgtccctcagcgggcaggcgggaccccgaccacttcagggtccgcgccccgctctgtctcctttccttctgcttccatctctctgccgccctcgccgtcgcccctcttctgccctccctaacccacttctcaacctctctcccgctccccaacctctccctccgacgcccctcccccccattgtctggccggtccccattgtccttgccgggtcccctctgcctccagtccctccgacctcctccattgttccatcccgtcgtcccgggctccccgccccagcccagctcgcccctctcatctctagtccccgtccagttccccctccttctctcgccttggttctgtcccacgactctccagagaccgagatgctgaggggaaagtcccttcgggatcccggcattcgagtgtcctcttccgaagaacctgggcatcggagagccccatgccccctcttgaaagacccctcccagctcccccaccgccccctgcggtacctgaggaccggcatccgtgctccggtcttgccctcatctccaccctggagagtcgcctctgcgctccgggaaccctagaccctccttcgtggtcccggcatcagaggtcctttcccaccacccaccctcagtatctgggaccccaatgctctgttctgtttccttggtggcggcgcccggctcttctcggagttctgatcccgggaaagggagcgggccccctccggctaacactcacccccagaagcagcaacagcagcaggcgcggcccgtccatggcgcggccggtggcacctgcccccatcgcccgcctcccgcggcagcgctcgacttccagctcggtccgctttgcggactgatggggctgcgctgcgctgcgctccagcgccccccctgcccgccggagctggccgcggctcggctcgctctggctgcgggcgggagaggctgggtgaagccagtgctgcggccccgcctccgccccgcccagcccgcccacccccggaaccgcgcccgcccgccctgccgcctcggggtgggaagcagaggcaaagggagggcgtgcggttccccgcaccccgctgcgcttctccctgccttgtcccttagagcctctcacccatcccgccctggtacccagttcccggcccgcgctactgcgcgtccgtcccggatgctgtgggcccggggaccagggcgtccccactgcggttcctgttcctctccggctgcggcccgc

SEQ ID NO: 5542 - DNA, 1026 bp, Homo sapiens
  source 1..1026: mol_type = unassigned DNA
cgaccgcccgggtccgagcagcgggggcgctttcagcggcggcaggcgcgggtgcgggggagaggagcagaaaagagagcagtttgaggggccgagggagccgcgtccgaggccggcgcggtggggaccgcgggcccaccaccagccaagcccagctacttaactatttgtagagctgctgcaggcacaggtccaggctttcgccctccacctcctcgcgggtgatgcgctctgacagcggtcgcgggagcgggggcaaaggcggcagctggggcggcggcggcggcacggccgagtgccccggggctgccgccgccgtcgccgcgccctcctcctcctcctcaccctcaaccgccgcctcctcctcgggctccgggtcttgctcctggtccccctcctccgtcgcggctaccgtggccgcctcctccccgggttcctctaccgaagcctcggccgcctcagcttctaccagttcaggttcgggctcgggctcggactcgggttcgggttcgggttcgggttcgggttccggctccggctcgccgccgccgcacggtccgcgaaactcgcccaggaatagctccaggaagcgccggtaagttttctcctcagggatgcagccggccatcgctgctcatgccccagggcagaccgggaaaggggttgggggaagcccaggaagggtaaggggctgcttttgagcctagggctccggcaagggcggttaacggccgcaccggcacgagcgatcagcactaggttgcctggagagggctcccgcaggcgtgcgcgccgccgagcaccgacgtgcgcggcccgggggcggagcgcgccgcccctctcggatctggagggaaagttggtggcgggcgcgcgcagggtccagcggcggcccaccctttattcctacggagagctcagcccacgctgcctagagactgtcgccatggcaaccggttctaattaagcattgcagggtccctcccgtcgagtccgcggagtctaaaggacactccactcgcccgc

SEQ ID NO: 5543 - DNA, 10207 bp, Homo sapiens
  source 1..10207: mol_type = unassigned DNA
cgctggcctcgccgccagctccctgggccttctccctcgctggcgctgccgcggggtcacaggccttacctgagatgccagcatgtgctgggagaggtggaacgggaagggcgcggcggtgcttgctgcgctggccgcgggacccagcccgcctgcgtccagccccgcggcggtcccaggcccgccacctccgccgttgccgccgcctgccaccgaggccagtaggtgacccatgcccatggcggagaaggcgccagggcccatggtgaactgtccagggtgcaggaagagcggctggccggctcccagcggcccaaagaactgctgcccgtgcaagtggctggaaaaggccaggccgggcaggtgtccggcgcccaggggggacgcactgtctgtctgcaccaccagcggcgccaggccctgctccttgccctcggccgcctccttgcgcccctcgtccttcctccgagcttcggcgcgctccttctccaggctcctcaggccgaacgggccgtccccgccgctctcggccggctccttgcccctctcgggactacgccgctcccgggcgcgctcgggttcggtcaagcgagtggggctggcgctgtctggagccgggctgcggcctagcggcgcccccgcacgctcctcgctcaaccgctcaggctccgggtcgctgtccgcggcgcacgacttctcctcagctgcggggagagggcgcgcggattacaggggcctgggcggaggccgacgagcaggatcagggacactcgggaagggctgctctcggggaggccgagtcggaggagctgctggagtcgggcaaagggcagctgcaggtcacctaatccaagaccccagatttacagtggaaggaacccagccctggagaggaaaccctacagctatagaattacacggcgcccaaggggccaggctcggagtccggccggatcttctggctaccggggaccgccctcgtaggggagtcccgggacggaaaccccatcccagacactcgccgacgtttccttcctggcctttcaggttagcgggtggctcagcaaaagaccagcccagcgacctgaggaccccccgccgccacctccctgtccctcctccggtccgaccctcacctcgggcccggtgcaggcgcagcggactgggcgctgcgcccggggaggtgggtggttcccgcgcggggggagggtcgcacgacgaggcgtctgactccgcgccatcgcgctcgggtttgcagtgctcctcgtacaagcgtagagacggcagcgtcagctgcttcctggggatgagcggatgaaccaggtcagcggggagcccatccctccatccctcctgctcgctgctcccgcgggcacccgccacagggctgctgtcctcggcctctcaccttttctcccgccggccgttcccggtgtcccggaagcccttggcaaacgggttgttgtcgatcttcagctgtgtgatctgcggggaccaagggggcggcgctaagtcaggccgtggctcttccagcgtggtcggtggcaccccgaggtcagcgggtgctggccgcagagggaagacccggggagcgtccacttggtacccacccgcctgggatgggacgccccgagctgaggccggtgggagggcctcgcggaaagcgacggggtctgtcctccaaaagcttcattcgaggaattatccctagacaggcctagacagccccacacaggcctaaagcagtgccacagtgtcggaaccagcccaagcatgcacacccgcccgcgggcttgcgcaagttaaacgactccgcacccgagcaggcgcgaacagagactgcagttcacacgcaaggctgcaggtacacacaaagccaaatcacactcacgggctcgcacacacgcaagtgtgcacagacataacaaacgcctacggaaccaaacgaattcacatgcctccacaggtatccaacacaccccaaacggggcacgcacagcccagcgtacaccttggttcacaaagccacaacgaccggcacggacactcgtaccctctctttcactcgacagtggcgcacaagggcacaggcctagaggggtgatgctctgccccactagaacaagggtggagaagccgcaagcagaaaaagccctttgattggaaggtaattctctaagcgcctcccaaggggtctggggcctagactgacccagagcagtagccaggagtgctttggggggctgtgtcacctgtcccaccctctggctccccccgagagagtgaaaactgggccccgggttctgagcatcggtagagcctgggcagattgcctcgggcgccctctcttcacttacattctcattcctgagccaagaaataaacgaataaaatgtaaaaatgtcagcgcgggcccggagtctcagctaattgttaagtaaacatctccatcagaacgacggcccagctgttcgctcgccccaggggagcctgtgtgtgcgcgcggtgggattgagagggcgccttgaggacttccgtgagtgctgcgcgtatggatgcgaggctcggtgctcgggggcgggccgcaagagcgcggatcccgtgcagggggcttcgaggggcgatgaacggacggttgggcctgcacgtgttgaggggcgtcagtgcaggggcttagcccaccgcccgccgcgcgcaccttgtcattctggtaggcagtgacggcgatgaagtcggtctccgggaacacgtaggtgcggaaggtgctgtaaggcagcttcaggatgtcgttggctcgcactatgtggaagcgcggctggtacttgtgcatggagtttaggatggtctgcggggagggtgggggtcagccggcagccaccagccccggcccgagcttttctattctttgggtacctgacctcttcctctccactttctctctctctctctctctctctctctctctctctctctctatcggttcttcctcttccccattttctcctgtctctgctcttttctcacccttatttctttttcttctacttttcctctcgcttttctcttttcacagcttctttttctcttgccattaaaaaaaatttcccagttggaaacagaaatgagacagagcaaaaacaaaacaaaacaaaaaacaaaacaaaaaaaccaaccaaaaaacaacccctccccacaaaagaaacccaaacaaaataaaacaaaacagagccctacaattccactcttaacactctcttcctttctggcactggtaaaccccctaaccccacaaagaggagattccaaccttcgggggctcaccaactgccctacctcagaatgggcagttccttttaccctatgaaacaccacccccgttcgctggggccttgctcaggcataaatggagagaacccccaaaccctctcctcctagttgggcatctgcctgtgggaggagggaaaggtcttagggaggctgggggggtgggtggggagggtggtttaacttttaaatcccctagtcttgggggagggccagggacgcgggtcttggcagaagggtgatggacaagttgaggtcatgggcaggtcttccaagctcggcacctacaggccaagagcagggtgacctccgtggtccagcactgcagacccagtcctggcagcacctgcctccctattgacggtacaagggaccctccacggcctgaggaactgagattgtgagctgccagccactgaccccaccatttcccaggcttgcaaaggagagcgctggggcccaggcccaggcccagcccacgtagaccacagggcagtgacccgggcaggggcactctgggggtttgcccagcgcttccccctgggagatcctgccgccctgctctcctgctcagctgcagtgctgggtcaacaagctcctgcaccgtccccaccctgccccaacactcacgaagccgtgcttgtcagagatgttgttggtcagcttcagcttgtggaaggccacaggcttagccatccactgctcccccgtggctgggctgtctgggtggatgtacatgcgtttgggcatctcagggtcggccttgcccgccaccatccagcgcgagttgtggaacttatagcggcaatcgtcagcggctacaatgtccatcagcaggatatacttggccttcttgtccaggccgctgactcgcaccttgaagggggggaacatccgcctgggagggagggaagggaggagatcccattggaaccggctgttctaggttccaggaccccactcctcctttatttatccctcctcgttgcgcacaccgctgccgcctggctgtttcccctgtggtcggctgctctgccctctcatcactgcccggacgaccccacctgtggttgttgctcccaggagatcccatttctgcctgtcagaccctctcctaaacagcctcctttaggccttgtgctcagatctggggaccctctttctccctgatctgagatgaaagctgatgcccaggagagaagtctaggccctctagaaatattctcgcttctccttaatctccccgaaattcgttcaggggaaatacccacttgggacggaagctcccagaaataaatctggagggtgtttgtattgggaactgggctacagagcctgataagacatcctggccgtgcagttcgggggaagagggtgaacccgaggcctggattctcggtggctgagtcgaagggtggaggggccggggctgtggctttcttcaggctttaaggcctggggcggcggatgcgtccagggctcggatgcccgcggtggagaaagggctcccagcccggtgaggcggagggctcggctgacccggggctcgctgccaggaaccgagcaaccagcgtggggttagctgggcccaggtcccactaggggcttcggggtcggagcagagtctgagagaggctgaatttcccccgagctcggagacggacccggacgcagaagagcgagagcgcggggcggaggagaccgccagggccaagccgcggggcctcctctgcgctgggactcagaacggttggggctattctttagcagtatgttttcgttttatttcattcggaggattttagcgtttttgttttaaaaaaaaatcgctccggtgccaaacgagaaaagtcaacttggttgtccgtgggagcgaagcgtggcgtcagggccagaacctggagccgggagccgggagccgggagtccccagctctgctctgatccgtgcagtcccgtgccccagcccgcccgcccgcccgcgcgccttccagccggccggcagccctacctcccggacttggtgatgaccatctccgtgcctagcttgtggaactggtcccacagctccttggcctccagcgtcaccttggggtcgtcctccacctcgtcctcgggctccaggctcttgagggagcgcagatgcgcggcgggcgggtgcgggcccagtgccgagacgtgcagccccgcctcggccgctgctgccgccgccgccgccgcggccgccgcccccgccaggcccgggtcgggcagcggcttggccagcgcgccgggcggcagcgcgagtgccgggaagaaggagggctgcgccgccgccagaaaggcggacatggggaagtcggcgggccgtggcgcgtggaacgggtggtaagccatggcgctggccgccagcgccggctctctcatcgggacatccggcccaggcgcccgggggccggggccggggccgggggcgcgcggctcggacccccggcccgggcggcggcgcgcgcggtggacggacgacccgggtggcgggcgcagcagctgctcctcggggcttcccgtccggcgcaccgcaaggggcacccggctctgtgcgcgggggcggcgggggctctgcgcggggccgggctgggccgggctgagctggcccgctccggcgccggggaccacgcgcgactggttagatcttgtcgtgatctctggaaaactgtgactatctcacatgtcctgcccagctcggatcccctgcgctaacgagccaggccccccttgattgctgattttacgctttttggaccaattgtgggtctccgggggcggggttttgacagctcaggccaagctccggccgggagggggggcctgggagaaggtgtcggaagcctcagcagtaagaaaacatgtcaacagaataaaatattaaccaatgacgggccgccgggccccgagacccctcctcctgccccggcccccaccgcccgcccgcgcctgcggctgcctgcgccggactggagagcgcggagggccgacctgacccgccgaaagggcctgaggcgaggggagcccgggtcccggggccttggggaaggacccgcagccgcacgccggccccaagtgcaaagcattgacacgaccccgagcggagagggggcgccctccttctcccgcgcccagaggcccggccgctctggcccgagccccagcctggcctccgacccagctccgggtcgtggcgccgcctgggggtccctgcgccccggaaagagacagcaggcactggaaagcgaggccggtgggcgggcgagtcgggaggctcgggcggccgaggtccgggagcggatcccaggtggcgggagctggtgagtggagccatggccgagccctgctggggccggcgcgggcgggagcgggacgcggccttgcgctggggaaacgcggggaccccctacccgcgcccgccttcaccggaagactcggaaggaacctggagttctccgcaggcccgggccccgccctgagctttccagcggccgggaggagcggatcctcggggccaggaaggtgagcgcacctttcgctgagcacagggcggcaccgcgcgggcggaccccggattctccacccgcgacccaacgaattttcgccctatccggtaccggagacgaaagtctccttcttccgaaataccggcttcctctcttcgccctgccaaccacttttttagtttcttctcatctctcggaagcgcacgtctcctaagttaaggagtgctgagtaacgcgtgagggagttggggtgtctgcgagcacctgtgattgaagccccctcttctgtgatcagtcttcgttttctgtcttccggcagcctcagtttcccccccatgaagtgatggtgtgtgtgtgtgtgtgtgtgtgtgtgtgtgtgtgtgtgtgtgtgtcgggccccgtgtggtgccctctgtgcgcagcgagagctataactcaaggtgtgcacggggagagtgaagcgaccacgcacctgcttccaatcgggctcgggcgcgaacactcaggctgattcctgaaggtcgttttctgaaggaaaagacagagcatgcactagccacgggtgacattcccacccgtacaaccgcgtggtgggcgcgtacatccaacattgacccatgcaggcgcccgcccactgcgcacaccggtcgcagggcacttcgttgttgaacgttgggagcagcgtttgaaggccggatctctcctggcagtgcggattcgggaccggcggaagcagtatggcctctgcgaccgttatccctacttttcggggccgaccccagggccctcacaactcctcatcaccgcatatgtgagcgccgcccccacagggttttctccacgacctcgttcttggctaggtcgcacctctcttagtacctcctctctggccagaacgaatctttgactccgagctgcgcagtctacgcagacggggcaggatccactgcagttttccacaggcaaatacctgctggctccaccttaggcgagatgtggcctctcggggagggacccgttgtggacacgtttgcgcagccggtgaggtgaccagataataaccagggcagctttccttagccgggaacccaggtaccggcctaggaatccgtgaatacattcgcaaagtcgcgcgcgcgcgcgcgcgcgtgtgtgtgtgtgtgtgtgtgtgtgtgtgtgtagacacatacttttgtccttgtaagagtatgtgtacatctaaatgtgtgcgttttagacattagtccatttcattagtccatccatagctggtccaggggtccgaggcctgaagagtttgaaacactcaggcctgggttatttgaccgagaaacctggcggcgacagtgcagcggctgcatctggggacggcgaccccacctacagtggcaccgaccttccctctggctttccggggctctgtccgggccaggatcccaccactcgccccgccccgcggtcccgcgatcaccctgaggtcctgctgcagccgctctgaagagtctgtagcgacccccagccaaactctccagctaggaatgcccgaggctcaccgaaagctggcgctggggaggcctgggaggccctggagcggcgccgtgaggcctccgctgggcccctcccccacctaggccggccccctcccccttcccaggaaccccctcccctggcggagccccgggggccgagtgtgcgtgttcctttaagaggccccggggggcgcctcgcgggccgcccggggctggagggggagggcgcgggcgggggcggctggcgccaggcggccgaggctccacaacaaagctccggcccctgtcacttcgcatcggccaggtcccgcagacaggcgggggacgcgcgctcggccgcccctccctctcgcaggcggtctccggccagggcgtcgggcgggcttgggctggtggcgcgcggtctgtgcgccccgcgcttcccgcaacagtgaaatggggcgggagcggggacggcctgggccgggtggggccgcggtcctgagcctggcgtggctgcccttccgtcctccggccccgtcacctctcgcagggttaaggggcactgctgggaccttccccgggttgagcctccaggtggcagggggtccccgccgcttcctcctctgtgtgcagggccggggttgcgtgaccccgcgggcagtgggcagcaggaagctcgggctgtgcggccgcgtggcagagcggacgacggacttgcgtccgagtgacggggcgcgggctgcagactggcttaagccctcggtggcagacgaatgtgcccaggctaagctcaggggacgtgtgtggccccgtgctatgggcccgctgtgagggtgccgccaggccgtcgatcactgcctggacgtgaggagtgtggtggtgaaggacactccctggacagagtcgcttcccatcacggcttccccgccggaccgcacctcccggagccctggcgccagccagcccggtttagcggccggaccgggctcccccgcggtcccaggtctggttggggtgggggccgcggcctcggtgaccccagcccgcagcggcccggcccgtcccgtccacttaaacaaattgccgctgacaggcgcgcagtctctctggagccgccgccctcccgtcgcctccctcccgtcccaattatcccgcgcagggtggggccaactggctgggatggggcgggggacgcggggagagcgggcggctcgactccctcctggtcgcggggtggcccggggaagcgtctccgcagccacggcctgtgtggccccgtccctggtcttcccgggggatgcgagggcaaggcccagcctggcagctgtgggccctggaagggcgtcgttctgcacctaagggcgagatcacgcggccgagaaccaaggccgcatcccggatggacttcgggtgactttcccggagttctggggaatcccctaacccggggagctgcagacgactcactggccccgggccgcggttccgcgggtggccgctgtacgcttgagacacctggtccgcagaagtcaggtgcacgtctgtgcaccgtcgtgcgttggatgtgcatggaggcgagatcgtggttatggatgtctgggatcacgggagcgtgaacggggcgatcgactgagtgacttgagagacggggtagagcgcaggaaggacccctaggacgggcccacctgcgacgggcggcggtgggggagtggggggcttgccggcgcgttcacaggctctgggttcgcgttcggaaacgctttcgcagggagcgggtcgggattccccggagcagcacggtgacggcgtgccacaatccgggctccagctgtgccgcctccgc

SEQ ID NO: 5544 - DNA, 2392 bp, Homo sapiens
  source 1..2392: mol_type = unassigned DNA
cgaggcgcacttgccccgagtgtcaggtctggggacgcggttccggagaggggagaggggcccgggaatgcggcgggaggggcctcgaggggcagcgggccgggccgggccggggcggaggtggcgggccccggcggggcgggccctcgcgggcggcggtgagagctcccgcacagtcggctgcgagctctgggagcaggaggcgcggtgcgcagcccagcccgggacggagccgggcgccgtgcgagcctcgggagggtcgcggggcgcaggggcgggtcggggccagcggaccaggccgcgccacccgcccccgcccccgccccgccgcgcccgggctccggcgcccgcggagctgagactgagcgcgccagccctccggggccgaggctctgggacagacaccgcgagggaggcggccggcgcgggctctcgtcgcgggcgcagcgccccttcccctcggtaagtggcgagcggcgggcgaggggcaccaacttcgccgccaacttggggctgggttcccgcggcgcgcgagcaaggacggcggagacagaggcgggacacccggggggttggacccacgcaggactctcggggctcaaggagggggcggctggaggacccggaccctcaagaacctggccttgggttttgacccgggcggccggagagaaggcgaagaagaggccgagcagacaggcgcgcggcggacgcgagagaaggacgcgggcgaagcgtccaagacgttcgtccccagggtcgccgagccctcctcctccttcgcttggcgcggcagcaccgcgggaccaggggagtctgggctgccgcggacccaaactgttgctgctggaagccgccggggcggagagcggggaacagggccgggagtgggggccggggctgggatccaccagagcgaggggttggaaaggagtcgagaaggtgaaagggggctgtgcggctccccagcccagtgccccagtttccctaggtctgctgggcacctgctgcgcactcgcctcggcgcccagaccccttcccccgccgcgagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgggggcttcgcccaggatccccgacggcggggaggggaagccccgagtctcctgtttcctgcctacgcgggcagggcggggacacgcggagcaaaggcacccggcaacctgaacccccaggtgcgtcccgcgaccctgcaaggagctgctgggtgagcaagacgggaattcccgccaggccctgatgcccaccccattcgtccactcggtttcccagccctggtcgtccaaggggacttctggctcggtcccccagccctcggatggtggcgttatcttagttcagtccctgaccccgggccacaggaaaatcgaggaaagacacttatttggggagggtaccattccgctggctgtatttcagagcccgtccaggtcttggcggtgctagtgactttgagcctgtttctaaactcccgaagaataagagcgtgccaggggcaggtaggcaggtccgggacacctgggttcgcccagggcccccgggcgggcctgggatggtactggggccgcctgccaggctggcttggtccccccactgcgggactcggggtcacgacccagcttgggggagtgggggtgggggccccggagccgcggacgccggcggggggcagcgtggggcggggggcgccgggtgcgtggtgctcagcttggccgccaggaggcgtggcgcgggtccccgcccggagccgccgccgccgccgccgccgccgcatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgtaagagattgctgcggaggggagggggcggggcgtcccggtggccagggggagtccgggcggggtccgcggagacgggggccgtagccttggaggagcaagaactccgtgcccccagcagtggggcaagctagaacggcggtcctctcccctggcgcctgggttcgggttttggctgggcaaaagggagggagggaaacccgacggcaaaggaggggcggctcaccggaagggcagggggtccgg

SEQ ID NO: 5545 - DNA, 564 bp, Homo sapiens
  source 1..564: mol_type = unassigned DNA
cgcctccaaaccgcccatctgcgacggccccgcgagcgtgcgcagcccagcccctcccggacgtcctcgcccccgcccgggcacatcgtgctccgcaccgaggcagagaggggcacgcggatcccagcccctgcgagcccctctgcccgccgccacttcacaccccgcattgcctcagctgccgttccagaagatgcatcgtctggcgcgcaaagcggtgcacggtccccagcccgcgcgcagcagcctggaggggcgccagagtccccgtcccacttcctggcggcactgcccccgggcagctccctcctcccctctctccctccatgcccccaccccatcttgggacgcttccaggaccgaagaggcaggagggggatcgcgaggggaaggcgcggagctggggaaggaggagcagcgccgggcgcagcagctcagggcggtccgggaggctgcgcggcgctcgcggacccacgccccaggacagaggacgcagctccgagcatcgcacgtggcttccagattcctcccacccctaccctggcgaccacgagagggggtcgg

SEQ ID NO: 5546 - DNA, 3277 bp, Homo sapiens
  source 1..3277: mol_type = unassigned DNA
cgcggcatggtggccctcgcgtgtgtgtgcagcgcctgcaggtgtcccgcccagcgcctcctgcacaacagttgcaggctggacccgagggtctcctctcctggggccccacagtgcccagaggtcccgctagccccagacaccgccccaggctcccctccctttctgacgccgtccactcccttcctctgcggaagggggacacgctcctctgtgccgaggtgccaggccgctgagatctgctgccctggaggaaaagccaggcagggtccctggccttgggcggctaggaaggctccacggctgctggggatagagacgcggggccaggctaagggttcccgccccgtctaaacagcctgccctgggcagggcagggctcctctcccgcgcccgcgcgctctcggctgggcacggtccggctccaggcctgacgggcgcggcctccccactggacgcgtgcgggagggcggcgaggccaaagcgctggggccaggagggcacccgcctagcggctccctacgggagttggggcagaagacgccgcgaccccgcgcgggtaatttctcccgaggcgcgttccagcccgtggcgctgccggcgcagaccccgcgtggggaccggcgaggctaacccctcctgcggcccggggtcggcagagcacgcaaggggccgcgggccgcgtgggtttgggcgcgccgtggtgggcaagcggggccagcggagcgggaacccgcacaccctccgagcggagccgaggacaggcccgtgcgggccgcggggtccctctggcgccaggaagcggcggccgaaggagacaacgagaacgcagccccggctcagggaggcttaaaagctgagatgctgaacgcagacggcgggcgctcgggggctggggggcgggtagaggccgccatttctcaaaaaggtctccatcgagccggcctctgctcccgcccgaggggcggacgcccgatcccggcacccgggactgcccgtgggtccctgctggctggggacccccagcccccggctgcgcgcagggaaaggctgcagaacgcagagaccagagaagccgggggcggcggggaggggtcggggggccacggctgtagcccggccccgcagtctcggagcctcagtttccttctctgtaccacgggagcgtggacggagggatttccgaggctttgaccgctctgatagccccggggcggggcggggcggggcggctgcgccagccctggtcctgagcccccagcccggcgccggaacccggaccgcgatctcgggagccgagccccgcggtccagatgaaggcgcgagtgcgcgggtgccgggtggggtgtctgagcgagagcggagcttctcaggtggacgcccccagccacctccgggacccttcctgctggcctttgggcctgagaagtgggcgcggctggacagacgggaaacagccccccacgcacaggtggacacccggggataccgggcgcgcgcggcgcctggcaaggggaagctgctggagacgcgggcggctgctcccgcggggcccccttccgaagcgccgctgcgaacgtccagccccggcgacgccgcctgcccgcgatcgggccggcgccgcggacaggaaaggctcgatcagctaggtctgcctccgagaagtccccagcgccccgcccgcacggggtggggactgacagtcccccggggacggggccgggtccacagagcccgggagctgggggaggggaggcgccgggggccccgacccgtgggaagtccctgtacccaggctgcccggcggcttctcaatagcacacggacatctaagaaacgcggggcggcccggtgacccccgctctggacttagtggcgccgcgaggccccactccgagccgttgaccaccgggcactcgggtgttgacgacctgggtccttgggcacccagcccggctccaaacgaccccggcccaagggtgttcagtgcagccaggagggccgaaccgaattctatctcccggacgcggtggtttcccgcccgcctggagccccgtcggaggttcggggacaccacgcaggtggtccatcctcgagtccggggccggagcccgacttccttccccctgagctctcggagccttcggggcagcagcgccggcccaggcgggggcgggggaggagggggccgcggcagctcccagaagggcgggggggacgcgagcggaggcagccccggtggcgcgctcgtgagacccccgccgcgccgcgggcccgggccgcggacaattaaagcgggattcctcccccgctgacgtcggcggctcgaggcccctcccgcggcggcataaaaggcgcgggctccgcagcgcaggcggcagtgggggcctgatagcgcggcggtgtggaccgcgcggccgaagagcgcggcgcccagagcgcgggccgctcgcggagccacagcccgagccgggtcccagccggagccgagccccagccgagccgagccgggcccggagcgcccggtgcccgcagccatgccggccggccgcgccgcgcgcacctgtgcgctgctcgccctctgcctcctgggcgccggggcccaggatttcgggccgacgcgcttcatctgcacctcggtgcccgtggacgccgacatgtgcgccgcgtccgtggccgccggcggcgccgaggagctccggagcagcgtgctgcagctccgcgagacggtgctgcagcagaaggagaccatcctgagccagaaggagaccatccgcgagctgaccgccaagctgggccgctgcgagagccagagcacgctggaccccggagccggcgaggcccgggcgggcggcggccgcaagcagcccggctcgggcaagaacaccatgggcgacctgtcccggacaccggccgccgagacgctcagccaactcgggcaaactttgcaatcgctcaaaacccgcctggagaacctcgaggtccgcgcgcgccctcggctccggttccccctccggctcgctcgcccctctgccctcccccaccccgttccctacccggccaggcatcccccgccctcgcctcagccgcgcgggtgcccggccggtgcctccccgcgcctgcgaggccccgcggcggccactcgccccagctccctgccaggccgcccccgcagtcgcccagaggggaccgcgccgcgggccttccagcacggtccccgcgcctcgcctaacggtgtggtttcccccgcccttgcaccccgcagcagtacagccgc

SEQ ID NO: 5547 - DNA, 5692 bp, Homo sapiens
  source 1..5692: mol_type = unassigned DNA
cggacgccaatcccacgaaccctgcccgggctgggggcctgggacgctttccctggactccaggatccgtttgtacggagtcacagaacacagcgttatcgctcgtccgagcccaggtaccctccttccttcccggggcctgcgtcgcctgcacgtctctccgcagatcctcgcggaaacgtgcacagtagggctctgaacagaacccaggctgctctgagccgaaccctctccggcccggggctgaccgtgtccatccaagccgccgtcccgctccccgcacccccgacgcggggccacctcctcccacctccctccccactcaggcgcttctcccgacagcggagggagagtcaaaaacccacaacccggcggcgggatcctgccggctctagctgggcgacctgggcgcacccgccggcgacgcagtctcgggtctcagcgcatagaacccggccgcccgcagcccctcccgccagccacgccccctgggccttccattggccaagccgcccgcgcctccgcgtgattccattggcctgcgccgggggctcagacaaagggagcagccgcggagggcggtgattgggcggggttgggggcgggtcgggcgggcgcgcgggtcgggcgggagccgcgcgctggagaggcggggagcacggcgctgggggaggggcgcggtgtttcgggcccgggaccgggaggcgcgggtgtgcggcgaggctcgggtgccttccctcgtgggggcggggcggcgggggcggggcggttccacgtgggtggggctgggcgccccggagggcggcggccgcggggcgcggggcgctgggatcccgcccgctcctccgccctgcacccctcccgccccggggctcctgcccggacggcggccgccgccgcctcgtcttccccgagggctccgcgtccgtctccgcagctcggccgggaacctgggaactcggacgcagaaggacgcgcccgagccaggacccgccgcggggtccctctggtgggccgtggccggggagaggacgcgggccctggcggtcgaagacggacgcagcgcccggaaaggcgagccaggtctccggctcctggcgcttcctgtgagctggctcggcggggtgcgtcgccggggagggagggactggccgtggggcgagcagccgggcggggagtggcttctgggggccttcgccagcggagggcccgcgaggccgccctcggagcgccgccaggtacgtgcgttttccttgtttcccgcgctcccagagcgcactctcggtagggaacgaataaaatcccggctggtgtgtaagagcctttcgctgcaaacgtgtctttctgcgggattcggggagccgccgaacgcggggtagaccccggcccaaagtgttcctgcagcttccaccagggacccttctccaccctcaccttgggctcggagcgggtgccagtttggaaatgcttgtctcttctgcagctccgattgaattcgcccaggaggaggtgcgccctgcctcggcctcagagctgggaggaccgggctttgttccccgaagctctcccaccccgtcctcctggaaaatgcggattttttctagtagggatgctcagttttgagggggttgttttcggaggaagcttgggttgggaaagcccgatattggccccaatctggcgggcagcttcccttgtcttggagcagcccctcctagcccccggagccccggacttacacggttaggagacgcccatgggctttgggggtattctgcggggtccgaggaggccgggtggcctgggcggggtccgaggaggccgggtggcctgagcggggtccgaggaggccgggtggcctgagcggggtccgaggaggccgggtggcctgagcgggctccttcccctcccccatgtgcacgtcaaacaaaagaatcttcgaacagttttggggacagaactcttcggaatgtgagcctgtcctccccgccccccttcctaggaaggacaggggtctttcaacaaaggcaaggctgcggttggagcgggctgaagggaaggagcgctgttattttggggtacttgatgaaagagaaactcactttctctttctcctcccaaaattagaggcagctgagtcagagctctccctactttcttacctgattaatggggtttcacacgatgtttgcatttggggtgactgggtttgaagactttcagaagtgggaaaggatcctgcttgtgtgggagattggaaagctggcctccacccggtgggggatagaacccctatggagtgaaatggattccaggccattttgcggaagattggaaatttaaggatttgacgggggggcggtgattttgtgtccttttctctcccccctcccccctccccagtttagaacaaagggcggaggcgaaggaggcaagatgggtggtgggctcggaagccggagtcgaaagaagaatgttataaaagtccctcacttcccagtccccgcgcactcccaaatagctcatcagagtttgggtggggacaaagtgaatgaccgcctagagtcgggtttggtacccatggcccggttttcggcgcgggcgtccggagcccgggggaagctcctccagctcgtcccaagtcgcggttggccagggcgagagaggtcggggcacagcgcgcggtttctcctgccgccttcgaggaccgagactcggggttcgcggctccctgactgcgcaagtctcctcgcccctcctgctcccccctcccccccgccgaaagacgctcggagcgcacacccgcctgcaccaaagccagggatctcatttctctcaaaataaaacaacaagccataaaggctcctgattccagtggaaaaggcgccgcagatttatggtccctccaaatccccacactctaattatccctgtttttagtttacttatgggtggtgaccaataaaatgattttccattttgaatttttttttcaacataaaaaatgcaagcttcgcttccctcttacccgcttggatggatcttttccgtgcgggaagcaaagaaatcccgtttccctcggccttatcggcccagggctgagctgctgcctccggttgagcgaacccggcctgccgcagcaccccccaagcacccccgccccgcacacccttaattgcaatttaagggagaatattctttccgtcctctcttcgcccaagggcatttgcagggacccctccctagaagtcctgtcgtgggcctagcggctagaagggccaccccgcagagcgggtctccgacagccccagcccggtcacctttcaaactgcgccctcctgggccccgcattgggcgcgagcctggggcgcccaagggcccccactgaggaggaaggttgccggaccgagccctcgccaccgcttggcgcccccatcccccatcctcctccctttgttcgcctttccggacgccgacttggagatggcaggaaaaaaaaaataatcagatggaaatcaaagattagcctgggtgcgcgggcggcctccgccgggccgggccatgctcggcccgcgcctcataaatcttcctcgcgacgtgacaacagccgcggcctcgtttccctgggaactcaggaacgcatcgatcctcctcgccgtccgcgcaagtcccctcttcgggagcgagaacggagagtccctggtgaccctgacttctggccagcgcaggacgccccaggccccagccagggtatcatgcacaggagtggaggaaggtggaagggaaggggcccaaccctcacccaagaaagcgcagcaaatacccacaccccgcaggttaaaccaaacacattattaggggccgcatcttctctcctccgcgccgcctgagaagggggcggaaggaaggacggagaagggtgaggggcggattaacccctccctggcgactcctttgtctggcccggacattgctgagccgagtggggcgcccaggagccagcgaggggctcccgaggcggccccggctcggcccaggtgtgcgggccgcggtggggcgcaggttcgcagcggagccacgagatccccgcgcctccggctgacgtccgggcgcccagggtctgcggccccacgtgcgatccatccgggagctgcgcctcagacgcctcgtggagcgggggagaacctgaaggaagtcgtggcgcgtttagatattttaaaaactcgaattaattgggaaaataggaagggcgcttccaaacgcggagaagacatcccggggtggggaaggatgtcttttaaaaattatatccccttgttgtggcggttgtttttgacctttcctactattaaaagaaatgttgccacgtttaatttttgttgccatgagatatggagggggtagcccagcattttgaagtaatttgataagccttcaagtagtaaatccgaaagggaggccggcggcccaggtatagtttctttgtaacctgaatttacaatgaaagcattctcctttatggatataatagattagatttcacaacttaattcaccggaatggctccgtttaagggagctccggctgattttattacgccaagccaaattggatgtttgtggtcttaacgaaaagcgatcgtgacataaaatatataatttttaaagtaaaaaaccagcgggttggatcctgtcccctcccctatccttgctccttactcccaatcccccagtgtgggaaatacggataattatttgtgtgtgttggtttctaccggggagacaggcgctctgggctccttccccggcgggccagaggcctcgccggccagtgcgcacgcggcgccggttcccgaccaaggctccggcccgctctgctggctcgtttgaaacgtcgacattctcagcgcacgatccggggtctcgggggcacccatggggcccgaagcctctgcctgccggcggcgaccggacagctcccccgggcgcgcagggtagaggaagcgccctcgaaagcccccgcacgcattcacgagccggccctgcgcgggcacagcggcagccgcggcgggacacccggcagggtcttcggcgctactttgtgccaaaaactgcgctcccggagacccgggcaccgccggcgtcggcagctagagcgggacccagctcccaccgcgtcctccactggagcccctttcggcccctcggcgagtgcggcccgtggggagtgggcgtcggcgcgaggaagttccccggcccgggcgaccccggcttctgagcggcccctccccacgtcgccgcccgccaggccgacggaggaccggggcggggacgggggtctcagcggcccattctgctgtcacttctgacctattctccagcaacggcgcgtccccccctcggctttttcgcgaggtttgttgaagacggatttagcccccgcagagctggggaaggacggatggacggaaggcccagcgcggcccaccccttcccctcgtcgtctcccggctggcaggagccgcagcgacagcttcggggagcggggcctgccccaagacccccttcgcggcatcgggagccaggcgtggccggaggcaccgcggctgctccacgtggctcccgccggccgccaccccgcgcggggaggacgcgtgcgtgcggtgcgtggccggcgggctgcggggacgcgc

SEQ ID NO: 5548 - DNA, 7937 bp, Homo sapiens
  source 1..7937: mol_type = unassigned DNA
cggcgggtccctagcgcagccctgcgcgcttcccccgaatctacccgcgccgcctggtgacctctagggcttcaggcgtggtagctgcccctaccctgacctccctcgacactcatatcaaagccaccgggaagagggctgccctggaggcctgggcccgctctgccaaggactgatcctctcgggcagggagtcagaggggaccgcccgagaggatccgtccctgcgaggcccagcacggcgccccacgctctcctcttggagcaaatccgcctcgctctcctcttggagcaaatccgccgcactctcgcctgcaccgaaatcctgagcgccgccccgcgccacccccagcccgcgcccgcgctgccctcctccccgggccgcaggctgagaggctgggccgcactctggccacgctttgtccggctttagcgggataccagaggcactcgttaaggcaaatgcatccctgcaaacccattctcgccctgacactttaaggctttatatagaaacaggatttgctcgtcttacaccagcagtccctattaacgctcgcccggcgcacacaccactctaatccgcgaggccgcggcgtaccctggtcccctccccccgccacaacagccgttttgtttccgcagaaagcgcctcgttgtcccagccccggaacgtcttagggaggtgaatgcagaatgcagaaaagaggtttccgtggaatttagatctgcaggagggggcgggggagggtggcgaggcgcggaaaggctttaatttcagccggctccggggctgcccctccgagacccccgggggagggtggccagggaagggcctctctaagccgcggcgacgcagcttggggggctggcgggacgcgcggccccgctcagcgcccaggcagccaccgcggccggggccgggaaatgaaaccaaagcttctctgctcccgggagcggaggggtgggcgccctgttccgctctcgaacgctcccgtcccgcgcccgccccggccgagcactgacctgtgtgcgaagccatgggcaacggcgacgggaagtactttcccggctggaagtgtgcggggggctgcgcggcgggcccagccggggcgagacgcgcggcggcagcggcgctgcggtggcccaggctcccgcgctccgacagcagatgcggcggcggcgcaaagtcgcggccatccatgccgggccccggccccggtccgccgccgcttcctcggagcagcgcggccggggcccgggggcggctcggcgcgcgggcggcgcagaggcggcggcgtccggggtcacaggcggtggtggcggcggggccggtcagcacgcgggaggactgggcttctcggcgggcggccgcgcaccgagccagcggccgctgtgcgggtccatggtctgtggaggcaaaagcagaggagacacgggtgactggggggctcggctcgcccgggggtccccgccccgcccgctcacccactccccccaccccccacccccgccggcccgagcgagcggcggccaggccgggtggcggggccggggcgctcggtgtctccccgccgcacgcgcgcgcagcccagcacccggggccccgcgcgcgcacgcaccgtcccggccacgcttggcccggggcagccgggggaacccagccgcactgctcgccgcctcccgttctcgtccccgcgggtccctgcagctagggcgccgcggcgaagaggctgctggctctgctgggtgataaaaacccaaatctgcgaagccatcacgcacactcgcacacacacacacacacacacacactcacacgcacaccctctcccctcccccgctgcccaaaggtgtctcggaggaaaaggcctggggtccacactagctctccccctctccccacctcatgccgaggtccagcttttactgcattccgcttaaccgaataaccatgctaattaagcgagtaattttattgattgtaactcaagagttttttttttttttaataaccttccttttctccccactcccatccccctcatgcatctttcggcccattcttctgaatccaccgtggtcccccctccccagccccagcgggaccagctcctgtccccagcatcgcgctaggaccccaggccggctcctcagagccccggaggcccgcaaccgccaccggcatcacctgggccgccacgccgcagtgcccggcctgctgtcccggagccgggagcttcctgttgaggctgtaacaatcaccccgccccccaatcaaattcgcccaggatcttcctctgcggattgggggcttgggggtgtgtgtggggggggtgctttcagagtcagaatgctctctctcaacggcccaaatcggccctgggatttcttccttcagcgcctgccggggaccgcgagcagaggccggtctccgctccgggcagtaccgggcggcctgggtacgcggggtctgcggcgcccagctcggccctctagccggggaaggtgggcccggcccagcacaaccttctgccagcagaccctgcccggacctcggccacctaaaataaccctcacctccattttcttccacccccacccaacgcggagcatccactcaggcgaaattggggacaattttagactctgggtgcggagggtcggagccagtgatagaagctgcgtgcaccaccgtgctcccaggcgtccctccgaaggcgctccctggacgcacttcacatattactcctcatcttctaaatacgtattgttttaatgtttatcacctccaacaaaagggagatggataggcttgatattcctaattaggaactttgcggaaaaccttgtgtttttgtagccattccaccatgacaacaaagcgattaagatgttttccatctactgaatacctttttaaattgcgatattttatggtccgggttctaaaacgtcttatttgcagactattttgtgtttgatttaatctataaccgaaaacataatgtattaagtgaatacatatttgctcagctgataagcttttttaatatttattcggagagcttttgcattgtaaataaatgggtctacacaaagagttctctttgtctggcaactacatacaaaggcgtttggggctcccttccctctggggatcgccagctctctccccgggtctaacaaatagctcggctcccaagccccgatcccggcctgcaaagcgagcgcccggccgccagggcccggagagtgctctggcgagggggctgcgagcgcaggggtcaggggaggggctgcccgggctggactagggacgtgggggcccccagccccggccggcgcctcccgagccccggagggcgccgggcgggacaaagggaaagaaggaaagggagggaggtcagaaacctgcagcttcaaaggcgccgaaggccggagaggggccgggggctgcgcacgcgggggtgccaggcttcctggcggcctccagggagtcgtgtgtgctgtgcttttgttttgtggttgtttttttttttttttttctctccaataagaaatttcaaagttgagaaagcgcgagctgccggcgattctcgggacgcgggctcggctacgaagcaacaattttaatctcccaccccctgcgggcggatcgcaggcccgattgttcctttctcaccagcctgctcgactttttaagcaaacaggaggtggattactgtcgcctgcctgcgccgccacggctctgaccggattggagagagcttttctttgtgttctctcctcccggggagaggccgcgccgcgcctccgcgtctgcccgcgccgggcttcgggggcctggggagcctgaggcggccaggaagtggggcgaggaagggcggccacacggcccgagctgggagtcccacagtcccgcagcggcgacgccgccacccgccgagtgccgaggcccggggcccactcccagcccagctccaggagaggccgcgccggaggaccgcgaggacggcgccgcagcgccaggtcgggctgaggtaagggaggaaatggagcgaaaagtggcggcgggcagagggccccgggcgggcggagaatcgctgacgagggcatttcggaaggaactgaacctaggagcacagggctccctcccgggaaggcagggcgtgaccctggagccgccggtccctcttgccgcggccccaggcgtggctggcgcgctccaggatctggagcttctacaagtttgctttgtttcctgcttttgcatctaaaaacccgctctctcctcgcccgcctgccggagaccaggactctggcccgtctgcctccctccggcgtcgtctccgggagcgcgggcgcggtggggcctgcaggccgggctgggaccaggcgcgccttggggcgcgagtggctcggccgtcgccgcagaacccgctccctgcgaaacagccgcacccgctccctgggagagtcatgagaactggggtcgcgcctgacccccgcgcccgaagaaaaccagcccgcggaccccgccacacgggccgtgacccgagccccgcgcgccgtcccgaacgcgcgcggtgaaaacgccccgctgcgccggccttgctcggtccccctcctccacccccacttctccggaaaaaaaaaattctgaattgggaacgaagacccgaaaaactcgccatgaccattcccctccccggcccctagcttcggcccggaaggcccctcagggcagcggccgtgggtaccacgacccggccagttcccctcgccgcggaccgaccgggcagggccaacccaggactgttccggggaggggagcagggtaggggagcgaatgttggggttcgttcgtgggtcacccagaactgggcgcacgctggcggcgcccggacttcgcctactgtccgcccggtgccacccgcgcggctcgcgccagacgcagcctggcggtccctgtcctgtcttcgagtatttgtttttaatgctgggtgtcgatcgagacaacaagcgctcagagcaaagcaaggatgcattacgggggtaattttaaaccgatcgataagatttttcagagaaaaaaaaatcgctcatagtccatattttttaagaaaaaaaaaagcctcaacattttaacggattttgttaaaagggaagatatatacttcttaacatcacaatcctgaatttcttttgctaaaaaaaatgtaaaaccccaaagccagaataaaaaataaaataataataaaaatacaaaaacaaaaaaaaaatgaaagcaatttcagttacttactggaggctgtttcctggatacaactgaatgcaatacaattaaatcagtaaatgtgactttgttttgtattcctattggtattttcaatgtgctgactgttgcactgtaaatgcaccgcttccacaacaacgactctagcgagcccatccagagcggctctcaaacctgcagcctggcgcggcgagccacgggccctgcatactaataagctcgtgccactcagcccggaacagccagcgcgctgattggccgcgcagccctccacggccgggagctcgtgccactcattcggcgtaaacaggcctcccaataggctggcgccgggccagggaactgccaatcaggaagcagcggggctactaccaagcccgatggcgcctaattcaagcccggcgactgcgcagctcctctgcgcagatcattgctgctgaatgggaatgtggtggcgcagggcgggagagggagctggagcgagcgagtgcgcgtgtcccggcggagggggaggcgtagacacagacacagacacacacacacacatatatgtttaatccagcaggtctaacgtttggcttctgccgcacagaaggccaagggaagaaacaccaccaccccttaaaagtagctgctttttctccctggaatctgtctggcaggtggcaggtaggccagacctccaagcccagaggcctccccaggttgcctggcccatctaccgctctgaagctgctgcctgcccggacccgagctcgcggatgcacgcacgcacgcccgctgcttgggcagcaaaagctttgaatagcccgtccggctctctcctccccatgacctggggatcagaccctgggaagtgagttctgagtctccagccgtctacattactggctctcaattttatctccctctgccacactttgcaacagagcagctactaaaatgaaaatcagggatttattgagaagacaaggattgccctttcttcatctacacctagatttagaaaatattttcagtttggtaatgggggaagcgggtatggtgtggtaaaccatgtatagtatttctcaatgctgctccctgtctgcctatctgctaaatcctcactccaactaaagcaagccactgaacaatttttatcgtaatcagatgcaaaccacttctaaaatattccgcaaacaaatatttctgttagaatttggtttcccacccaaatgctatttattctcagggagtcgaggtgatgtcttagtggcgatggatacatttatttttgctcctctttctccatgtgaatctctgcctccccctctgggggaaaaaaggatatttaaactaggagccaactgacagattcacacgcattcgaaattctccaccgtctcattccggcagggacacgaaagagttaaactcaaagcctgttgtctctctgtttccccgcccccactcccgctcccgcgggaccgctgggattggttggcactccgccagtggactgtccatcaccgagtgtaaacaaggcgctgattggctgttgtccagtccgcactgggcctcctgaaaaaagcaattactggctccgcggtttcaaggcggcccaaggccgcttgatgaaaggagataagctggggaccgtttccaggatccccgcgggccgaccggggcagcccgggagccgaggtgcggcggagagcccgcggatcaaaggaatctggagagaaaggggaagcgggcggccggccccggccggccttcccccccgcaggccacgccgacctggggtggggggctgcgggccgcgggcggggactccgggatttcccgcctgcctgagtcggggcctacgccggcgcccgcttcgggcggctcggcccggaggggagctccggagagcccggggctcgcaggtaagcaccggcgctccgcgggccgggccggggacgcaggacaaggcgcggggcccaccccggctggctcgggagtggcggtcgcgcgggcccggctcccgtctccggcgtctcccggctccggcggccgggaccccccgcggccgagcccctggccaggccccaggccggcgccttcggaagcgacgtctggcgggccgcggggcacgagggggagagccgggaagcgtaaatccccgaagcgcgcggagatccgattagcgcgcggctattcattaggctgggggcgattgaattaggtccctgggcgcggtcgccggctgggggtgtgtggcgccgacccccgggctcttgccgtggcctcgggaggctggagcagcgagcagcggccccagcgagtgtgtcggggaagcgggtgcctccgggtcccggccccgcgggtgcaggcggaggctgcccgcttcccgcgtacaccgaggacggccggcccggctccggagaaatggcgcttgagaaaggaggggaggggaaggttcccggaccctgggcagggacccgtcgccggggacccgcggagccctccggggatggaggaggcgcgagctggaagcggcgcgcgagcccgagcgcggggctaacaccgtggggcccagtctctcctggctcgggtaagtggacgcgccccgaggccccgggtccacgcagggcgcccctcgcagacggcgc

SEQ ID NO: 5549 - DNA, 1408 bp, Homo sapiens
  source 1..1408: mol_type = unassigned DNA
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaaggtagggcggcggcagctccgcggggctctgggcggggggaacgggcttcggggcgcgcgggaggccacggaggtgcctcccgcgcgaaccttcccttgggctgcgggcccggggagtcggggctgccagggcgccgggttcgtgcgcggacactgggggcgcacccggctcccgggtcaggcgcggctggagacctcgaggttggggttttgaagcgcgcaagtattcccctccccatcgcgtctttgcaagtagtttgaagccctaagtcgttgtttacggattcccgtttccaactttttaattgaaaaaacctgccgaggagagtggaggcatcgccatccctcccggtcgcttttccacgccgcagcgctccccacgctcgcccagtcctctctcctcccgcctctagccgtttcccggcccgagcggtccccgcgctggcggccgggtgttttctccgggactggggatgttctccgtgcgccctcgccacatctggcaatgattaggtgcccgaggagttcagctggctcgggaagtgcatttggcatctttctccatcagattcaccgactggaaaatagttgccctcggttccgcgtcccttccacgtgcccgccttggggtgtgcccactggtgttttggggtgacacacctcagctggttagtcgccccctgcgcggtgtcctctgcaggccggtttatggaagtgtcagatgttatcgtactttagaaagaagcacgagaaggactgcagggcagccttctgtttagtggaaacacggagatttgtcagcggaatcctgatttatgtatgagataagtaaccgcagcggaggcatcaaagagtcgttcaggaatgggcccgcgtggtgtttacacaaggcttcgtgtgagagttgctggttctgtgctaggataacacagccctgcgtgggtgcgaaatgccatctgaccgcggtcaccccgcttccagccgccacagacctggcgatgcaatcgctttgacttctagggttgccgtccgagggaggcgcccgggaagccccaaggcgcttggaaagtaacttttggctctggaaagttttttttctgaagggcagctcccgcggaactaaccggagcgatgatatcctaccaattcactccctttccaagggcgttaggtgtccacgtcgggagacctcgg

SEQ ID NO: 5550 - DNA, 208 bp, Homo sapiens
  source 1..208: mol_type = unassigned DNA
cgccctcggggccgcgattctcctcgggaggtgtctgcgaaggcggctctgccgcggtgggggtggggaggctagggcttcggaccgctggagttggggtcgcagccagttcctggcgagtgtttcctggctgctgccgcaggggcttgctttttcggatttcccctctaatctcgccggacttcttccccttcccccccacgcccgc

SEQ ID NO: 5551 - DNA, 805 bp, Homo sapiens
  source 1..805: mol_type = unassigned DNA
cgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccaggtaacttttccgcctctcggagtgggggactgcgagggggtctcggctttacgaggtgcggaggaagagcccgaggcctggggcgaggcgcgcgggacagtggggctgacgcgtggcttcggcgccgcgcggtctcccgaatcccgagccccgcgcccggcgcggccggggtccccaaccgccctcccgctcgccgggacccccaccgggccgagcctgcgcgccgcgccccccgcccgctccgcccgccgcggcgcagtagtggctgggccggcgcgcagagcctgagccccggcctccggcctgggggcctccctgggatccctggccgaaggggcgactcggtccccgcgtcccttctccgccaatttgcacaaatcccccgcccggggcgccatgttttaagttgcccctcgggctgggggcgagcgcgggccggcccctcccccggggaggtgcgggggacagggggcga

SEQ ID NO: 5552 - DNA, 2462 bp, Homo sapiens
  source 1..2462: mol_type = unassigned DNA
cgagcgcgcggctgggaggcgggctcagggcggggcagagcgcggggaccgcccgggcaccgggcgcagccaacgagcggacggggagggcgggcccgcgagggctgagcggcgcgggctgtcacaggcgcccgaagcgcgctgcaggtggcaacttggaggtgccgccaccgcagctgcgggaggagcccgggtctggcggccccttccagcctccaggagctctttcccgccgccgagcccgagactggaccccggagaattcgaaggaaagagcccctgcggagggacctgtgagcagccctacctctctctgcccttgcgctactttttttctccaaggaaggttgtgcctgcgggctgcgaacaagctccgggaggggccccaaaggaaggcttcggtgactcaggtgagcgcctttctcttcttggcagccgggcgtaggccgggagcgccgcctagccccgtgggcaggggcgcgggtgcgggccgcctgcccttggctcgaggtcgatgggggagaaagcgaggaaggggcgaggctggcccgaccgggggctgcctggccgggtccgcccggaggcgacagggactctcagacgggcacctggagactagggacgagcagagaggtgctttgagggggacagagggcttgcgcccggtttaagctgaccgggatcgaccgcctgcgcgctgtgttggagctgccgcggaagccgggcgcggcgcctctgcgaaccccagagctagtgcgcggggcccggcgagcgcaccagtcttcggttcctcggagcccaaggccctggaggacgtcatccctctccgctcgggcaactcctcctccgccccctcttgcctccacccctccgcgccggccgtttagcctattccgagactctgtgcttttgccagcgcgcgctagttgctgctgtcactcccctccccgccctcgccggagttggagcgacctggggtctggctccccggtcccggcagcctagttgtgggctggacgcgagtggggctggccagttctttgcgaggagggcaggagtgagcgcgggctctctctctagtgctccctccgaatccgtccccgcccccctgcagctcgaaccgctagcccagagagcggagtctcagaagctagaccttgctcgccctggggaaacgcgggggaggggggggccttccgggaaggtgcgaacctcgcagatgaggccagagcctccgcctccatctcagcgtttcagcccctgctttcctgctttcaagtggacagtggctctgacctccgcattccggcttgtggcgtggggggcgctagcggcagtgtgtgtgtgtgtgtgtgtgtgtgtgtgtgtgtggtgtgtaaggatgagcgagtgcgatcctccgggaggcagaggcgcaggagccagttcccccagcccggcggagccgcagggaccgcctcccctcgccgccagctgcgcgcagctgcaccccggcaactccgcgctgccggctcctctcctccagctccagctcccggtacccccacgaccaacgcggaatcccaggattaaaatcatctggccaaagggtgcgggtgggggatcgaggcgttcccgaggcgaatgaggctgtttttcaaaatccgggaggcgcccctcgcccggcgttgcatcttcccgtggctcggctgtaaggacctgcggtggaggcttggcggaggcgggcccgcgctccagagagagcgtcacgtcacccgagaaggcgacgctgggggctgctgagcctcccaactccctttggcgcgtcctgctcagaagccggggagctcctggccggcggctggcggggaagcgcggcgcgggaggtggggtggcctggctggtgctgcgggagggcgccccgggcgcgtcaggggctgcgtgccgcggctggagggcgcgccgggagctgcggcgggctcggggcacccgagtggcgctggaagttgagccggggtccgcagggctcggtgaccgccctggcgccgccgctgcggattcgggagcagcaaccacgcggcgcgttcggccgccccctcggcccgccggccgcgtctttcgctttccctctgcagaagtgaagccgccgcctgggctcgctcgggctggcgacctttgcgccagaaaagcctgaggtgctggaggcgaaatcctcccgggagcgaagggcggcgtccacaagacaaggaaagggaagacgccgggctctggcgggtagcgcagtagcgggagggcggcgctgagcgccaaggatcccggaggcgaggcgaggccaggcggacccaacccagccaggaggtgctgcccccgcccttggggctctctcacaggcacctggtgttagttacagacccccgcccccgccagtccgcaactccctcgtaattccctctgaagtgcgatggattaagactgggccgcga

SEQ ID NO: 5553 - DNA, 990 bp, Homo sapiens
  source 1..990: mol_type = unassigned DNA
cgcatactctgtgcggcccgagtggtccggatggcacagcccaggtgtccgggctaaagttggcatctccaaagtccagaacgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccgccgctctgcctgcgctgccgcctccgctcgccggccgggctcaactggctcccagcgccgcggcgctagctcgtccccctgcagccgccgacgccaccgccaacgccgccgccgccactgagcccccggcgcatcccagccccgggcgccgcccacgccacccgccaccccgggtcgcggccccggtccgggtccagtggctgcgccgccccccgccagcaacgcccgcgcggaatgagcgcgccgcgctgcccgcgcctccatccgcagggctcggcgccccctccccgcccgccgcccctacagccgcgcgctcattggcccggccagcccacggggagccgcggcgggcgggcggcccctggcgctcacacactcgcgcgcgcacacacacaccacgt

SEQ ID NO: 5554 - DNA, 2274 bp, Homo sapiens
  source 1..2274: mol_type = unassigned DNA
cgtgccgggttcgcccccacgccggacccccgactccgatccacagatcctctccgtgaggggttcctctgggcttagaacgcccccgcgcgcgcgtgcaggcacacacgcgcacacactcacacgcttgctcgcacaccgccagtgcctctccttcccacctgggacccccgggcagccgggctggatgaacaagttgcagctggccgcggcgctccgctagggggacgagggtggggagggggagcccagcggggcgcagggccgtggccagggcctggggacctgcccgcttccctccgcggccgccaagccctaccgctgggaccggcgaggaactccccccagcctctccgcagacgctgcacgaccgcggggacctcccggggtcgccagccgcgccgggcagggggcgacagggagggcagggcaccgggagatcgccgccgccggagcggccgccagttcccggcgatcgctgcgggcgcagccgaacaccagcggcctgggcccggccgctgctcggggtcggcggggaccgcgcagcgcctacgccaggcggcccggcggctgcaactgggaacttcaagcaaagttttctgctgttccttttgcagccggccagggactcaagagtgcaagccgcccaaccttgagcactagcccaggccgcggaaggacggcggccgagctggcagtcccggctggggagctcgccctcggggtccgtccgctccgcccgcccgaggactgggtgcctgccagccccacggcccctcgcccagcgcccggctcacaggcagaagcggtgtccggcccgccgcgccccccgcccggccccgacgccagccttagggctctaccaccagggagctgtcggcgtcccgggcgtcccgcgccggcccgcgcgcctcgggggcggcagaggcggtcccgcttacctgagaacgtctcgcccgccgcagttagcaaaagtccggccaaagtcgccaggcaagtcccaagtcccctcatggtgctgagtgcgggccgggccgctccccggcggcggtgggtgggcgcgcgagggcggagggggccgggagctttggttccgaggcagcgaggagagacgggtaaacagcagagcgctaagccaagcccccaaagtgccaacagttgcagaagtccgaactccagcggctccaggggcgcgggcacagggtcctgggtcctcctcccctgtccctggccccactcggcgtctggcgccgctggcagagggagcggagggcgagcccgcggagccaaaatcttccctcggttccggttgctgagctcgccgcctctccccttcccctgcccgggacccgggacccgagctgccggccgtggccgtggcggtggccgtggccgtggccgcgcgcgttccgcccgccgcctctccacaggcagccccaagcccagccccgggcggcggcgcgccgatgaccgagcccgcgccggctgcgcgcggggctcttgctccccgactgactggcggtgccccgcaggccggctgaagggagcgctcacgtcacggccgcccggcgccgccgcggcccgctagagggcgtgagcgcccgtgccccgccggcccgcgcccgagcgcctccgggagctcggctgggggcggccccgcggccacagccactaccgccgccgaagcgggcgtcagccgcgcggggaggagcggccaccgggctccccccgcccacctcctcgccccggccgcgtcttctattttggtagctggctctggggagggtgactgtggaagaggctgcgccgccgccagaagtttgtcccgggtcacgagccgcgagtagtttgtgagcgcggccgggcgggaccagcggcctgcgaccccgcgggcgcggccaggcggcttcgagcctggcgccggacggcgatgtcaccgcacagggccagctgcacccggagtcgccgggcctgcgctgctcggcggctgcgggaaaagcgagccaggagatcgctgaggctccggagggctgcgagcttctctacgccgcgggcggagcgaagttggcgggcgccgggagatggcgcgggagccgggagcgccgagccccgcgatcgccagcccgctcccggccgggcccgccgggtacacgccgctggccccgagcactggcgcccgggaagcagggcgcgcttctgctgttctgcgtcctcatcatgcctcggtgtcccgtgtgggcccgaagcgagccgcaggcagtacacggaaggcgg

SEQ ID NO: 5555 - DNA, 882 bp, Homo sapiens
  source 1..882: mol_type = unassigned DNA
cgaaggctgtggccgcgctcccgccggccagttcccagcagcagctcatcgcccctgctccgcgccttcgctccaggcccgcacggtctcagccccgcggggatcagcactgagccggtcccgccgccgccccagtgacgggctgctgctgcgggaagccaatcgcccagcgcttggaggagggcgacgaggccttccgcgcgagcgagtaccagaaagcagtcgggctcttccgctccatgctggcccggctggcgcagcccgaccgcggccggtgcctgaggctgggggacgctctgacccgcgccggccgcctcccggtggccctgggcgcgttccgtgtagccgggaggctggaggcgctgcggccggaggagctgggggagctggcgggcggcctggtgtgtcccggcctgcgcgaacggccactgttggcgaggaagccgggcggcgagctcaaggctagggagggccggccctggcgcccggcgcgccccgcgacctgcttggctgcccggggctgctgcacaagccggtgacactgccctgcgggctcacggtctgtgagcgctgcgtggagctggggcccgcgcggccacgggcgcgggcgcgggcgcgggcgcgtgaacgtagtgctgagccgcctgctggagaggttcttcccggccgagtgcccgctgcgcaggctggagggtcaggcgcggagcctgcagcgccagcagcagcccgaggccgcgctgctcaggtgcgaccaggccctggagctgtgacttggctgtggggccggcccgcctccctgacccctgtcaagcccagcggctggagctaacccgcgggcctgggctttcgagcgctttgtccaggcgtagggggtcacttcgc

SEQ ID NO: 5556 - DNA, 4359 bp, Homo sapiens
  source 1..4359: mol_type = unassigned DNA
cggagcgtccaacccagcacaccgcctccggcaaactgcgagcaattcaaagcagctcgcccagtagggaggggagctggtgggaggggggtggaccccgccgcccgcagaggtggggagacctggggggcggctccgctcccaggctgcagcgtgggcctggtcccctgccaagccaggagcgcagcccggagccagcgcggcccccgggtccctgcgcttatggcgagggtcgcgggggaacagcccctggtaggtaacttgccgggcacccacctgagttctccgcaccgcggcccgaaaacctgggagcgtcccaggacaaagggccagccctctggaattagccgtgtgtgactagtgtgtgccagctcgtatgtgggggtcccagtgtgcaactaacttagctgctcaccgcagcctcggagaaacgagcacgcctttctgcacgtgtccagggcgggtgcggcgggcagtgcattgtgaacaaagccggccacctcccgcgccgcacctcggggacgattcccggacggttctccgcggagagccgggcggatgagagcgtggtgtgtgtgtgtgtgtgtgtgtgtgtgtgtgtgtgtgtgtctgtgtgtcttgtgtttccctaaggagccggaggcggcccgcgaggcagggacttgctctaacttgtttcacacctggcgcggtttccccgaagctcgggtggcgtccagggccgggcaggcacgcggaggaccagcagcgttcgctgcagaaaaagacatcgtcaactcccactcagaagcccacactgccctgagacctggtctttcattctttcttaaaaaaaaaaaatgcaaattgatggatgggtttcaattgatgcgtaaaatgcttcccttgagagcaagacaggagggccagggaagggggaaacaggcagttgacataactctcacagcctaactgccgagaattcggacttggaggtaaattcgaggacgcacccgaggagcaggcgaggctgcctcccagcaggacggcctggcaccggggcgcactgctggggacctgactccctcgtgtcccctcaccccagggactcgcagctggcccgcgcgccagggtacacacgggctgcgggagaaggtgaaagttaggatgcagcacgagctccgagagtggcctgggctgtgcctcctaagagaacagccgaggtccccggcggctctgggaagctgcccctgggccgggagagcgggaggcggcgacgcaaggacgcgcccggagcctgggcgcgccgggggcgggcgtttggctggaagtggggcagtgtctcctatgggaaagcgagacccggcgagctctttggctgcttttccagtttccgaggtgcccgcccccgcgcgcctgaggcagcgcagcccggagggcgaacgaatggcggttggcaaactttgagtgagagtgcgctccggatccgaattgccgaattgtggctgcggcagggtcggccgagacacaagttcgctttttccgcctgcccgatgggccttagggagacttcagctccagcttggtggagcgcctcgcccgagggagttgtgtcactttgctcaggggcagggagggcggcgccctgggcgggtggggaagggtccctgtggcccctggggtcccaagcgcctcttccctcgtctcccctcccaccggcccctcccagtcttctctgcctcgctccttcccggggctggctggaccggcgcggacttgccccagacctacggggagcgccccaggtctttaatgacagcttaaatgtggctgttggaaaagtcgaaagggatgtggctgacgtggggcgtgtttcgctcctttgcaagagtcggaaagggagttgggagccgcgcggctggccccaggcccccgcgcctcgccgccagcaagtaggtgggggagccgccgccgccgccagccccatcccgctcccaagcctcgcccgctgcgccctggccgcgggcgccgagagggtgcggggcctcgccgtgcctcctccaccctgctcattaacctgcctgctccgctccgctccgggcggccccagacacgggtttcccgcggcagcacccgcggcccgcccggcgcagccgccgccccgaccccccggctccggggggcaatgagggggcagtggaaggggcactgctcctcgggcattacttagagaaacgagaccgtcccgccctctcgccggccctccctctctcccgcccgggcccgcgcaattctccgccagagggtaagttgggagtgtttcgcccccaccgacagctctccctccctttccttttttttttccttcaaagttttcttagaagtgggagccgggtgggggaggaagaaggtctggtcagcctccgtcctttaccctatctctccggtctaacttgtccccccctcccccctcccctccatcccctgcgcgccgctgcccctccggagctgcgctcgggaatgacaattggagcgcggctcctttaagagcccggctttgcctcccggtagctgaaggtcattaaacacaaaagctctcagcgctgcggtccaatatagcgcatgcgccctgcccgaggactggcagagagacggcaatatggcgagaatgcctggcagcggggactgtaacaccagcgcgggcggcagcgccagcgctgccgccgccgccgccgagaacaatggggagcggggcgagggcgagcgcggcgcggggggccgcggccgccgccacagccgtccgcactactgcagcgcgggcgaggaggaggaggaagaggaggaggaggacgagatccaggaggtgcagataacgggggacgaggaggaggaggaggacggaggtggggggctggaggaggacgaggaggaggaggaagaggaggagatggggctggactgggacgagcccctggagcccgaggactcggccggggaggagctggagcccgagccggtccatatgatcaatatggaccagagcgccgcgctggagcccgaggcgccgccgcgactgctggcgccccgggcccgcggtgggccgcccggggacggctccgagctggaccccgacgtgctgcagcgccccgagcgggcccggctgagcgagaacacccggctggccacccgctacgccgtgcgcatcttccgggagtacctgagcgagaaggcgcagagcccggacttcgagaccatggacaagggggcgctgtgccgcgtgctgcgctccttctatgccgaggcccgctccaaaagcggccagctctacagcaagtcgtcgctcatcagcatccgcagctccctcaaccgctacctcaatgagcccccgtactgccgcacgctcgacctcaccaaggaccccgagctgcgcagcgccaacctgacgctggccgcggtcatccgcaagctcgaggagcagggcgccgggccggtggtgcagaagcaagccatcacgcgcgccgacctgcgcaagctgtacacctccagcgtcttcagcaccaacacgcccttcgggctgctcaacaaggtctggttcgagacgtgcatgtacttctgtacccgcggccgcgagaaccagcgtgagttggaggaggactcttttgggctggccatggacgaggacggtcgcaagttcgtctacttcaagtccctcgggccctaccacaagtcgcgctcgtcgtcgtggagcaagaagcgcgccgagagcagcgacgaggagaacttgccccgcatgtatgagacgggcaccgagttctgcccctacgccagcttcgtcaagtacctgtcgaaacgcaaccctctctgcaaggcgttcttccagcggccccgggaccactgcagcgagggcgatgtgacctggtacgagaacaaagccatcggcaagaacttgctaggcactcggatgcagatgctctccaaggcggccaagctctccaagacctacaccaaccactgcatcggcgccgtctccatcgccacgctcaacagcatcgcgggcattggcaccaagctgggctcgcccgccccgcagggctgctacgccgaggctctgaacggggcggcacggcaccactcccaccacccccccacccatccctcccaccaccaccgcccccagccgccctcgctggggaacacttacatcctccccaaagacagccaggtcgggcccgacgtgaaatccgaggctgcgcccaagcgcgccctgtacgagtctgtgttcgggtcgggggaaatctgcggccccacttcccccaaaagactttgtatccgcccctcggagcctgtggatgcggtggtggtggtttccgtgaaacacga

SEQ ID NO: 5557 - DNA, 2762 bp, Homo sapiens
  source 1..2762: mol_type = unassigned DNA
cggggcggtgctcggcgcactctaggcttccctccggcgaccccccgcgggctgcagcaaaatacggggcgcttcggcggggcgggggcgggcggctgccgcggatccggccggctacagccgcagcttggtggcctccgattggccacgacgcgggcggggaggctcggcggaggagggaggcgggggcgagggcggcggcggcggcgggaggaataggagaggggagcgggccgcgcagccaggcagcgcgtggggcgagcgcggggagagcggcggcggctcgcccaggtcgcgcagcggaggccgagcggggtgcgcggtcggcgacggagggcggcgcgcgcgagtgagcggcgcagggcgaggaccggcgggcgggtgccggtgcgcgggcagcaggggcggctgcggcagcagctgcgcgggacggagccgcggcgggagagaccgcgccggcccctcgcctcacccccttgcggccgaggccggagaacagtctccaactcgccgggggaccggaaagaggagccgagaagcgcccctcggcccccacgcagcggaggcgcggagtggcgggactgctgctctttgtgggtgcagcacgcacgacccggagcgccctccccgcggcgctgtccccggcgtcttcgtcgcgccgagcggccctggagcggggacccggaggaagcaaaaccacgagcccgaaacctcgcgtggcggagctcttggggagcgccatccgctccacttccacctccacatcctccaccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggtacgcggcggtccccgcgggccgggccacgggcggggtggggcgggcggcgccgggtccctttgttccccgcgccgctgcggggccgggctgcgcacccgggaagggaggtgccacgccgcgccgcgccgcgccgcgcggccggtagctgcgcaggcatcgggctccgtccgggcgccggggcagggttgccggggccagtaggtctctcgcgcctttcctggcggggctctaggggctggattgcgggtcccctctgctccttcttcggggccgagcaagctcgcggggggtgtccccaggcagcaggagggtgaggcaggataactcccaggttttgcagttttctgtgcctttcgcccctcgcatagtactttgctccaatttttttgtttatttctgcagggatgggtcgcgagtttacagtaggaattctcactctggtgtcttagttacgggacttgcctccaccttaccccaccctgcacccgtgcgcctcccggtgctcaagggctctactgtcctattgtctttatcccagtctggagttgcctccttttcttcttctcttgccctcacaatattctgtgttcgtcccacctggaaagaaaatctggccctcttgcccggaggagtctctgccggtcagcgcctgcctgtagaacgagtctggcctctcacgcctagtatctcccccgggcgagaagttccgttacgcggctgctcctttctctgtccggctgcctgtgccctatatgcgccccgggggcgcctttgcctggagccttccgtacttttcataccctcgggagagagccagcgagccttttcatttaatctctactaagaggctcctccgcggcaggaagcacctgctccagtccgggcgcaggttccctcgccactgcacgctgcgggttcccagcccgggggcagcccaactttccgccgcctccaacccgaggatgcccccaggctcctcccgaccagccagcccaggcctggaggccacttcacacagcctcggccgggaccctctagctgggcgggtgcagtgccctggtcccaagtcggtctccgcctgccgtggggtccctcgaaggttgcgggaaaggggcgtgcccaccctcgccgcggggcaggaaaatccacggagggtccccctgcctgtcgccctcggggcaaggggagaggtgctctactgccagctggcagccccgaaaagtgcggacgcagctcggaagtgcctgctccgggggtggagacaggtggtgtggattaccccgctccgtggtcttcacgggtcagggcctggcgcgctccggcccgccggggggtgagtgctgctggggcgggggcaggggctggacggggctggcctccgcagtctctcgcgctttctcccgcaacccctagacggtcgtgggccgccgccgcgcggagccctgtccatggtgcgccatggtgcggcacgcctgtccctgcccggctccacgctctcctcccgggtcgt

SEQ ID NO: 5558 - DNA, 338 bp, Homo sapiens
  source 1..338: mol_type = unassigned DNA
cggagcgggggcggcctggagcgctgatcgggcgccgaaacgccgggagtcgggggctaagggctcgagccaggaggccccggagcagcagccgcccgctcctcacgccgccgccgccgcccccgcggttgcctggacacgggataaccgacttggggcctcgaccgcagcagagccggaggggtgggcaggcgcgggtccgggagacgcgcggggaaacgcgcggagccggtgagtcgggggcgcttgtgcctcggcgcgggcgcttgtgcctcggcgcggggcgctgccgggcggcgcccactccccctggccgcccgcctgcgcgactcccgcgg

SEQ ID NO: 5559 - DNA, 1435 bp, Homo sapiens
  source 1..1435: mol_type = unassigned DNA
cgggacccgtgtgcccttcggggctcaaaggcgctgggcgggcggctgctttcgggagaggcgcagccctcactcctggaccacggggccagtggctggggaagcttctggggcgcgcgcggggaggcggcgctgcgctccacctgcccagccccggacgcagcccgggggcgaggcgtctagggaccaccccaattcaatattgggatttttaataaaccaaggaatgggattttaattattgaaaacccagctcctctgggccagaatggtgttgggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggtgagtgactcgccttcctctgttatttgtctgccggagcagcccggcggggagggaggaaggagagaggcgggagagagggggagccgtgagccgccgttggctcgtgtgccccctaccttcctcaaccccctccccaagtcgtccccactcgcattagccaggcgcgttttccccactgtacagtctttgtggtcctttattttaaagcggcagcgcacctccagagctggcctccctccccgcctcgggttcccggaccggctgcaggagcttccttccccgggtcgggcggcggcgtctggcgtcctcgggctgggccattgtcccatgtccttctctgggcgcctggcgcgtgtcccaccgccgccaccgcgcctaaaggccaggctggaagcccggccgcacgctctgagagcagacgagtctgatcgatagtctacagtgtctccttattggcataaagcccgaatgtagcgctagcggtggatgtggggttttccccaggacactgtcaggttttatcgttagatcgctgcccgggaggcacggggcagcccgaatgcctcgatcactcccagagatcgttgccgcga

SEQ ID NO: 5560 - DNA, 510 bp, Homo sapiens
  source 1..510: mol_type = unassigned DNA
cgagcgtgagtcagcgctgaaggcccagagcgcgctgcacgagcagaagactctgcccggggtaagtggcgcccgccgtggcgcaagcggccgacgcgccgacagggggcgacttcgggaggccgggcggcggcgcggcgcgcggggagaggacggcagggcgcccgccgccccgcctgagctcgggagcccgcgcgcccccccaaatccctgggctctcggccgtccgggcccaacgggatccgggacaggggccccacttggccgtggccgtgaagttcctgcgcgggcagcctggggcgggggagcggcgcgtcccgggtccccggagcgggagctgcctccgccgggcccgcgggccgcgtgcgcgatcgagtccgcccatcgagtcgacgcgggccgctctagtgggggaggagggggccggcgtgggagggggcgccgcaagtgagatcaccgcggtttatttaaggagccagccctcgtctttgataaactatcgcgcctcgg

SEQ ID NO: 5561 - DNA, 2722 bp, Homo sapiens
  source 1..2722: mol_type = unassigned DNA
cgaaagtggctagccgagggccggcgggggttaggccagccgctcagccccgccgccccagctccccagccccgcagcccgcgggggagcgggcgcgttatttcaatttgccaggcttctgaagcgaagaggctgccctgaaaaagcaaacatgagagaggacggggtgcaggtaaatatcattaacgtgaaaatctgctaccccagccaagttcaccaccagtattcacccctacaggcggggccgctcggaccctgctcccggctccgcgcctgccactccctttcccgcgcagccgagatgccagccccagtgggcctggcggggagtccggcggggtccggaccgggcggctcgacccccggtccccacggcaggaacgactcagcctcgcacctcgggagctgtaggtgccgaaaacgaaacccgcgggggcagcgcacgccgcgcgagtctcggtccggcggcaacccagatagcgattcaggggctttattcttttgatggtgattaaaaaaatatattctatttgaacccgtaaagcagacgagggcaaatcaagccatcccccgcgctggctcaccggccaccgcgcccagcgccttcctccccctccggcgggcgagcgggcaggggcgcccgactcctaccttcctcccgccagccaccgggggaccagccgcgctctccggggcgggggaggccgcccgggacggggacccccaccttccgccttcggaagcgggttggggcgggggtcggaccccgagtctctactccccgtccctctgccccccggcgcggcccgacagctcccagccccatcctggcaggtggcttgggtggcggtagatgccgggcgggaggaagatgtggggctgctctggcaggttgggggtgcgaggaggaaaaaaaaacagagaaagacacacacagagagacagggagagagcgcgcgcgagagagctcttgtctatagatttatccacataatatatatttatgtagctttttttctctcgacactgatgaatgcgcgctcggatccccgggcggactccctccaagccggctcgcttttctagtctaaataaataaataaagccagatggaagaaaaaagcgcccattccacctccgccgccgccccgcccgccatccctgcctttgcttcgcccgcctggcgccctaatagagcatagcttggtggataaagcccccctacatacccacacgaaaataaaaatcactatttttaaaatacaaaaagttgcacctgctgctattacaaaaagaacccccaaaaggcaaagagaggaggccggctgcccggctcctcacggacacccgctccccgcggccgccgggcccggaatctcagcgcctcccgaagagccatgcgcctggcgctatttatagccgggggccgtctcggactgtaccatcgccacggcgcggggccgccgacgggggaggcgcggtggccgccgccccacgccgccctgcccccggccgccgcccgccgtggcgcgggcccccacagcgcgcccattcccggccccccgcgccctcctccgcgcgcgcacactcgccacccccacccctggtctggctgggaacttgaaccggtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggtgagtacacctttccctcccaactttgccggggagcaggagcgggctggcgggccgaccggccggccggcgactgacgagcggcggactaagcgagaggaagcctcgggcgggcgcggtggagggaggcgctcgggcagcggagaccagagctggggtgcgtggggagctgttcgctggggcaagactgggttttgggcgaggtgctgataggaacgatgccatggagagagcagcgggcgccgatgaagagaaagagagaggggatcgaggagacggggcttggatttttgggtacagcgacctgaaagatggggatggggaaggctgcaccggtcgagcccaggacgctgagcggacggactcgcgggctcctggccggccgaggaccgagggtgctgtccatcgccgt

SEQ ID NO: 5562 - DNA, 1133 bp, Homo sapiens
  source 1..1133: mol_type = unassigned DNA
cgagggcggccgcccccaccctcgggggtccccctaaaatggggtggggggaagccaccgctcgccctgcgtcctcgcgggtgtgccctgagcccccggccgcccgcggcgcccgcccccgccccggtgcctgcggcgatccacgctccgaagcagaccccgaaaggaaaaagcgatacctctgtttcgcacagagccaaacactggaagcacgagatagccgacgtggaccaggaccatcctggctcctcgcgcggcggcggcggcggcggctgcgcgcgggccctttgtggcgcggctccggggcgcgggcgcgggcggcggcggggctgcgggagccgccggggcgggaggcggagcgcggggcgcgggcggcggtggggcggcggctggcggggagacagatggcccatggaaaggctcccttcccggcccctctcgacattcaaaggcgctggggccgcagctgccgccacacaaaggcgcgcgcagccaatgggagcggagcgcagcgcggcgcggcctcgccggaaccgcgggggacagcggggaccgcgggcgcgcgggtggcggagggagggaggggtgacggctggaagggggccggcggccaatcgctgcggcccgctgcggggcgcgagggaggggtcagccccacgggaagcgtggagcccagcgcgggtccctggccgcccgcgggccggagagggcgcgcgtgaagcgcccctgcacagacatgggcggcgtgaacacggaacgtgcacacatggagagggacgtgcactcagacatgtggaggtgcgttccttagtgcagagagacgggcacgagcgcccttagtgcacacgaccctgaggtccctgcacaccgcgcacgggtcactcggggacgtgcgctcggaggctggcgcacgtgtagagcctgactgcgggcacaagggaagctggaatgcgaacaagcagccgcaaacaggacccaggcactgtcacacagacatgcacacaccaaacgccttgttaacgcaggacgcgtgccaagaacgcattctcagagacacacagagggaacacacgatgcagacacaggtaagacacgcacactccccaggctctctgcctggcgcaccgcgtcgt

SEQ ID NO: 5563 - DNA, 2401 bp, Homo sapiens
  source 1..2401: mol_type = unassigned DNA
cggcctgaccggggcgccccgccgtcctcccagtgtaccccaccgctctcggctgggggcgcagcaccttggagagaggcgcctggccccgcgcctgggctgggggcgctctaccttgcgccctgggggtcaggggcgcttgccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtaacgcgcgccccgggcgcccgccctctgcgccagccccaccgcttctcggcgtcccctgcagcccacctcctcgctccgcgccgcgccgtgcctccctccatccccgcctgccttcccctcgccgccttcccttccctcggctctcccggtgctctcggatcggggcagcgggcggcgcgccgggggtgaggagttgcccccagccagtgcgctccgggacgcggacgctcaatcctgtcctcttgtttattgtagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcga

SEQ ID NO: 5564 - DNA, 769 bp, Homo sapiens
  source 1..769: mol_type = unassigned DNA
cgctgagccgcagggaagctgcggggccagctgagtagccggcggcctgttgggtccccagtgtcgcgcgacagcacgacccgagacaaggcacctggggctggtgccaggcagaggccccgcgttgcgtggccggcggcaacagcgcctggcggtcggttccgggcggggctgcaggcgccgggttcccgcggccgcgaggcggggctggagggcgctgcgggctgcgcggaggctgcgggaagcgcggggagcacgcggagcccgactagcagggagatcgcgtcgcgccgggcacaggcacgggacccgcgctctaggagggcgcagcgagaggcgcactgcgcacccaggggctgcggtcccggccgccgtgcggtgacaagctgactccccgccgccgcccagccaagtccgcgcggggtgctggcggagatgtcgcatgggaggcttcttcaacgaggtgcaaatccaagccacctcgcctgagtgaatgaagggacggcgcggggcgcgggtggggttcaccgtgacaaaagcccagtacctggttcaaactttttttttttttttgcccgcaggattagaacatccgacattaaaatgtctcagtgcagcagaatttcccagcgacttcggtggcgggagagcagcacctctcaggcacagctgtgcgcatccctcgggccccaccgaccgcaccatctgaccgcgggaaacgaaatctgagctcaggaatttgaactgccccacgcacgttcgttcccgg

SEQ ID NO: 5565 - DNA, 1169 bp, Homo sapiens
  source 1..1169: mol_type = unassigned DNA
cgggagccaggcgcgcgggcgggggctccaccggtcactccgaaatcgcagaatgccccagggtctccgggacttgtgggtttaggggaacgttcgggacgcggagcgggcccagttcacctgccggacgccccctccgtccatccgaacccgggagccccgcaggagggacccttctcgtccccagtgaccacagtccggacccgggctgcgctcggcgggcaaggctgggagctccccgggccggaggacggggcgcatgggctccgggtttgcagaattcgcggctgcgggagctgggtcttctctcccccaattcgggccgcgccccggctggtcggaggaggcagagtaggggtgcggccgtgtgtccgagcgggagtggggcgttcatctccggggagaagggggaccgggaaaggcgcagcgcgccgagcattcgcccacaccccgcccgctctccgcgcgagccgggtgcgcccccaaccgaaccggggcgggcgccgggagagtcgggttttcccgagacccgcgccccttcctcgccttcggctcacccgggctcccgcaggaccagcgcgaatagacggggcgatccgcggccgagacctccatccacgcgcgcggcgcggccagaccggcgagcgcctccggcccgacgcccccctcgactcccggactctgggcgctgagcgggagggggaggcaccagccccgcccggccccgagccgcccccgcccccttggcccgaacagggggattccaaggtccccttcgaccctcccgcgcccgcgcgcaccgcgcacccggagaagaagctgcgcgcggaaccatcagacaggagcccgcgccccccgccccaccgcccactgcggccccggctccttcgccgcggaccccccacccccggccccacggcgcgctcaactttacctgcggtccagactccgcgagctccgggctccgcttacccggccggcggcctcctcggggcggagcgcggcgtctctggagccggcatcccggactccggcgccgccccgcgcaccgcccccgtcccagccttcagtggcgcggcgccccctcgcgacatccgcgggtccccaggagcgagccgaccctcggctgggtttggagccggggccaagtccactcggagggagcacgg

SEQ ID NO: 5566 - DNA, 6036 bp, Homo sapiens
  source 1..6036: mol_type = unassigned DNA
cggtgcggtcctgggcactgaccacgcccacatgtgatggtctccgtaacgtgcaggctccgctggggagaggccagcgcgggctccaggtcccagggcctcgggctcactgccgggactcccctcagtctcctttccattggcctcgcccgccgcggctgcgccgggccgatactgactccagcgacccttggggtcgccccagctggtagccagcatctcctctgggatggggtccaaatgtcagccggcccggcgtctgcaccagggtcccatcgtacgcagcccgctgccttcccgtctcccgccaaggggtgcgacaggcagggggatccgttggcctctgcccctcccacccccacccttttgggctccgccggagcgcttgggctccgggttccctgaacaccgtctgggcggggcttcctgccggggctcggccacacccccacccgcactcccacagctggggctgagaatgaaaacaatccctgcaaagccctcattagcgaattaccggcggctgcagtgattacaggcttcgcccctgcgcgccgcaaaggcccccagctggcaggcccgccgcggcgccgccctcccccagcctcgccccacctgcggcgggcgccgtcacctccccagcgctgtccctgcgaagcagcggacccagacccagacccggacccggaggctaccgcctccctcgcccggggtcaagcaacggcttccgacaggggaagggccgcgcgctcagggctgggccaggacgcccttgccagcgctccacggtcgggacttgaggcctagcggccgccccgtttcctcctggacctccgcggcacagaggcaaggtcttccggtgaggcgcgaggtcgccgtgcgctgggcgggggttctgagagtggtggggctcgggtgggcagaggccctggggcgacctatgggggacgtctacagcgcaggcccatggggcagccagaccgcgccgcagggccgggagagaacgttccagaaggccggcctaggccactattccaggagggtggcggaggcagtggccggggctttctccgcggccgagtcggtggtggctgcgaccaccatggggctgggcacatagttgaaggggggtactcgggccgagcggctgggggagccgtgccggctggcggggaagccccccacggcgacccccaggccctcgtgcacgaagggtgcggagatgggagccttggcgaggctgggaccgtccacgtcgctgccgaggagggagagctggccgccggcgggggccccggggggctccctggtctccaggctcggggacgtgctggagttggtcttgggggcggcgacctcctcggtctggaccacggcgtcgctggtcttgcgcggcgggggcccggccggggcgtcctcgggcgtggagccccgcagtggcagggccgtggcgggaagcgtgctgcgcaggatgtggggcacgtcctcatctcggatgcgccgccaggtcgtgcccggcgcggccaccctggggagcggccggggctccccgtcgctgctgcggcgcgcggcgtcggctgaggcaggggccgcggggacggcgccgtcgggcctgcgggccacgctgatgtgcggcagcgacgcgtagcgcttgacagtctccggccgggcggcgggcgcgcgcacaggcaggcgggacgggctctcggaggtggtgcgccgggcagggcgctcgccagggctgggtcgggccgcggggggccgctgccgggccggggccgggccctgccggggtgccgctcggagctcttcgcagcgcgaggagcagaggaagacggcgggcagcgcgggccggccgcggcggggcgaggcgccctggggggcagaggccgcggactcggccgaggacagctcggagcggcggcgccgcaagcccggcgactccttgatgaaggttagctgtcgccggaagcccgagcggtcggaggactcgctgccgctggagagggctgaggccacacgcaccaggcccaggcggcccccgcgcgcccccgggcccgcctcggtccccgcccggcccctggggcccggctccgggactgcccgagccagcggtggcggcccacgccgggccggcctctgcatgaacgggatccgcacgggcgatctctgcgtcttgtgctgcttcgccagaagggtgcgcgccggcgttttgggcaccggggaggctccggggccgggcagggccccagcagcctgggtgaccggggggcgctttctgggcaggggctgggaggcgggcgaggtctgggaggagctggaggagggggtcttggcgaggcgggcgggcggtgtggcgcttctggggggctggctcagcgtcgccagctccgaggtcttggcaggccggtgtaggctccgcgaccgctgctgcccggggctcgggactttggctggagccgcgggctgtgccaggcaagggggcgccaccttccgcggtgtggcgcgggggccgggggtccctttgggctgggcacggggtgccgggctggggacgtagatcactgttcgtccccggagcacagctggcaccccgggcgtggtcttctgtgtgccacgtggcttctcggggcctgcaggggaacgggggctcccgctggtcttgactgaggctgcgccccttttctctggccgccgggcactgcccatttctccctccgcctgtcgtcccttcctgtgcttggggggctgtagggtggatcccactgacagcccggatacgaaggacaggatggagtcggactcggacgaggcctcccgcgtggcagctgctgcctggtgcagccacgtgacaattgaattggcgccctcctggatggcgcgccactccacgctatccaggtcggaggcccggtccgagcccgctgcctcctcgccgcgttcccgggacccctctgcgggccgctcatccagccgggtggctcggggcttgcggcgccgcaggccagacacggggggccggcgcctgggcagggccgagctgatgcaccgctgcagaagctcctccgcggcccgcgggctgggcgagctgtcgcgtccgcctcctgggcccgggtccttggtgaccgcgggctcccggcctcgtggatggacggccggcggctccgagggctcgggctcgctgagggagctggcggaggagctcagggagtagcagggcggggtctcgtcagcaatgaggctgggctgggtccgggcgggcggcggggcagctggtgcagccttggacggggcaggggcctccttccggccctgcggacgctcccgcgtaaaagcgcgagggatggccgatgtgcgccggtgggttggcgtgggcgcggccgccgggggctcctcgtccgagtcgttgccgtagaagcagtacacggcctcctcagtgggcgtcgtgaggcacagcgactggagcgccccgtccccgcgggtccggccgggctttgagccgtccttgtctgcgggggcgctcgggggccggcccaggggcagctccagccctgctctgttcttgcccgcgccccgagactgctccgcgctgcggccggcgcctcccgccttgtgccggtgccccatggcctgtctggcagaggtggggcggccggtgggtctttgcctgcccgctggtcccccgggctggtccctggggggtccctgcagcgtctcgtcgctgagcgaggcggcgctagagaagttgaccggcgtgccctccgcggagtcagtgcaggagtcgtcctcctgggccggggccggggcgggcaccaacatgtagacgggcacggggagtgcgcggcgacctggcaccagcgcggaggccaccttgcgcagccgggcaggcacggcggctcccaggcactcccgcagcagttccagctcctggtccgcggcgccgcgagggcgagaacccgtgggcgccggcccctcctcccgccgccggtgccctgcaaagtggaggccggcgcccccggcgcccccgccgcgctcggggcaggccgagggcagcagccgcagctccacgtcctgctgcacgtagtgctcgtgcaaggccagcgcgctgaggctggaggcgcacgagaagttctcgtctggcttctccacggtaaagcgcacgctgcctgcgtccagctcagatggcagccggcagcgctcccggcagtcggcgatgtccaggaagcgcttcacgtagctctcccactgcaggctgaactgggtggcctcggggggaccctgtggcgcgggcgccagcggtggcgtcttgctccggctgggaggcatggtctgtccggggctgtcgggcagctcgctagggctgatggtgccgctgccctgcccgctgcaaggttcactggggatggagctggcgatggacgggctctcgaagctgcccagcgagctcacagagctgcagcggctcagcacaagcggtgtctcctgcacgtagttctccgacgagctggacggcgtggcgtcttccacccccaggccccggcctcggttacgccggggagccggaatggctacgggcagcgaggtggccccgggcgcccgccacgtgctgtccagctcagcctcgctggggccggcctcctccagcccctccagggaggagtcactgtcatccaggtcaccaccctcgctggggcctgggcggccggccgaggacagcgaggaaagggagctgcatcgggacagcgagagtggcccctcttgcgccgccagtttctgcagtgccttgctggccacagacagcggggcagccgccagcttctcgggaaccttgctcaggtggtctgccggcagccaggcctgcttccgggcccctggagagattccaggccccgcgaggggctctgcacccgcccttgaggcaccctcaagcagtggcacgtgctgataggtaggcgacagcttgatggtgcgcacgcgggcgtcggcggaggtggcctcgcgggccgggggctcggcctggcagccgggcaggtcaaggtcaagccggctgggccgaggctgcccacacctggggtcctcgcggcgcgaagccagtgcggccagcgggcagggcagcatatgttcgcgtgggcagtacccgtcgctggcactgccgctgttgaggctgtcgttggagaggctggcgtgggccgccttgagccgcagcagcgggtgcgcccggcttcctgcctctcgccgcccgccctccgggccgcggcatggcgagcaggactgggcgcggccctcccgtggcgcctcctgtcccgggtctccagagctgaggctgaagctatcgtcggacgaggtgtgcagggcggagatgtcctccaccagctggtcgatgcgcgccactgcaagcgccagcttggccttggccttggccgccacggctgcctccccactggtgtccttctctgcctccttgccgcctcggcgggtgggcggggtgcgagccagcgcctgcccctgcaggaaggggctgcccaggaagagggacagcgcggcagggctggctggctccccggtggccgcggccgcagccagggatgacggtgcatcgtcgtcgtcaaagcagcccgaatcggaagcatagtcttgggccaggccgtccaggtgtcgcaggggcggcagcggcttcttagtggcggcctcggctgccggcgggccctgcttctccaggtgctccagcgcctgcgcgaggtgccgtgcgtccagctcggcctccagcgcccgctgcttgcgcacgtacaggctgggcacgcagctgcctggggacacggcggtggcggccgcctggtgcttggcgggccgatgggccagcaggttgcgcagggcggcggcgctgcccatggcgatcatcttgtgcttggagtgcaccagattacgcagcatgcccacggcgcccaggtcccacagcagctcctggtcacgggcgctgcgggccgacaggttccagagcgtgccgcacgcgttgctcacgatggtcaggctgtgcga

SEQ ID NO: 5567 - DNA, 3400 bp, Homo sapiens
  source 1..3400: mol_type = unassigned DNA
cgtgcagctgcggggcacccggggctgggttcacctgcgcccggggccgcacaggcaggcagagagagccgggttcagggcacaggcctgtctcttgtcccctgcgcccggggaagggggcggcacagagccagtgaccacagcgcagcgcgcacttgcccccgcaggccctcggagcgtccccgcgcgcaagaaggcgcagaccgcgccgcccctgcagccgccgccgccgcccccggccctgagcgaggagctgccctggggagacctgtcgctcaacaagtgcctggtgctcgcctcgctggtggcgctgctgggctcggctttccagctgtgccgcggtgagcgcaggctccccagaggtggggcgaggctggggtccacctgtgcgcctattcctccaaggaaaggcgctgtgccgccagggtggggtctgggagcctcctctccagggctgggtcttgcacgcccccaaagttggtttgtgcatctccccttaagtgacgggccttgcgcgcccctctcacccggtgtggaccttttgcggggcccattcccctcgccgcgagtaggttctggcttccggatgaaccttgtgcaacccctcctgcctcgtagcgttctgccgcctttcccctgcgccctctctggggaccgctcagctcgtgagcgccccccgggggcactcctgcgacccctcccttgctaggggcctcctacagcccgtggtcggggggaagaatgaccaattgaaagagcgaggttcggagaaggggcgccgcggcagcggagtcccggagtcccttcccacggctcgggggcatccttagtctcagccgtaccgggggagccccactccaactgtccagggaggggggctctaggggtgagggagggatggacagtgtggaccgtgcctcggcccagctgactcgggtcccgaccctgtcgctgcagacgccgtccctggggaggcagcactccaagcacgtgtgcccgagccctgggtcccgccaagctcagccccgagggagccatcgtcgcccctggtaagagcttccttccactgaccgcgggcattgggaccttcatccccaaggaaagaaggagcccgggccggggggaaggtgggcgcttaccccaggaccccactctgtcttgcagcctaagttcgaggcccaggcgcctccatcagcgccgcctgcgccccgggccgaggcagaggtcagacccaagattcccgggagtcgggaggctgcagagaacgacgaagaggagcccggcgaggccaccggagaggccgtccgggaggaccgtgtgaccctcgcagaccggggacccaaggagaggcctcggagagaggggaagccgcggaaggagaagccgcggaaggaggagagacctaagaaagagaggccgcggaaagaggagaggccacgggccgccagggagccccgggaagccctaccccagcgctgggagtcacgcgaagggggccaccggccgtgggcacgggactccagggacgccgagcccaggaagaagcaggcctgggtgtccccgaggcgtcccgacgaggagcagcggcctgggagtcgccagaagctccgcgcaggcaaggggcgggactgagccggccccgcgccggagtccaggggccccttctggacgccccgcgactctggcgaaataaagcgagtgctgcggccgcagagtcacctgctcctttacgcctggacccggcaccaagtccggggcctgaaagacggtggtggggcgcttcaggcaggggagagacagcgagcgctacagggcggacccgggccgtgcgcgaggagagacggcaagggaggtcccacgggccccctaacacgcacggacaccccagccggttgcttgctggtctttattggggcgatgcttggggtccgaataaatatgggaaggggcgcgagctggggcgcgtccggaccctcggggcaggagtccgcgcggcgcaggggtcaccggcagccacactcggtggccaccatgttgggcacgtggtgcgcgctgatgcgctcctccgacaggctgatgagcagcttgcccgcgtaggcggtgggcacgcagcagggtgggcgcgccagggcggccccacggacctgcatcttcagcagcagcaccacgtggttgccgtagcgcgggttgcggtcggactgaggccagccgcacacgccctggcaattgttggcctggtaggtctcggggatgagtacggagcgctcggcgcggaggtctacgctgagctcgcgcagcgcgcacggcccgtcggcggcggtggcccccgcgctgcgctgtgcccgacccggcccgcgcggatcccgcccgcgccactccacgcgcaggccctgcagcgccttcaggagcagcagcgctcgcaggggatcgccgaggccgccggggccacctgggcagagcgcgagcaggcgcgccagcagcggggctgtggccggaggcagacccgggaggcttcgcagctcggcagccgccgcttgcagttcagcagccacgcggcgcgccagggccgtggcccacggcgccgacgtggggtcgtgcaggggcgcaggatccccggtggtggccgcagtgggcctcagcagcagcagcagcggctcctcgccgtcgagtaggcgctccagcgccgcggggtccgacaggttgactaggccctgcgggaagccggccagcgcgtccggatccagggccaggcgcggcgcggaggcccgggccggggggacccgcagcgcccgcaccaggcgcgtgagcgtctccaggaaggggtctgcgctgggtggcgactcctcgagttccgcggatggcctggaacccgcaattggaggagttgagagcggccacgaggccacgccgcccccgcccgctcctgccccgtgtcccggtgcctgcgcgcacctgggcggcgggaagggcacggtgtccagctggccgtgcgcaggcagcggcgcgggctcggaccgcggcagcaggagcagggccggggtcatccgtgtgaagcagcggtggtcgtcgccgaacagcagtgcctgcagccgggcggtactcagccgggagtctgcggtgggtgggcacgcggctggctcaggggctgggggcccgggggcagtcgacccggctccccgtccctctccacgcggacctaccctctccgcggggctgcagggtcaaggccagcccggagccgcgccaggcccccgcagggcggtccaccgctaacaccaggtagcgggtgtctcgggaggggcagaggctctgcggagaccagggctcagcccggctggatggaggcttacccagccccgctctaccggtccccttcctcccatcgccactggttctacgc

SEQ ID NO: 5568 - DNA, 1143 bp, Homo sapiens
  source 1..1143: mol_type = unassigned DNA
cgggcttggcgccttgcttatctccccggacgggcagctcactctccctcacccccggtccccgccgcgcgcactggcggcgcccgttccacgctccaagaaccccgcttcccagggtgggtggggggtgcacgcccgacagggccaggtcagggccaggcgtggagcccgcgtgcgccccgggaccccgcccggggcgcgcgggaggcgccgggggccgcggaggcggggcggggaggggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcaggtgagcacgtcggcggggagacgtggagagaccccgaggccggggtggggggaaaccccgagggctctaggcgggggtgggcccgggacgtgcgcaggaagggccggtgtgtgcgcgagtgtgcgcgtcccgggcgcgcagcgggtgcgcggctggggcggagggtgctcagaggcgatcggaccccgcgtggtggtggctggggtttcctgggtgcgggtgtgcgcggctacgagccccgggcgtgtgtacccgcgcgtccacgtggagggctgtgcgcgtgtggccgaaaagcgtgtgcgcggccctgcgtagcgccctgcgtgcccgagtggcccggcgctggcgcccaggtgttccagtgtggggcggctgtgtgtgtgccgggggcgggggacaggtgcgcacgttcccaggtgtggagcgcttgtgcgcgcggatgcgcggggacgtgtgcgcacacctgtttccacgtggacgtggtcctttgcttgtctgcgcgcagctgtgtccgagccctgtgtgtttctgtgcgtgtgcatgcatccgtatgcgtgtgagtacacgtgggactggaggatttcatgggaggcgcatcttggaggggccgagactcaccccccagcaccgcccacttcccagccactagcggtcgg

SEQ ID NO: 5569 - DNA, 220 bp, Homo sapiens
  source 1..220: mol_type = unassigned DNA
cgtggcaaacccgggctccgacgacagaggcagcgcagaagctcgctcctaaatgagacaattttattaaaatcataattccttgcatttctatagcgccttttcagtggcggagatctcaggtgccccacgccagggtctactagagaatcggggcgaccgcaagctcagtcgcgggacaggcgaggctcgccagctccacgaagcgtcaccggcacgt

SEQ ID NO: 5570 - DNA, 1860 bp, Homo sapiens
  source 1..1860: mol_type = unassigned DNA
cgcacggaagtctctgcccagctgtcagcgcgcgtcgccaggggctgcactgaagctgtggacccgggatggggaggaggctggcggcctccgaagcagggtctacagcgggggagggctagcgccgtctggcggtggctgcgcgtggccagtgcggacccaggctcggctcggccggcgctgcctgcgtgtggtccgggcggagcgagggtccttggagcccggttcgtcctgggtcccaggaagctcggcgtgcagcgtcagaggccgcgtgtgctgggggagggaggagtacagactgtgcctgggggcatccaggacgaattcacagaggggtggtcctgccccacccagggggtgtcgtgggcaaaggccctggggccacctgcctggtgccttggagggcgtagggcaggagccgccgaggcccgcgggccactgtggggcgcggaacttcagaccaggcacccgcggctcaacttccgggccaggggacccgcgggggccttacgaacctgtttggcccatttgtgcaacagaaatccgcccgcgcctagcagcgtccggggccgcctgcgccggatccgcagcccagtaccctccgcgccctggactccgaggaggccaggtagagagcggctcgcgcggtccccgtctgcgccctcagccccgcgctgggcagcgggacatgcctggctccggcgccgccacctcggcttccgcttgcccttgagtgcggagcccggagcctccctcgcggtgcgctgggtcccagagggccagaggccaccagggggccggcatcggcgggagcccagccgggcgcgccctcggccctctcccacccacgtcctccgcggccgcccgggtccaggggcgcagcggggaggagaccccggccagggccggggagcgcgagggcggggcggggtccggcggggaggggcgcgggcgggcggggaccggggcgggggccgggtccgggggcggcggcggcgcgggcgggaggaggaggagcttcccgcgcggggcaggggcggagcgagcggccgcgccgcggagccaagtgagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcaggtaacgtgtccccgtcccgcctcggcccgggtcgccgtctcccctgctcctgggcgcgccctgcccggcccggctctggcctccggctcgcgcgccctcctccccggcggtcctcgccgccccaaaccctcaggacggagcccggcagccgtgcctcggcgagaaagttcgtgcttggacgcccggtcgtccacctccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcgg

SEQ ID NO: 5571 - DNA, 441 bp, Homo sapiens
  source 1..441: mol_type = unassigned DNA
cgccggggccccggctgtcagcgcggccgccatcgtatggctgaaggggactgaggccgagctgggcaagaactctgggcgcagattgtgaagctgactgcggggaggcctgggtcccgccacagccgcttcccaccggttccaaccagccccgttccctctctcgggatgtcggaccggcactctcaccatttctaggcttccagggggccctggcgtcttagctgtggatctcccaatacccgcaggtcgcagggccacacaggctgggcttctacgtgcagaggacacaaagcagacagacgaaaattggagcttcggcggcagcgagaaacaaaggccgcgccaaatcccggaagccgccctgtctgctccagctgcgggcctgattggacggccccccgcccagtgtccccgattggataacgtttaaggccccgc

SEQ ID NO: 5572 - DNA, 5587 bp, Homo sapiens
  source 1..5587: mol_type = unassigned DNA
cgcgggaagaaggccctggggggggcgctcccgacctaactaggaaggagtatgcatatgcaaatgcgcccagggggcgggtcctgggtccggagccccccggggcgtcccggcgcagccctagccctgcgccatccccgcgcgtgcgccccctctccgcgatcccttacccgagccgtgcctctggcgcagcaggaccgcctgtcccgatggcggcgacgctgacgaggcagcagcagctgccgcgactgtggtggtgggcgtgtgggccgccgaggctgccgcggcctcggggactgcgggatcgatggcggcgggagggctcccgggcggcgggctcttgtcgccgcggccgggctcggaggtggtacggctcgcggcgcccgcgttgttggcgttggcggcgctggctgggccgtggcgacgcgggccgctgctctggatgtgggacacggcctcggcggcctgcatgttgggcggcgcgaagcgcgagagcacgcgcagcatcgcctgggccttgtgctcctgcgtgtcgtcgtcgctgtagtccgacacgcggcactcgtacacgccctcgtcctgcagccgcacggcagacagccgaagccggtgtgagatgtcattgccctggacgcgtacggtctgcaagagagcagggttagaggccgggctgggcagctcccaaacctactcttctggccaccctggccgtcgcgccccctcatccgcgcaccccaacacttcccggatcctggtttgcccaccatcacgatccggcttccctttcacccgcgtctacccagtggcatagggcttccaactctgcgtggacgccaggcagccagctctttggactgtgtccccacgtccccatcacgttaaccaaacgcccaccttgcatctgccccgcccatacaaaccaacactgcttgtcttcccgtagctggcgcttcagaagggcagagtccacctctccttcctccctcctgcaccttcaggaaaccccaggctggattccttgttccttaacttccccacgtctttcccgccccgacgcgctccaaccgacagtcccgccccagccggccctcctcacctcccggagcacggagggcctgcccgaatcgcttcctaaggaaagccaccctgtcaccggaccccgccctttacagctaacactgtgctttcttaagaaggcaagcaacgctgaggctgctgcctggctccctggccacctgctaccaacccgcctttccgcgggatctccagaagccccccagcgaagtgctcctcccctgcgccccggtggggacttcgggaagtactgctctacggctctcaacaaacacccagggagccctcacctctgaaccgagcccacgaggaggcttcgtcatctccaggcctttctacgctccaggtgggaagcttgggcgcatctcctcccagagttagcaaccccatgacccgggcccctcgcagcctggcacaaccaccccctaccccgtcccctgcaagcctgcaacaccccgcacccagacccgcaatccaggcggaggataaagggttgcagcggagggcgcagagcagatgctcagggcggggcagagggggcgggaagctggcgccacggtcgcggcgagggcgagcagccgcgcgctcccggtgctaggaggaatgcccgcagagcggaggctggcaggcgcgagaggccctaagcgcgcagtccgaccaaggggagttttacaggtcagcgccgagccgaattaggggactcaagccttggacccttgatttacacaaaagagaacccgaccctgcaaccggcgacagatggcgcccggacacgccgagcagccaccgatgcaaggctgcgatcgctgccctacttgcgcggccccacatgcgcggccgccgcggcttgctaagggagggagctgcgggacccgaggcggccagaaggggtctcccgcggcccgcgctgggctccacacttacgctgattttagttgcatccttatttgttacctaaaatgcaaagagggagagagagacgtgaggctcgcggccttctggctaggggaactcggatccgcctttaggcaagggcaccctcctccggcaggctaggaccgaaaccgcccgggggatgggggttgagggcacaaaggacgtccggctttccaagagtttcccaggaggaagcgggctttggagctagcatggtgcctgaccaacgggtggctgccctggtgcacacctgccggctgaactggggagactggatggacaccagggtgggaaggaaagcccctctccttccctctgggcatccttaggccctgccgcgtggctcaaaatcctcccccagctcactgggagccgtgaagaactggagggagggccgctgtgtctggacagcacccagcgggaggctcagtgggagtaactctgggtgggaccctgggagaatgtaggtgtgtgtaggtgtaggtgtgtgtgtaggtgtgtgtgcacgcgagcacactagagtgtgtaagagagtgtgggttttgaggcagacaggcagcgtgggcctgttttcggccacagagaagtggcccctctgtgcccctgagggctggaggtcctgccggctttccggtactcggttttctggtggcctctggaacgcagccgtgggagccctggggtcctcaaagtggcagagggcggggagagcctgatgggaccaagggggcttccttcactacccagcacccatcagagggccgcagccagcgagcacgagcaagcgaccaggctgaggtgtggctctttaggggctgggcgtgaatggagttctgggaggtggtgggaacagcgatgctgtcaaaataattgacaggtttgggggtaaccactgctgactttgaagatgctttgggatgcgaaggtggaagatgggctgcgccacagggcggcgccctgcgcgagtgaagcccgctgcttccctccctgggttagccttcgccgccccgggcgcgagccgggcgcgcgccggtaccgcgtgggcggcgggttaccttgctccgggcgcccggcacgctgagcgccagctcgtgcagcagctcccggggtggctccttgaggtaccaccactgaatctccagcgaatacgaggtggctccgctggcccggaacgcgcagggcatttcgatgtcgtctccctcccgtactgtcacatctttggggacttctgtgaatgcagctgggggtggggagagagagagaggcgtgaccagctgtaggtcgggggcctggggcaacctaaagcgaggcagtcggtctctggctggctggccttgtgccccccaccccgcagctgctccctggcgcacggccggaggggctagcaaagttcggggaagcggctgcagggccgaggcagggaccggccatcggctgcctactgcttccctccggatggggcggggcggcaggggcgactcgtgcttctcccccgcccctggccgcaccgccagagcctggctggggcgcgcctactcccgctccccgcaggcatcctttccgcagccggggccccggcgggactgggaacgactcgggcgcggcgctgctgctgcggcgacccttcgccgctcgcctctccctacccctccgggcccaggctgcacagcgggattgctggagaccgcgaagcttcccggttcgttctctttcttcttcttctcggtggcggccccagcaaagacccccccgagtccacagcggcagcaaagttcccgcgctcaccgtcggccacgaagagcagcagggcatgcagcagcagaggcggcaggtatccgagggcaccgagccggttccgctgttccatctcccgcggggggcgcggtggcggcgggggcccgggagcggagaggcggcggccgcgtgggctcggatcggctccggctcgggctaggacgcctccgagcctgccatggccccgcgcggcgccccctcccctggccgccggcggccgccaatcagccccgctccctcgccggcttgcccggtgcggctccggcggggggcgctgcgcggggtgtgcaggagacgcggtcccaccgggaggctgctggcgatcggtcagtgcctctctctgtccggtcgtccacaggacggtggggatccgcggttcagtctctgcccggcgggccgggcaggggctgggccgcgccgggacccatccctggccgagggagtgcgtgccacggagccgcgagcttctgcctccctgtctccttctggttctgctcccgattgccacctccttcggctcccgcagccgcccccgccggttcctccgcggctctttccgcagggcgagtgggcgctcagccgcggcgcgcagacctggcgtccgacccagcgcagcgcggggagagcgggtccggcgtggcggacccggagccggagagaggcggggagagggggaggggaggggaagggagggggcggtcagtggctgggcgccaagccgcctccaccgctgcatcgcccccgccctcccctctcctgccacagcccgccccgcccccgccccagagcgctccccctctctcctcgggggtcgctcggagggaccaccgtctttctggttggagtacagccccgccccgcacccgcttgggttgggagtcctcccacccaaactctccctggcttcttcccagtctgcacggctcgagacggccgctcatccctgctccccgtgtgtccctcggtcctctctgcagctcccagccctcaactccttaccccagtttgggcaaccagctgccccgctgtttggcccaggcctgggccatgacggatgggtgggcgcccggggccgcgagaagggcggaacgctgtgcccagccggagactacgctgggtggcggcggcagcgccgggagtctgcagtgcgcgagggagaagtgagcgcacagcgcccagcgagcaggtgcctgcggcgcggagagcgcacacgctagccagcccgcagcggccgtgagtgacggcaggggcggcgggggtggggtggggtggggagcgccgggcacgactcagggcccgggaggtttccgggagggggcggggttcctgcccctggatcgcgggtccctgtgtctccacgcgctcttcgccggtcgtggccccttctttgcccggtgcaaagcgagatgccgaggcggcaggaagccggaacccatcccccgcctgctctggcgtactcggcatcccggtacctcccccagccttcacccggagtctgctccctccccagccatctgagggagcgcggtctggtccccgaaggcaaatgcggggtggacatgtggttcggacgcagcgcgtagtcatagtcataggggcgagtcctaaggctcgccttgggtctctcctatctccttcccccgggagtccccagctagtgcgtttcggcacctctgcccctaccccggcccctacgcctcagctctgacctcaggttggggtggggcagcccggtggattcacgtgcctgcttccccggctaccagcctcccggaggcaccgc

SEQ ID NO: 5573 - DNA, 3643 bp, Homo sapiens
  source 1..3643: mol_type = unassigned DNA
cggcgcggcgcgaccagcagccggccccgctcgctcgcagctctgccctcagcggcggccactgggaccgactgcccgcccccgacccaggcaagatgcccaactgcgaccgcgcgccccccaagatcgcctcccgagtctcgccacaggtacacgcgtggcccaaacacttcacctggcccgaaaagtcagcagacgggggaaaaaaaaaaagttgtgcgagcagccagccgggcagtcccggagcccgcggaggccgtcctcccgccgcccagccgcccagccgcccacacgcgaggccggcccggggcggcgcgcagctcgcggcacctcgctcccggctttgcgcgctcaccccggggcgcgccgaggccaccgcagggcacttacttggcacttgcttttgagtgtgcagatcgtcgcggttttcacttgggttttcaaacaagtttcagggagaaagaaggaggcaaaaaaaaaaaatccaattatgcaaatggactccggactgggaggcgcgggatggatctgacgccgctactgtacgagttctcggagcagccccgggccgggcagatttatgggggcgcgtcacggctacgccaggtcccgccgccggagcatctcgaagttaattaaagcggtaatgtccactttcctggcgaccctccgtgcgtgggtttactatttcaccatcaaacccgaccccggcgggggcgggggccctgtccccacgcctctccttccctcttctggccgcccccctctttttcctctctccgtctctcacccctttttcctctctttcgtctctttaagtcgcctgccttccactcagtgaacaatgaacaaagatgtgagtgatgggaaaagatcgccccccctcccaaccccagcagagagcaaagccggtcttaaagtaaaaatccagttgctagtatcaaactgggaaagaaaacagcgcgttcccagtctcaccaccccttccacacacacacacgcacgcacatacacacgcacgcacgcacaccccaccccaagttcacctaagccctggctggagactggggcgtcaaggtcagggcgcgcggggctgcccaactcgccggggacaccagggttggggaacggcgcgtgctctggtcaggcgtgcttcccgcgcccatccccgccggtcccctccgccggccccctccgcgcctctacaccggccgaccaggcccggcggcccgctcgggctgcccggccgccggatgcgctcagcaaacgcggcccctgtcggatttctgctaaattgcacagcggcggcggcggcggcggcggctgccgggagaaggcgcaggaggaaccggagggccgtaccgcgcgctcgctcactccgcccctcccgctcgcccctcgccccggccccgccggccgccggctcccacccgcgcacacgacccagcccccaggacgcaccgggtgcccgagccccgcaggccgggacacctcgcagctgccgtattttctgctaaagtgaaaacgaaggcggctgacaaatcacgtctccggcgaggcacccgttagacataacaatatctggcaaacaaaacccggccgccgctgccacccgcacgcggggctgagaccccgccctgctctttctcggcccccagcccctggccactgcgtcctcaactccaacgctccccgccccccaacattccaatcctccacctaactcgggaacggtggacatgttctccaacaggcacacagtaggaaccactcacaatacagaagtgaaaagggggggacttaactttccacctgtccccaaagaaagccctgccggagttcactccgcagagtgaagagtgagcaacacaggtctctctctgcccagccctttttctttctttttccctaacttccccgcgtttcgaccttcctccacttcacatacatccgtctatatggagatatctatattttaaattatttgcaaaactgcaacagatgggcgcgtcgagatctggacactttcctactcatcaaaggaaagctctcccccaaccctaacttttttttttttgcctaaaatacaccccgagtctcgcctacgactgttttcctcaattcatcttcgaaaaataatgtcttgaagcaaacagaaaaaggcttatcagcaaagatcattcctaccccagtcatgcatctgcgctggggggacgggaggcgtccccccagattgcactcttcccagacgccgcgcaagccctgcctctcctctgccttccagagcccccacgcccgcacttcctcgctctgattggcctcatttctccagcctgggactggccggctcttttccctccataacctgttacttatttatttatttatttcctctttggcccccggctgggcccccaggccgaggcccggctggggcaggtgctgcgggcgccgcctgcgcttgcaggcgccacggcctttcctggggtcgcgggttcggaccctggcacctcagccctgaaaccaactctccggcctcagcctggccaggctcccggggcacaggaggccgatgcaatcacaaaatggcagatctcagcggctctcggcgcccgcaagtttgacacattgtaagcatcagctaactttaattgaaaaaaaaaaaaggttgcaaattaccctctctccacgggcggaggggccggaaccccgcagtgagcgcggaccagagaaagagcgcaaggcgaacccccgtcccaggcagaggagaaaatggggaaagtcacttgagcagaagtttccgcggccccagcctaccccctcccctttttactccccccaccccccagaccctcttgaaagtttcccggggcctgagagtggctcgcgggccgctcgcgggtggggggcgccggccgggtccccggagctggacgcggggtcccgatcgcgcgccgggcgccaggcctcgggactccttttcaaagtaacggtcccgggaccgcgggcggggaggcggcggcccaggcgcaggtcccgctcgccgccgaagttctctagcgccatacgatgcccggccgcagccgccggctcggttttcctcttctttccccccaccccccacccgctgacagcttctctcgccaacgtcacagccacggatatttaattagaccgtattttttaatcgcgatggggcgagaaggaaccgggcggcaggcctcgccgagatggggagggggaggggacgggggggccgcgccaagagtccaaactcactttgccacctcccggacgccgaagctgcccccccacccgccgccgcccccccgcgccgcgccccccgcaccgcgccgcgccccgcgatcccccccccacctttgttttccttaccttaaacattgaaacgcgggcgtcaggagcaaactcgggcacgtaaacggagcgttgtaaaagattgtgttcaatgaataatgaaacatgcccacacgattgacttgatcattttccggggctgaggggggacgggcgccctgctcgcgcgcctcactcgcccactcggcagagccctgcgaactgttcccagcccagccggggcagggcgggctcgattttcatcagcctcttttcagaatcgccccgt

SEQ ID NO: 5574 - DNA, 808 bp, Homo sapiens
  source 1..808: mol_type = unassigned DNA
cgggacctcccacaccccgggccgcagcgcactgtgcgagtggagggggtgagctccccagcagaggcgcaaggagggtgtagggtgcgcggtgtggctgtgggctgcggacaggggccgggggcgcgcccgggtcggtgccgcgtggtgggagcagcaggcgcgcaggtagcggggagcccccgcgcacccagcccgcgggtgattactatgcggcggcagctgtctccggcgcggtgacggcgcctctaattgatctcattatctcccctccgtaaggtgaagtgcggccgctcgcggggcccgggcgcgggcagggccggctggcagccgcgggccggcgggggcagcgctcggcctcggggtggcactaccgccgggcgccgcgccaacgaacgcaggcggcgggaggctcggcggcggggctcgcgttcctgcaccgcgaccgcgccagaaaacaccccggggctgggcggcgtctcggagacgcattcctttgttactcccaccgtctttggtaacgattattaatgccatcatgtcccatttcccctcaccttcccccgctcccagagccgcgcccgcgcgcccgatctccaggcgcttcgctcctcctggaaccaacaacaatgatcctcaattaaccctctgccagggctgcctgctcgtgaatggggcgctcttccggctcgcgggcggcaggcgccccagcccgggcggggggccagtctccgctcccccggccggacccgcgggggctcgcaatccgcccgggcgccggctgggggtggcctcgcagctcccccgg

SEQ ID NO: 5575 - DNA, 3415 bp, Homo sapiens
  source 1..3415: mol_type = unassigned DNA
cgggggcctttttgcgtgtcccgacatggcagtatggttgctgcgtgcactccgcatagcccgtgttgtgcgtggcgggctgtcgctgcaatgtgcagcccattgacactgatggatgcgccaatggttggacggacagatgttagggcggatcgcacagcgctcggcgcctgagcgggggagggccaggcagcgacccagcggcggcggccggctacgcggagacccgagttcaggccgcggcccgcagtgggagggggccgaaggaacagaggtttgcaagaacagcgaggggatggaaaggaggagaaaagcgcgaccagggagaactacacgcttccgtgtgcggcgccccgcgctgtgcacacgccgcaccgggcgcgcctaagtgggagcttcgaaggtgagctgggagccggcgggagctgaccccgtgcggcgcaacccgcctccaggcgacaggagctcagcgcggccaccagaatggtgaggccgccggcggtgtcggccaactcaccgtttcctcgcttgcaagaagcgtttcacgctccacggccgcgtctccccggcctggaggagtagcggttctggcctctgcggccgcgggcacccaacgcgcacggcgcctcagcccccgagtccgccagcccgagagccccgccgcagcccgcctcggactccctgccccgcctggggtccgtaccccacaactccgagcgctcctgcgcgcggaaaggcgctggaggcggctttatagccggggaggccagcggcggcgcatctgcatcctgggagacgtctggacccagcccaagcccgcaggctgggcgagcggagacttttgatcttaccgtgtgggtgagatcactgtctcccggtctaaaagaaaagaaagcatgctgtgaacttttgaaacaaacttgcaaaaacagtcgtagagaaaaaataaaaaggacacagggcagaaaaagagggagaaagagactaaaaaaagaaaaagataaggggagggggaaggaaggaaggagagaaggaggaagaagtctggggtttgctgctccaggagcgctcaggcagccggtgctggagcgcggggcgcccgccctcgccgggactgtcggcctcggggcctgcgagagcgccagagccccagccggcgcgcccgggcgcagggccgcctcggggatagtgggcccggaggccgcccccgcgctccagcagccgccgcccggcagcgcccggagccggccccggcgcggccgccccattcccggcctgagagctggcccagggagacgcaatcgagcccgcagcgcatcgatgcgccgccgcccgcgccgctcgggctccggctcccgctcagccgccgccgcccgggggtcgcccgcatgagctccggcccacccgcgccctcaccgccgcccgtaagtgagcccgcgtcgccccgccgcccacgccgcccagccagctccttcttgccgcggccagtcggccgggccggcccggagcctcagcgaccccgatcaccaatcaataatcaatccctctagtccagcagccccggcaggccgggcgcgggacacggcgcggcggccccctaggctctcggggggagcccctggcgggggatgggcaggggagcccggtttccttctcccgcccccgtcccgccctaggatcggcccgcgccgtggatggggggcgcggcccggctcccgggggcgaggggcggggtggagggaccctgatcatcccaaagtcaggagaggaaacttgaaggaaccccctcccacaccgacccccgggacgggcccaggaaagtttgtccggggaaaaaaaattgggggaagtggctacggcgggtcctgggggaggagctgggtggcgcggggtctgagggctgcccccacccgccccggcccgcgcccgcctcctccctggagggggcctgcccgtgggctctggcttccccgggggacgccagccccggcccggggaccacgctgggggctccggagtcggcgggtggagaggagtgcgagccgggtggggcagctggggggtggctggggacgaacgctgggtgggaataggggtggggggtaacgagcgccccgggacgggctcggcggggctggcgccgcgcccccgcgtgtgcgcacggggcggaggcggaggggcggcacccctttcgctggcggggcgggggtcccacgcgggcctggggccgggggcgggggcgcggcgcccccgcgggcgggcgattgacacgatcatctccttttcctttaagcttgcctgttgccgacgccgccgctccagccgcgccacgggcagaagactggaccgccgagccccgggccgcggcggcggctgcgcgtccccccggatgccgtgacccccggcctaggggcgggggccggggcagtaccggtccgggccgctcccgcgctcctcctcccaccgctctgcccgccctctccccgccccccagccccgaaccccgcgcacctcgtctggggacggggcgggggggggcagggccgccgctcctccccgccccctcctcctctggcctctggagcgatttgtcaaacttcccattccgccggcagcgcggtcctcctcctcctcctccacctcctcctcctctgcctcctcctcccccccgtgctcctccctccccgagcctccctcgcccgccctccttcttccctccgcacgttcggggttcgcggcggagcgcggcgcgggggggacgcggagagcctgggcgcagcagcatcctgcgggcggccgctctccgggggggaggctgagagcaggcccgcctcgcccccccgcgggcccgccgccccctccctccctgtcctcagcccggcagcggcggcggcggcggcagtggcagtcgccggagaagcatcatgccgaggaggaagcagcaggcgccccggcgcgcagcaggtacgagccgcttccccttccttctgctctcctcctcctcttcctccgctcgccccgcgcctccagcgggcgcgaccccgctcctcgccccgctcttctgcccgcactgagtaactccgggcgccgctctcctgtttgggtgcgtgcgcccgcctcgggtaccgggcgccccccggacgccccgccgcgctctgccctcttccctctcgcacccatttggggagccgctcgcggagcgcgctgagccgcgccaggtccctacctcctcagctctccggctgcagagggaatgggaagcaaccccggcctggctctttctgtgggtggcgggcggggtcacctgagttccccgggacatcttccgcgtcctccgagcggccgaccgccgggggactgcctggtgtccgccgagccagggagcgcgaacgagtgagcgagccggtcccctcgg

SEQ ID NO: 5576 - DNA, 3415 bp, Homo sapiens; identical to SEQ ID NO: 5575
  source 1..3415: mol_type = unassigned DNA

SEQ ID NO: 5577 - DNA, 1592 bp, Homo sapiens
  source 1..1592: mol_type = unassigned DNA
cgtgctctcctccgctgatccggccgcctacccgaggcagtctcggaaccccggaccccagccatgcgcgcagggaactgccgggccgagcgagctcaccgaagtagtcccgcgccgtgcgcgcctcgagcgcccgctccagctcccgggtgagcgcctccagccgccgctcggccgcgcttgggccgccctcccggccagggggcagcgggagtgcaggcagcgggaagggagccggccccgcaggctccggggagcgagcgggcgcggggcaggcgccgggcgggaggaagtcagcgtaggcgccggccgagccccgggagccgaggctggaaacgctggagcgggcgctgcccaccgaaggcggcccgggaccgggacgcgggtccgagcgaccggagcgcgggctgccgtggcgctggtcgtagcccaggctgatgccgctggatcgggcgctgccgccaccgccgccgccgtcggaccccgccaggctggcccgtgggctgcccgcaggctgcgcgctgagctccggaaccgccgcgcgccggggaccccgctccccgcggctcagtccgtccgccccggcctcggggccgccgctgcccttccctctgcggcccagcgcgggcgccgcctcgtctccaggcccaggccgcggcccccgccgcccccgaccgggagagccgcacccgggctccagctcccgcagggccagcccggccaggagtagggccgcctcgtccgcgcccgccctggagcgctgcatggcccggcccgccggccctggcgcgtcacctccgcctccgcttcccgccgccgctccggccgggccgccgcatcgtccgcccgaagcccggagcccgccccgggacccctgggcgcggggcggggcggggccggcgccgggccggggtcgttccggcggccacgcgcgggccgggggacgcggcgccctgctcggcggcgcgcgcggcggaggaatgtaagctcccaggcgccgggccgcgccccctcctcgccgcggcctcgcgcggggcggagggactcctttgcgggggcaggaatgcgaggaaggagacggcgctgcggcctctggaatgtggggggagtggcggcggccgcgctgcgccgggacctcggaggggcgtggaggccgggccaggacgcaggggcgggcggcggaggcaccgcggggagagcccagggtctgcggggcgcccgggccgtcgggccgctgggaagagctcggatttccgcaggctgagctggaggcagctggcgccatccgggccggagagatccaagcagtcgacagctttccccacatcccgccccatctcccttccctgcgccgccttgctctccggcgctgcagggccgacccagctcagcttggaacccacggcgcttcgcccgtcccgcgcccaggaatactgtgcgcctagcgcagatgcgtccccacgaccccctgcctggcccggggccatgtggccgcgcaccggcctctgaagcccccatctgactgctggggaaggcgcccagaactaggagcgggttggttggggactggtcctcgcgctgggtcgcttcgc

SEQ ID NO: 5578 - DNA, 903 bp, Homo sapiens
  source 1..903: mol_type = unassigned DNA
cgggttcggctggctttcagtaggcttgccggggtctctgcactctgtgtccgggatcctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactccccggggcttggggagggggctgggcaggggcggaagcgagctggagccgtgtttgtcgcggcgctgcggagtggaacagatggctggggaggggagagggtgcgtggcggggaggaggaggggtgcgggggccggaggatagggaacgaggaatttcgaagcctggagtctcccaggagaagcccccctccccgtcttttcccagaaaggggggcatatatgcgcctgcctttttcccggagagccctggcctctgccctgtggcagaccctgccgcgcaatcctctgccccagggcgcgcccctcacccccaaacccccgccgcgggacggggtggcggggtcaggaccgccaggagcggcccgggtcgcgagggttaatggggccgccctcccaggggcgaggaggcggcgggaaacgggctcggggtggggaacgagttctgggatcgc

SEQ ID NO: 5579 - DNA, 1592 bp, Homo sapiens; identical to SEQ ID NO: 5577
  source 1..1592: mol_type = unassigned DNA

SEQ ID NO: 5580 - DNA, 382 bp, Homo sapiens
  source 1..382: mol_type = unassigned DNA
cgttttttacctttaatcgcgagacaatacgggtcagaggtcaggaaattatgtcagcaccaatgcgggcgcccacgagtgcggtggaccgatgtggaagggccgggacgcagcccgagtcccagttcccgccgtagcgatggccgatttcccagccgcggacgctgaaagcgaggactccacgccgatgacccttcggcgtaccatgtccggcgggcgcttggccaaacagcccaagactgcggaatcacactcgccactgtgtacctggacgccatctgcagacccagcgcctgcggggattccggaaacgggagagcgggcttccggaaacggtgaccaatgggaaacgtgatcagatgttactaggcgaacagtccgt

SEQ ID NO: 5581 - DNA, 665 bp, Homo sapiens
  source 1..665: mol_type = unassigned DNA
cggggaagtagggccgcgaaggcctctgggaaatgtagttcggcgcaggaagcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtggtgagtcctcgggaaaccgctagctctgagcgccggactctttgtgctgggtgggagtgggggcccgcggtcctggtgccccaatctttggaggaggacgccgggcggggcgatgcctgtgcttgtggttccctgaggcagtgggagtggcgtgtgaaggactgtgagagtctggcgtgaagtgactgtcatttgccagacattcgtctggctgagtgtggccccgggatcgtgtccgtaagcggatttcgtggaggcgc

SEQ ID NO: 5582 - DNA, 764 bp, Homo sapiens
  source 1..764: mol_type = unassigned DNA
cgcgggtatcggcccaacaaggtgcagcgaacagtcgcccgctcccgcctcaactcacagcctcacattccacggtgccattgacttcctcgcacccagtcacacaggacgtggacaggcacacggggtgacagcctcgcactgaacggtaccaacctccactcgcaccggagtcacacagatggcctgcgacgagcttccggagacccacacgccactcctcagcccactcccgacctgcagaacagaactggtggaagatctccttcctgccccgaaggctcggggaatctgcactcgggtctcaccgctacccttagttggatggaacccagcccttacgggcccggaaagaagcgcctcagctgcctccgcccccggaggacacaaaggggccgccggcccaactcccgcggggtccgctgggaaacgtagtccggagtagaaaaggtcgcggcgtcgcagtgtctggcagcagcggtgcagctccgcgcagggtttgtaacacggcctcctccccaccaggtcctcccacactggcctctccccggccttccagagagcccgaaagtccggattccctgcagctccgagcctggcccggtcacagggacggggcccagcgtcacactacacgggctggtgtggaagtgcgcaggcacaagcgctctgcgcgcctcccttagcaaccagggcggggagttgagaatcgcaggttggccgcagggaaaaggtttgtgcgtgggaacgcgctagtggcgcgt

SEQ ID NO: 5583 - DNA, 1394 bp, Homo sapiens
  source 1..1394: mol_type = unassigned DNA
cgatgtcaggtacgtcacaaacgcagacacaaaccgcaaagaccccagagacccgctacagccagcgtcagagtcaggcaccaccgcgcagccttctctgcggcaccatcctaatcccccgctagagaacggcacacgcgcacgcagcagccccgtgcacggaaacactactccgccagcggccaggcactcggtccaggtacgcgggggcgcggcggccgtcactcagcaaacaccacaggcagcacgcgccgcgccttggtccaggctcgcgatactggggtttcctccatccaactcacgccagggtcacggctacaggcctagatttgaacactccatccccatcgggatcctgtagccaacctccaccctcctccaaacctcccgacccctcggcaggtgcggccccacacttctcccttgctccctgaagggccccagcgttcgccccccgcgcgcttgcgcactcgaggcagaagccgatttccaaaggttccggtgaggcgtcgctgggggcggggcggggctcgcagcctccgcctgtctccgagccgagaaccaaatgaaaaataaaaaggcggaatattgtttttttaaattttggaccgcagtgtccacaggggagcaggcctggattatctttaatggcactggtcagtcacggggcggccattacaggtagaggcctgaggcgagggacactgcggcccctctggctccgtctccccggcccgactatccccgccgagacccggccccacgcgcccctcccggcccggagcagctgcgggacttgcctccgcccccccgcgcgctagcgcattcgcgacggagacaggcgctctcccgtattctggcgccgctgactcccagggctgggctatcctctgagtcgggtgaggctggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtgaacgccccaggatgaaggtcccctgcaaaacgctgggacctagatttggggtgggtgtctggggtctaggaggacacgctggacagttccgaaaagacacagtgggtggtcccgggcgtgggcaaccgggtgcggaactacagcgtacccggagctgcgaacccagacgcgg

SEQ ID NO: 5584 - DNA, 949 bp, Homo sapiens
  source 1..949: mol_type = unassigned DNA
cgctccagcgctcccgagtcacacctgtgcggcttattcaacgcgatgcctggacgcagcctccagagaggaggccgggattggaatacgcagccggggaatggttgcaggtggtccagctcccgcccccgccccgcccccgcccgggcctcgtgcggccccgggtgcgcaggtgaaagcccggcctcagcggcctcggccctgccatggaccccgcgcccggcgtcctagatccccgcgccgcgccgcccgcgctcctgggcaccccgcaagccgaggtgctggaggacgtgttgcgggagcagttcgggccgctgccccagctggccgctgtctgccggctcaagcggctgccctcgggcggctactcgtccactgaaaacctccagttggtgctggagcggcggcgtgtggccaacgccaaggagcgtgagcgggtgagggatccctagggtcgacgtccgttccccccttccctgctctaccaccaaacacctggtcaacacccgggggtccgctcaccgcccacccccgctcgaggcgacttcgagctcccgaggcctcccacgcccccagcttgtcaggagaatggcagtggcctccttcttctgcacctccgtgcagctgctcgttggcggccgctgcggtggccgcctcgcccgctaaccctccaggatttgtgcaggacccgggtctgggaggggacagaggaggggccctgacaacttcaaaaatgtctccctgggcaggtgctttaaaagcttcgcgcccagggggtgcgccttcatctcacaccgtaggcgctggtgggtgcttgggacgcgcagggatccccttcgctcctttttcttgctctctgcatctcggcctcgaagcacacacgagggtgaggagaaaggggggcctgacggaagtgacttttcttttttaaagtaacgaaacacgacgt

SEQ ID NO: 5585 - DNA, 1365 bp, Homo sapiens
  source 1..1365: mol_type = unassigned DNA
cgctcaacagcaccgcccggagcgtccacttccccctaccccgtaaaaaaaaaaaacagggccattggttcgggtcgagagccgctttgggaagcgtctctgtcactaagcgctaccccggggtgtgcgagggagtcaagggacgcggagaccgggagcagggctgggtccccttgcagccccagcgctggcctcctgcccaccgcattcaggcgctgcgccgccctcacacccaccctctcccacctcagcagcgtgcgggggaagcctcgcgccggggtctttttcagcaagactgtcgcggtcctcggcttcaactgcaaggtaaacggtggcagagccccttcccactccagccgtgtgtgattctcacactcagtgccctctcctgcactggggcgccggcagtggcgacctaggctctccagcccccgcccagtcccccgcgtgcgggcgccgggaccgcagtacctgtgacgccgaagcccagcaggccgcagacgggagccacgcgcggccctggcacagggtaaaaacctacgctcaggtaggcgggcagccacgatgtcgggcaagcccagggcagacccccggtggcgcacagggaagcagcggtccagaaggccgggtggacgcaggcggagcccgacggctgggaggccgccggcgcgcaggggtcgggcctcgccaggatggcctcgaccgagaaaggggactcgaagcgtccgggagcgcggggcgtgttcgggccagtaggggacctgggcgccggagagcggccagagcgcggaggtcggacccgagagcccgagggagcgggtggcgggctgcctcgcggcctggggctaggcatgacgcggccgttgcccggacggacgcaaggaagggagctcgggagaagtgagaagattctgcaaaaggcagcgagcaagaccggttgtctgggaacctcctggcgctcggcgaaggctcttaaatttggcggggcggggcatggggcggcctctccccactgcggtccgggcggggcccccaaagcctgtgagcgcccgctctgtgcgaggcaaggtgggcacagcaccaaagagtgtgttccctcccttcctccgcttttaaaaatgcccaccctggggcggtcgtggggaggactctgagctcgctggtgatcctgggcgaaacacccagccaccgggctccgtctttctcctttgctcactgaagaagggatgcccgtttccccggggccttgcagaggcggagctgtgatctggagagcggtagggcagtgcctgcggtcttggcctcagctgacccgcgccgtccttgacgcagaagcctcggccagattcacctaggaccgcgcgg

SEQ ID NO: 5586 - DNA, 2638 bp, Homo sapiens
  source 1..2638: mol_type = unassigned DNA
cgtcgacagcgaagtggcaggcaatgggaatctgggcgggaagcaaagaactactacgattcacatcgcgcccaagcagcagcacgcgggaacctggcacacagtaggtaggcgttcacccaacatctgtcatcggacccagcacctgggcagggagcctaggggtggagtggcggcttgggggacacaaaggcctcgccagcccccagctgcgcccctcgcaacgcggggggcgggagtttagagccagagagagggggcgaaggaatccgccctcatttgcacgtcgtctggggcccggtcaatttgcttaatcaccgctctaaatgccagcgggcagcacacaatacgcgcccattaacaggtttaaagtgtcgcagcgctcgctttaaatgagaaaagcaggcgacaaaagggggaaaaagccaagttcctcaacttgaagaatgccttgggtcgcctcgaaatcatctacgcgagtttaaaattcggagctagctccgcagaaaagctgaggccccggtgcgagggctgggggtgggaacgggggctgtgaataacccgccacgaaaactgggtttcttaggaaccagcctgcagccgcccagtgaacccggagtcggaggacaacgtcgccaacccagctccctaggccccttgccccactgccagagaaagctgaccgatttccaagaaggaaagcgagacccccccaaagcgggcacaaatccaagtttccttcggtgcaggcgaagaattctggaggccaaggaagatcccagaggtggactccaaaacctcaacccgcaagaggggaaaagttaaagtaactttactttcatccaggcactggccagcgcagcctcgcgctcggccgccagagagtagttcaactccgcaaacaagttctgcttgggatcggcgcagaaggccccatcccccactccatggccaagcccgggggcgcatcctgcgggccgcggcctcccaccctccccggcgcgcccgacgggcactcacggtgcgcgctcctccgggagacaggggtccgttggagaggtacgggctgctcaggtccgggatcatcaggaaggggtacccagggtacgggggtcctttaaagaacgcgctgtcctgaggccttctcactgcgaacaagaccaaggcgaggtgaggcccaggcccccgggactgacagcgccgcggcagggggctcgaggcgggagctggggaccccagcgccccccacgcgcgccccacgggggctgccgccaataaaggcggagggcaagggtgcgtccacccaagcaagggggacggtgggccgcccgggctgagcagcggagcgcagcgggaatcgagagtggggggctgtcccagcgggcacataccttcggcgaaatagtcccgcggcttctggaaagtgtcccggacgggctgcgggcgcctctccgcctgcggaggagacacaaaggcaagagcgggtgagcggacgcagggccgggatcccccgggggtggccgcggtgcttccttacctccgagtccgagctgctgctctggttctccgactcgttgaccagggacgacttgacctcgtctaggtcccgctgcgccgaggcgctatcgctgctcggctcctgctcctcgcccccctcgtcctggaaggggatcagctcgtcgttcgccccgaggtcgtcccctccgccggccgccccggcgctggagccgccgcctcccccgctgccgccgccgccgccgccgcccccgccgccgagctggggcatggtggggccgcgggccggggccgccgctctcggagcccctagccgcccgcgccctgcccggcccggcccggcgcccctcccgcccgcttgcgggcccgctgcgctagccgccgcaacaaagtttgacagggcgtggccccgcgggaagcgggcccggcgctgcccggccggggcgcaggcggctcggctcgggcccctccggcagcgccgagcctagggctccccaactcgccaccgccgccgcctgctccgccggggcgtcccagcccctggcccgccggggaggggcgagcggggagggagggaggagggaccgccgggctgggcaggggggccggagggaggagccccggctgcaagctgacacccgcgcgcctcgcggaacccggagagctgcggtgcgcgcgcacacacacacatacacacgcactcacactcacacgttcacactcgcatcttccaggggctgcgtctccctgcaacgtgcaccgcccccaaccccctcctgcgcctcacactgcaccctcggcggccctccccacggcctccctggagtcctggaagtcttgcgcccacccctccgcatcccctaactttctcccaaagaacctccagaactccgcgcaggttcccaccccctcccaccgtatcggcgcgcgggcgggcggcactgccccctgcgggaaagcctcggacgcacatactggccgcggggccctccccctgcctagagtccctccgagtgcgcgagctgatgcacggactaggacactggggacatctatggaaccccggaaaatgcccggcggctttccgcgcctttttcctgtggggttccaacgcgacccccgg

SEQ ID NO: 5587 - DNA, 1531 bp, Homo sapiens
  source 1..1531: mol_type = unassigned DNA
cgaaagcccgtacaaaccgcacagaaaacgaataaatgcttcccgaatgtgagcgaacctacagtttggttagaaaaactcaacactgatttccgttcctccaatcacagaatccccgaggagaaggggacacgccaagcgggcctgttaataacctctaccgtataccccaaagcgttgtaaatcacatcgattattttcgactggaagccgatcggttgagactggacgtgaattccgcgactcgatcacaaaaggttaggaggaaagaggtagaaaagccaaaaggatgactaggcaggtggcccgagcggccaccccaagttaactttttagaaatcattcgtactgttcgggttatcttctctttaatattcgtggctttacttattatgatgttaagaaacgtgggctaggaatggggtgctgctttttgcccgaaacctggaggcgccggcctcccagacgctcccgggcccgggcagaggggcggtaggggcggggcgggcgggctccgggtttgggcgcgcgggcaggtggggcgtggcgggggcgtggagagcccaggcccgcggccaccgccccgctccgggccggcccaggaggagccgcgccgggctcggttataagaggccggctagcaggcgctccgctagcacccgcccgaccccggcccggagcaccgggcgcccagcgcgggtgaaggcggagccgcagggttggcccccaaagggatgctctcgcccgagcggcgagaccagccccgctcgcccctcgccgcggccgcgccgcagccgcccacggccgccgacatggccctctactgcggcgacaacttcggagtgtattcgcagcccggcctgcccccgcccgccgccaccgccgccgccccgggcgcccccccggcagccagggcgccttacgggctggccgactacgccgcgccgccggccgccgccgccaacccctacctgtggctcaacgggcccggcgtgggaggcccgccctccgccgccgccgcagccgccgccgcgtacctgggcgctccgccgccgccgccgccccccggggccgcggccgggccctttctgcagccaccgcctgccgccggcacttcggctgctctcagcggcccttcgcgcagcccgcgcccgccgcgcccgcctcgcccgccgcgcccgcggggcccggggagctgggctggctgtccatggccagccgcgaggacctgatgaagatggtgcggccgccctactcgtattcggcgctcatcgccatggccattcagagcgcgcccgagcgcaaactcactctcagccacatctaccagttcgtcgccgatagcttccccttctaccagcgcagcaaggccggctggcagaactccatccgccacaacctgtcgctcaacgactgcttcaagaaggtgccccgcgacgaggacgacccaggtgagggccgctggcaggtgcttcccagccggggagggcggacgcgggtcgcaagggccggcgcaggggtcggtgtgcgg

SEQ ID NO: 5588 - DNA, 2045 bp, Homo sapiens
  source 1..2045: mol_type = unassigned DNA
cggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagaggtcaggcgatgctgtgggcttccaaatttgtacagctgcgacactctgcgacgtgccaccctatccccagtggggtggggtgggggattccctccgcagtccgctgaaagcgaggcaggaatcactgcaactcctctgctcaggctgaggtcgccaccgctccgcggatgcacgcgctgcaggggcgccttccgccgcgggcacggcgcgggaagggatggggtctggtgggagtgggcaggtggcgggagaggcgcgtgtccgtgcactagaggcccccgtgcgtgacacaggccgatgagctcctgcgggctgcacccacgcggagtcacagaccgaaaaggtcagccggtggccggtgtgctaacatatatagagagacgcccgccaggcgcgccgcaggctgggacgaggctaggagggcccaggctggaggagggctgaggagggctgcgggggcgggccccggcgcagggcgcccggagcggagggggcgggcccgaggcggggcgggccgcggcgctgacgggctgtcgccgctgcactcgcctccagcccgcggtgtcgagcgcaggcggaggtacatggccccgacgggaggcgcgcggcgagcacccggagctcggctccctgcctgagcacggcagccgcgcctccgcccgcgcgtcctcgcccctccggccggcagcccgcggacatgatcgtgtagcctcctcctgggctgggatttgtttgaagattttcttcatggaagcgatgtccccccagcaggagactctagggggacagccggggcgctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaaggtaggcagcggggctgcggcgctggtgggctcggccccctcacctgcccgccgaggcgcggctgctccatagcagttttcggggggcagatatggggagtactgccccccacaccagggtcctggatgattccgggtctcccaggtgggggtcacagtttgaggggcgactgtggatgataacgctcgacactacggggacatgtaggttcggctgggcctagaaccgagcagggtgggggcgggtgggctgtggttgggggtcctgagggctgaggtgggggaccttctccctgcactggtccctggcccctgggactctggccgggctggatagggatccgggtgtcggtgtgggcgtgggggcagcgcgtgttccctgtcaaagctgggagagggatgcaggtgacaacttgtagcgttccattccgataaacacggccgctgtgctgcgggaggattccgatccgggtcaggtttcgctggaacggttccctgagcaagtgcacgtgggccgcgggctgccggcctctgccgtttcgc

SEQ ID NO: 5589 - DNA, 476 bp, Homo sapiens
  source 1..476: mol_type = unassigned DNA
cgggcgacacgccctgggagggcgggctggcggcttctccagctcggagcgcgtggaggctgcgcgtaggggtccgggacgcgggacagggactccgcgcagcccaggcgccggggaaccggggctggagtcggggatctgagcccagcggacgcctcctccgcctggaggcccggcacggaccgggacaccagggcgtccgtggccgtggctcggcccctggctgctgcgggccgcggcctccagtgggtccccaggacccttccccacggcgggtactcaccgaggctgagaggccacgccgtgctgttggggcttctcgtcgaccacattcctgggcgtcagcccgggcagagaccgcggggactggccaggccgggccaggccgggccgggggagggtcgcgctcccgggctcctgaccctcggcggcgagaggaagcggcacctgggtcacactcctcccgcgcgggccga

SEQ ID NO: 5590 - DNA, 455 bp, Homo sapiens
  source 1..455: mol_type = unassigned DNA
cgcccttgcccagcgaggaccgtgcagaagcgggaaccgggcactggagggcgcgcgcggcacgcgcatctcggctggcacctcctggctccgcggggccggaaagaacctcgaatactcggtcttaaaaggctcctagtcatcccgttccttccactcctcacagcacagatggggaaactgaggcctggagaataagcgtggcatacccagggtcaccggaagagtaatgagctgaaccagagaggaggaacgggaagcgagacttctaagcaatgcggggtggcccccgggccaccggaggaggcatggtcgggcacgtccccaagtttcggtacccgtggtggctgtgccagccgatatgagcccctccctctctaggaaggcgcaggactcggggaagcctccgcggccaggccgcctgcctacccgcagaccccgggcgccgcccgcgt

SEQ ID NO: 5591 - DNA, 749 bp, Homo sapiens
  source 1..749: mol_type = unassigned DNA
cggggacccgagcccccgggctgaggaccgcgggggaccccaggtcgggacggagcctcctctggctcgctgtgcgcgcacgcctggaaaggcgggatttaaggcagcgatgctgcgggaggctctgcagtgtcaacgagcccccgaacggttccgcctcattccctctctgtgtgcctcgcaagtctctgcttagtaaaccgtcacagcttcggcgcgcgagagtggcgttggcacgtccaaaccccggggtcctcggccaggccaggggggcgggcgtgcggcggggccgggccgggccgggcgcgcccagcgggctccgggcacacgcccctcacctgggcgaggcccggtgcgcaggcgctcagcgcgggggcagcggccgggcgcttaagcccggcgcgggcaagagttggacagttcaggggccgcgccgggccgagctgtcgcccgcgccacctccaccgccgccgctgctaccgccaccgccaccgcctgggctgcagcagatcgcgggagaacgtctgcgcgaagccccggtgcagccctggcgggaccgcagcaaccaccggagcgtgagcaacagcttcccggctggaggagccactgccccacgcgcccgcggcccgcgcgccgaggtaagctctgggcgcccagcccagaccggcgcccccggactgggcgccctctgcttgcccggcccccgccctcctccgcagagcgagcctgcacctgggcgcgccgcccga

SEQ ID NO: 5592 - DNA, 1134 bp, Homo sapiens
  source 1..1134: mol_type = unassigned DNA
cgaggagggcggggcgcccggtccccagtcgcgcggccaccgcctgcccagcctggctggatttgagcccggcccgccgatcgctggccgaggcgcagctgaagcagccccccagccgcggcgcccccactttccaactccacggttcctgcggcgcgggcgcgatgcagctggcccggggtgaaggcaaggcgcggggcgcggggcgcggggcactgggagcgaggcactggcgcgggatgcccggcgcaaggtgcagggcgcgggccgctctctttccgcgtccccccacctcgccaaagtttttccacgatggtccctaccccggctgggtcagccccgtaatcctcgcctgtctcttgtctcctctttcctccccgagccgcggggctcccggggcgcgcggacccccgccaggggccgtgtaggcgcggagccccagccggcctgccttgggtccgaagaaagttgtggcttggagctagtcctccttctacgacccctgggggcgtccttccttctttttgagcccgcgatgggaaggcgctcccaccccatccccggggtctctgagacttcctggcgaggtggggcggcgcggcaggtgcagggctggggagggcctgacagccctggagagtgcccgaccccagtccgccgccgtcttctaggcggattccccagaggcaggtcccagtccccggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctctcgccccgagcgaggcaggtgccgtgggcggccccggctacttctgcatttcgagcgcttactttgcattcagctctaagtcggagagctctggggacagccgagagtgccagtggcctcatagggagactgagggttctgtttcacctcgggcgccgtgtgggtctgggctgtccacagcacctctgcgcctcagtgataggagaagccaagcgcgaggcctctcaacagctgcgtgcactctatttcccaggtatctggaatcccggcgcctagaacgtgtttttcgg

SEQ ID NO: 5593 - DNA, 1645 bp, Homo sapiens
  source 1..1645: mol_type = unassigned DNA
cggcgctttccttccggaaaggacgctggattcagggcgcgccagtacgcgcagtagcggcccgcgagtcggcaggtgggtagccccggcgcgggaggaaggggaagttaccttcccctcggaagagggcgctggctcccccatcctgcctttataataaggccaccggaggagaggaagcagccagctgccgtctgcgctttgcaaagcatgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggtgagcgcagcgtggaggggcccctgggttcggggataaagggtgacgtgtggtcctggggaaggtccgggatgagggagctgaacccagttgttccgcgcggtgcttagagtgtttcaccgcgcgcaataaatctccgtagacaccgcatctccaatgcggtgtccctctgtgtcagtgccccggcggctcttgcagggtgccaatgttacggctgtacaccgcttttccctcccatcatcctcacctgaacagacctggaggaggcggaaatggaaattagggcatgtccacaagctggattcgttagatcctcctgctcggcggtatgcttgtgcatgcctgcatgccggcaaggagccacggatagggaaggctcaagagctggccacctgagcgcagtagatgggctcccgcagttttaggcgccagggtctccacggggcgtctccgggaggtgggcatgaaggctagagcgccggcctcggaagctcggtcggagtaggtggttagatctgccctggagccagacctggctcgggttcggtgcgcga

SEQ ID NO: 5594 - DNA, 4698 bp, Homo sapiens
  source 1..4698: mol_type = unassigned DNA
cgcacggactcgcgttcgcatccgaagaccccacacgtcccccgcactgtccccacagcatcccacgcccgcggtgcacgctcacctgccggtagacgagccacacgcctcggcggtccagacttccgtgtcgacctccgtgggcgagcctacgcgctgggtgcccggcgcgccctcaggagtggctgggaccgcgggctggcgccgggcagggcggtgggacgcctggagccggcgggaggagcacgcccaggcgggtccgcgccgagcccgagcgagcgggcgagccgggcgggaggggccatttgtaaccgagcagacgctaccaccgccccttactcgcggggggcgggggcgggcggtcaggtgacggcggcccaccctccgccgccgagccgggtggttcctgcccgggaggagccccctggcgcgctctgattggaactcccgccgcagtggcgggggaggggggacacgtgaccgcccggccaggcggcccggcgcgccccattcgcgatgggcaccccatcttcctcctggaaaagccgggggacacagagaaggcggaggagcacgcggggtgcaggagagcctaccagcccctttagccgcagtgctggtgattccggccgctgaacccggagaggaaaggctcccacgcggccagccggccttgactgtcctctcgccctgcccttggccgcagtaccctcccctcggctgcagtaaccgccccctacacctccaggcaagggcacgctcagtgtagaccactgccacttcatagatgccagtgccacttaagagtggtgttgggttttttttttttcctttcctcctctctgcacaccagcacattgtacccgagagaaactcacggcggtgcactgcagacaccgcccagctccagggcccgaagaccctccgaccaggccccgggatgcctgaggtctcccaggtcattacgtggaggaactcaggcctgctccctgcgcaggaggaggaggcgtcgcgggagctgcagtccccgatccttcccaggaagccggccgggtggaaggggagagggccgttatcgtggtgcgaatccaactcgcagcctctgggagcacgttgctaataaaggtcaaattaaaacaactaagtggtgccggcagggacgcgccgcatggtcaggagaagcccggctattaatcatccataaggagcattgctcttctggtgtgggagaatggggctgtgcgacagccccccggagttgcgctctgctctgaaccctaagctcccccagagcaagtggattgcgcagcctattaccccacctccccacggccccctcttggggcggcaccaccctagatggcaggaattcggagaaaatgcggtgtcacgtccgccgctatgcccgcacacgcgtctgcgccaactccagcaacacgtggggaccgtgaatctgggcgtctgctctccacttaggtggttatgtgggtatacttatatgattactgattaaaaccaaattggacggagaagtctgtttctacactggattctttcaaacttctgtccaagggagttttgcgctcgatttgggcggggacgcagttttcagccaagaccgccgcagcgctcagcagagcccggggaccggtggtggtggtggcgggatggggaggaacagaggcccttgattctttggtactccactttctttccttatttagaccagtcgggcaacacgtccctcgcccaagatggcctttccaactggaacgtgactcagacaatgtggaagccaggggtccttgacccatcgtacctgggcttcgctgggcataggacaagggttgggcaggtttacctggaaagggagtttattcgtaaagcttcgggcataaacgctagatagcgaaactttgaggaagctcaaagtttacctattgtaaattggtggggggtgggggagcatcttatgtaaaaaggaacggccctattaaattagtaagtatcttattttcgtagtggacgtcttgctgcccttggtcctcccctcccccacctcatttctccaaaccaccaaggttggagaaatctcataaacaaagtataagtccgtggggggggggggggggggttacttggtgttttaaaaaaacaacaacaacaaacgacctttgtaataagaaaggtgggtacgttttcatttctaggtcttaatcttaacgttacggccacgttaaaattgaagttgattgagacaagagaatcccagagcacagcacgcagacagacaatttcacaattaaaaaatatgtacttccttctccccgctctcgtcacctccccctttccccgccattacctactcccgtttggactaggggctgggagaggaggaggatgtagtccctccgagtgcacaagggaggcggcggggccacttgttgctgcaccgccagaagagctaattccgagcggatctggcagggagttaaaacccttctcctggatgcgacgccccagagaccgaggcagacggcgagaacagattcagcgcctcgagatgtgctttccaatttgaactctggaccatctttgcttgaaatgctttgtcttgcacgtctgggaattactctgtgcgattaaacgcgtgacacacacacgcatacgcggggtcgccccgcaggggggagggtgcgtggcacaggagcctcggactttcaggggctctgcacttggggagtggtgcgagggggaccgcctcggtgtggctgctgacgtgagacaggtaactcggaaaggtcttcctccggctgccttggtaatgggaagctgtgggcaaaggtgcaggggcggtcccggagcgcacacggcgcagtccgcagtgaagggcagtggtgtggtggggcagagagactagacaagggcaggcgggttttgccgattccgagttcatccgtctacggggtcacgttctgttgagaaaatgcgcgacacccggtagggagagagtgacactgaccaagtgtccctggagggccgagccgtttgccctcgggagggggtcgcgaggcccgtcagcactcggctcccgcggaagctgtgctagcgcggcagtctcgccggcgcctggccccaccagcctttgccttcagcgtcctccggtggcatcgtccgagatttgcggagcagaagccgaggacacgagcaactcgctgtgggcttgaagtgaccacgccttagggctgtgaaaagctgccccgtggtgacttgggtacgaggaggttaataaagtgcagaattagtcttgatttttacctaaaatgaagctggtagtactgagcgcttaaatgactccgctaggaccctggaggttgtgggagcggggtgggagagggtaaatgctaggtttaggacaacacaggatatgtctaatttaaggaagctccccttctcgggccacgttctctgtagctctacccaactggaatcgcctctgcacccggggtcatctccggcattatgacacccagcgttgccctctaaactccaagtccccgcggccacatccttccgtgcctgctggcaccagcaagagtctctgcctgccctttctcctttacatggacccttttcctttcacccctagaccgcagtgcgactggcaggcacctcttcgccccctccgcgccccgcgccgacggtgggaacagcagcgacagcgcgaccgcagccttctagtgccttcgccccctcccccgcggccacacctcacccacctcacccgccaaaccccgcactccgccgccgtccctcccctgcgcgctcccggcgccaacccagccagaagcgggtggaagcccgggtccatgtgcaggtgtccttgtgcgggagtaggggagctcataggtcagcgatccgcgaccctaccctgccctcagctcggggtccacccacgtggaacccgccggcccccgcgggtacccaacaccagtctcccgggctcggctgccgttccctcgaagccccagggcgctcccacgggtcaatgaccacctcagtctttcctcaagccagggtttggccagttgggaaacctcttcgtcccctgcccacatcccctggcatctccggacaaagccactcggcttcccgccccggcatcgggaaagatgcgcgtggagagcgcctccaggcgctgggccacggtcccggtccctggccgtgcctgctgtgtgcggagctggggcggcgggtaccgcctgcgcggggcaggcaccccactcgccgttcctccagcacgggcactcgaccgccgcggcgctgcaggaaggaggccccgccgcgccggttcctccacacccacgtgcccctcgtgtgcgcgcccccggcctgcagatgctacaaggctggcgccgcctggatttccgggcggccccaccctccgcggccgctacgcctcgctccctgcattcagtctccttggcgtctccgctgcagcatccaagaccaggcgccgcctctgctagccgtgctgcccagcacgcctgagggccgctgccggcaggcctcacctcccgcccgggtcccccactcacctttccttctggacggtggggttcaagctctgcactggggctgttaagccaccgcccacgacctcctgtagggtgcagcgggagggcgttcccgaggcgc

SEQ ID NO: 5595 - DNA, 462 bp, Homo sapiens
  source 1..462: mol_type = unassigned DNA
cggctcgtaaactgattatgaaacatacgatgttaattcggagctgcatttcccagctgggcactctcgcgcgctggtccccggggcctcgccccccaccccctgcccttccctcccgcgtcctgcccccatcctccaccccccgcgctggccaccccgcctccttggcagcctctggcggcagcgcgctccactcgcctccgtgctcctctcgcccatggaattaattctggctccacttgttgctcggcccaggttggggagaggacggagggtggccgcagcgggttcctgagtgaattacccaggagggactgagcacagcaccaactagaggggggccagggggtgcgggactcgagcgagcaggaaggaggcagcgcctggcaccagggctttgactcaacagaattgagacacgtttgtaatcgctggcgtgccccgcgcacaggatcccagcga

SEQ ID NO: 5596 - DNA, 300 bp, Homo sapiens
  source 1..300: mol_type = unassigned DNA
cgctgcaaaacagccgccgggtgcagtgggccgggcgctcggccaccctggctgcgatcatcgcagcctcccaaaggatgcgggcagatgcagacggctctggcccatctgtccctaaaggcctgggactgtgcttgcgtgctccgggagggtacccgaaacctgggagctctccggcgctcccagcctcgggtatctggggctctttgtctcccaacagcactaatcctgagaacaacgcgcaccgaaggcggaggcccctgtgctttggacaagcccgccacgggcaagccagttcga

SEQ ID NO: 5597 - DNA, 554 bp, Homo sapiens
  source 1..554: mol_type = unassigned DNA
cgccggggcggggattaccttgtagcaggagcccgcagacactgtagaagcggagaacggcgctgcgtttccaaatcatggtcccttctctaaagggctggggaaggaacgagggggcaagtagatgctggtgagcggggcacgagagtgcagggctccgctggtgtcctcctcccggcgcccgccggacccaccgtccccaccgctgcggtgttcgaacccgcggactcggatcggcggcagcagaagcggcagcggcaaagcacccgcagaatggggtatcgcgaaatagtttcttctcctcctcctcctgctggtggtgcagccgcgacagcccgtcttccaggcaggggtttggagcttgccttcctctcggcgcgcacagcaagtcccagagcccgccggggctgcccgagcaggtggtgcagggatgccggggtgttggagaaggtgcgggcgagggctgcaaggagtgggtaggtcacggaggggaagggctgggggagaggaggagcaagcaagcagcactgccgctcgcgcccggggtgtctcgg

SEQ ID NO: 5598 - DNA, 1153 bp, Homo sapiens
  source 1..1153: mol_type = unassigned DNA
cggcgcacacaagttgaggactgccgaggcgtctcctgcgaggtaaacacgaagtcgcttggttagtgagaagaaacccgaggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggtgagtagcggcacagcggccccctcgctccgcggcccccgctcgccgagacgtggctccaagaagtggtgccgcagccggggcagaggcggaggaagccgagtcgggcaagccgggaaggctgcggagacgctttgccggggcaggtgttgcagcctcagctagcggtctctacggagggggcgg

SEQ ID NO: 5599 - DNA, 1603 bp, Homo sapiens
  source 1..1603: mol_type = unassigned DNA
cggcccgcagggggtgtcccggggcgccccctgcgcgaggtcccgggaacagggcacgagggtccaggctgcccagttgcaggtgcagctgcttcggaggaggacgctgcctgcggcgccggggagctcctcgcggctggaggcgaggggaattgcatccaccacagtgtcccgcttgcgcgaggactattcacttgggccggagagagcgcgcgcgcgcaagagcgagctcgggctgtggtttgggggaggggagcgagggggcggggagcgcctcaccgcgaggacgggggcggggacggactgccaggtggggcgggcagttggggcggcccgaggacctctcccgactcaagtgggcacttgcggagccaaaagcaggggaggcgctgcagctgtgaagaggcgtgggggccgcgggaactttcctctggccggtgcgatgaaagccgggcggacgaggtggctcaacggggctgagagtggttcggccgaggcgcgggctgagccctcagcacctggcctgagcggcgtgggcagcagcctgcaccgcggacacctccaactctgccgcgtctgcgccgcactctggccgtggcagcgattttccgggcatctctgaggccgcccttagtcccacaagcacttagccgcccatttcagagcagcggcgccgaccgttttaagaggagtcagttcccgacaccgcctcccacttacttctccacatttccaccgctggagggggtgagtgccgtggacaggcgctcccgtccggggacagctcagcggcggcagtcagcccgaccctcctccgcgcgggtcgcccaaacttgaccagcagagcgagcggctcagcgcagtagccgccttcgcggcttccagttgtagaaaagcaaagcgccgggaggaagcagcagagggggggttacatgaggctggaaagtggcgggtgtacggcgcccgggatcgccgaggtccttgcgtcgccttgcggaggtgacttcgcggtggaggtcacgagcatcgtcgcagccttgacgctgggattcaggggtccccgagcgtccacggcgtggtggcgtcgggccgcgctctcctagcagtccaagggccgagtggcgcgtggccacatccacagcagcgcaggggcgccgtgggctgacggctctccccgcgcgagccgccccctcgcggcacccactccctccccgcgctcgggtctcccggaagccgaggcgcgggccacttggtgggactccgcggcccccgccccagggccggggcaacgcggcgtgctgactgggaggaccctcggcgtccgcggtctccaccacctcgccccgcggcggaggcgggcgcccagggcagggacggagcccggagcgctgcagagcccggccaagcccagccttctcccggcctggcagccgcggctcggatgccgccagttcggcgctagagggggttagtcgacaacaaaaatgcctgcaccgctcgcaggtggaggcggctcatcaggccaggaaccgaaaggagggagggatgctgtcaggctaaacttaacgccttggttaagggcgcgtcaaggaaaccgtatcgc

SEQ ID NO: 5600 - DNA, 1411 bp, Homo sapiens
  source 1..1411: mol_type = unassigned DNA
cggtccccgctactcgggtggatcctgcttaccgcgagcggggaggcggttgccttccgtgcaggatttccgttgagggctcacaataagcggtctcaagcgggggcacattccccgccacttccgcggtccctcaaacaaacaaagaagccaaagtcggctgtcccaagaccaatgtaagcgcttaggaagctttgaggcgcttgagggcgaggcaggctgccgtgggcaggtgtgaacacctcagccctcgcggcgggtttggagccgcccagcgtaggaagagggcagaagtgggctcgcgtctatgcgggtattcgaaatgaaaaagagctgcaaacggcacaaaagtccgggggctaggcgcaggaaaacagagcaagggagctgccttagttctcaaacactgcatatggatgggtgttccgcggaagattattctagaccctgtgaaagaagtctccactgggcgccggccacggcattggggtgcgcgcctgctctgcgagaagggtcccccaggccgcgcgggggaacgcaggagacgcctgtccccgggggaaccagcggaggattgtttcatttcaaagtgaaaatctgcaggctttgggaaacgatattcaaaaaagtatataatctccatatgccgctcaatggaggatcctcataatttacagcggcagataaggctagagggtgtaataaaaaatctgaagccctcccctcccccctcgccgcctccccggaattgcaccttgggcagcggagcagaatccggaatgtgaacttctcccgacatatgtttcccgcagataagtaaacaatctggacgtgaaatggaaatggtaattaatgcagtaatgctgttacacctcgagtgtgcaaatcccattgactcgccgcgccacggggggtgccgggcgtacggggaccggtggcgtgcgcccaggctgcccactccctccctcctctctccctcctccctaggtccccgggcggggcgtccagaaatcccgcagggatgtggacgggctgcgggaagcaaggagctgcttaagcggcgttcgggactcccggctctcggcccttggaggactgggcgggtgctctgcgtttgcctcgacagccgcacctctcacccacctccctcggttatcaccgccgcgctagcgctagcagggcctcctcggggctcgagtgcagcccggccctgaagcacctaggagagcctgagctcgggcgacagaggcctggaggcagagggaaccctcaaacttagtgcggcgggtggccctgagtgcggcggtcaggtctttctctcctctctgttccggggccaagtgctgccgggttgtctggcgagagtttttctgaagtttctttccatcctcgcaccgaaagcgctgatcgt

SEQ ID NO: 5601 - DNA, 2629 bp, Homo sapiens
  source 1..2629: mol_type = unassigned DNA
cggcagcaaacggcagagcaaaggagtcgttttctttcacctgaaagccgcgaggaggcttggagcgcctttcctcgctggggcccgagcttcctgggctttggccgggtgcgggcagaccccaccggggtcctcgtcatctcccagcccagcccgcagagcgagtaccggcagatttcaagggcgcgtgagcctggctgtcggctgggcccctgaggctcgctgggcgggggcaggccggtccaggctgtgcggggcgtttacaaaaagtgacttggagatgaactcgcccgtgcgcggctggccgccccgctataggggcgaaggcgcctgacgcaagcggaactcggtggagcccatacgaatcagaacagagcgaggctcctggcgcactagggactccaggaggcagctccgccagagacgcgggtcgtgcttcgggaaaccggggggcggggggaggggaagagcgcagaaaagaaaacccaccaaggcggggactggcctgagcggggaggggcggcgaggccggagcccctctctgttgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcgg

SEQ ID NO: 5602 - DNA, 1686 bp, Homo sapiens
  source 1..1686: mol_type = unassigned DNA
cgacgctcccaggcagctgtcaaagtccggggttcgccggcttccaggctcgcctgacagagccaggcgttcgcttggatctagcttccttccgggcgggaggcgcggggaggtcaagctcttcaaaggaacagggtgggcaggggagtggtgccaggttaggctcctcggtcctcggtagtcagagcggagtaggaaaggcagcggggagcctcacatcccgcgcttcttccggaccccgccgcctacccggagggtacacgttccccggggagtcagagacgccctgggggagcttgaggagtgtcagcggggccttccctggagcctacaagtttccactccatccccgagctgggagacaagtcacagctcggctccctccttgaaagcaccgccgctgatccttcccccaggcaggagcagacacctgcttgtccccacggcgcgccagcgccctgctctagccgtccctgggccagagctcgaaactcacccactgcgctcccaccccggcacagacagccctcaaagttgtccgtactccccagacctcgccttctgctcagcccccggaccccgcccaggggttgagttgacgtccgcgggtggacctctctggtccgctgcgcagggaactgacttcgggaatccagggcgcacagaggccaaagaagctgcggcaagggagggtgggcaaatccagcttgagcctaggtccttgccgctttcaccctcaagcctgccctgcctccctcctgggagaagagcaaacttccccagcacccacctttagccgcgaggaggcggcgctgccggctgtccccgccaccgccgctgccgctccccacgcccagcgccagcaggagcggcacccagcacagccgcccaggcagcatcctcgcagcagccgccaacgagctgcagccgccgcctactgtccgcgccggctctcgcctcccggtgcctgccgcaccgtgggccgcctcgccgtgcccgatgggtgcgcttctagcgctgccgccgcggcgctcggcctcgggttcccgccgctgcgccgctagctcgccggcagcagccgcgctcactggcgcggacccggagcggctcaggcgctcaccccgggacggcccgtgacgtcacggagggagggaggtggctcgtgcatattcatgaacgcgggcatcggcgccgggttccgcgctccccgccccaaggccccgacccccaactttcctcagccgtctccacgctccggggccctgtccaggtccccctgcccagtcgggaccgggcccccagaggaccctggtgggcggctccggagagccctccagccccgcgcctccactccgactctcggaaaagctgccgcaagggatggagggctcccccagaaagtggccacccgaggcctgagggtcatctggggtggcgcgagggaccctgacctgccatgccctttgaactgatatctgggcggagaggactgacgggcgtcgctaagggtcttgcccttggctgggtctctgggcgttctgcgtcgactggtctggggagggcgccaggcgcacactagagcagcgcctagtggtgctaggggttgtcgggcagagtagatagccttggacctggatggcaatggcagggctccgcgtcatctccgagaagcaggggcagccgcgg

SEQ ID NO: 5603 - DNA, 1686 bp, Homo sapiens; identical to SEQ ID NO: 5602
  source 1..1686: mol_type = unassigned DNA

SEQ ID NO: 5604 - DNA, 2132 bp, Homo sapiens
  source 1..2132: mol_type = unassigned DNA
cggctcgaagagctggtgagcgcgaccacagggcagcttgcggacggttctttcggacaggacaagggcgagggaaacggcagaatggtgacgcacctgagtgcgcccactagacgaaagaagaccaactaagccttcgtgtagtgcgtagacaggccgacacacacacacacacacacacacacacactaacacacacgcaaagacagtgagggagcgagaggcgcatccccaggtagctgacaatgacacggccccgatccggacgcgggcttaaagccccccgacttccggagtgcccccctccccggcgacctccggagattaccgctggcgcatctctccgccctgcccggctccggcgccctcccctccccccgcagccgcagctccccgccccccgcgaacgcggctccccagtgtcctccagaacgcccgcgtggctgtcgggtttcgaaccccagggccgactctagtactcggcgcgcgcgccgccgcgtcgccgaccagcctgcggcccccgcatcaatcattaacggggcggcccgggctgcggcggcccgaggagggggatggtacggaactcgagacaggggacaactctatcccccgaagcggccgcgaaaccctagcctgggaggcccccgcccttcctcggtgcgcccgtccctccctccgcgcctcggctcgcacatccccacctcccgctccgggggcggcggcggcggaggcacccgcaccgcgcgatgcccagtcaccgctgccgcgctgccgccgcagtcagccgcgccgccgccgctgccgcagcgcgggcggccgcgcgccggtagcaggggcttggcgaggaagccgctgagcctcgcgcgctccgcgctcctggcggtcgcagcgctgcctattaattgattctcttattgatttatttaatttttaggagcggctgctcggaggcacgggtcttctcctaaacctgcagcgacgcccccggcgtgggcacaaaggctccgacggcggccggcgggggctgcccagcgcccgggagccggcgccagaggtcgcctgcgcgcgccctagccgagccccgggcaccatgccgcggcgcctgcagccccggggcgcgggcacaaaaggccctccggccccggccccggcagcttcgggggccgcccggaactcccactctgccgcctcccgggaccccccagcgtctgccaagccgctgctgcgctgggacgaggtgcccgacgacttcgtggagtgcttcatcctgtcgggctaccggcgtctgccgtgcacggcccaggagtgcctagcctcggtgctgaagcctaccaacgagacgctcaacttctggacgcacttcatcccgctgctgctgttcctgagcaagttctgccgtctgttcttcctgagcggcggcgacgtgcccttccaccacccgtggctgctaccgttgtggtgctacgcgtcgggagtgctgctgaccttcgccatgagctgcacggcgcacgtgttcagctgcctgtcgctgcgtctgcgcgccgccttcttctacctggactacgcgtccatcagctactacggcttcggcagcacggtggcctactactactacctgttgccaggcctcagcttgctggatgccagagtcatgactccatacttgcagcagcgcctgggctggcacgtggactgcacgcgccttatcgccgcctaccgcgccctggtgctgcctgtggccttcgtgctggcggtggcttgcactgtggcctgctgcaagagccgtaccgactggtgtacctacccgttcgcgctgcgcaccttcgtcttcgtcatgccgctcagcatggcctgccccattatgctcgagagctggctcttcgacctgcgtggggagaaccccacactcttcgtgcacttctaccgccgctacttctggctggtggtggccgccttcttcaacgtgagcaagatccccgagcgcatccagccgggtcttttcgacattatcggccacagccaccagctcttccacatcttcaccttcctcagcatctacgaccaggtgtactacgtagaagagggcctgcgccagttcctccaggcgccgcctgccgcacccactttctcgg

SEQ ID NO: 5605 - DNA, 2954 bp, Homo sapiens
  source 1..2954: mol_type = unassigned DNA
cgcccagagcgtggtagtctgcggggccgcccacgccctccttcttggcgccaagcttgtggcccgcggcctccaagaagggcatgcggtgagctcgcgggtctcggctgcgcaccacctgtaggctctcacggatgaggccgtggcgcgagcggatccgtgaactcgccaccgcgcggggatcacgcaccaagtggatgaccttgaggtccagggccgggtctcgcagcagtggcgccaagaccgccacgtcgaagacgcgcacaccctttatgactagtgtgcggtacttgcggcactcctcctcgaaacgcgccaggcgctgtggcgggcacttcttgcacacgcggtcgtccaccaaccccacgacctccttgcggtaggcggggcagagtggtgacgagcacaccaccttgttggtggctgcgccgaagatgcccagcgtggtgaggttgcgccccccgctgcccgcggggctatacaactggaagacagagaggtcgcagcggtaaagagcgctcagcatgtcccgcgctgccccctgcagggaaacggcgtcccccggatacagtttttgccatacatgccacactggctcgtagagaaagaacacctcgggattctggttgaatagctcgccgaagaacgacgagccagagcgccacgtggtgaacacgtacaccagctgccgcttgtccccgacgcccccggtgccccgagtgccattgcctggaggggccgcaacccccgccatccctgccgcggctgcaggagccgccccgacggcggcagcgggagggcggtaaggagtgcggaggtccaaacgggcatgagcacggggcggcccggccggaggcggccctgggcgcccccagctgcctccggctgcccccgctgcggcacccagcggcccatcggggttgcactgctgcagcggctccttgtgccacttgtagtccaggaggttgagcatagtgagcaccagcagcagtgcatagcccgcgcacaacaccagcgccttcctacggaacaccttcattccgagaggggacgcgggccagcggcgtcctgggcgccggggccactgcgggagcagggcacgcggcgcggctgcaggcgcagcctggagcagccgagggagcgcgcccgggggcagagctcgctgcgggctgcggctcatcacaggcacaatccgggccggcggcgcggcggaggcagccctgcagcccgggaaggggacgcagcgggctggctgctggcgccgggactcgggccgcgactccgaggcgggcgcggcggctggtccccagcgcccaaggctggctctcccatggcagcggctccgggtaggacctgcgaggggaagcggagtgagcggatgcgccccaatctccctcccagcctcctcctcctaagtaacgcccaccctcggttctgcccggttcctccgctcacctggagccgagggcgcgcccgggagcggccccggatcaccgcccggcggactgtccggctgtcactcgttcctcgatttcgctccctctcgcttccgctgggggtccccgcaccttcgaggggtctggggagtcggccgacttatccctgggcagtttccgggcagcgggcgccctgcggctcgggaagaaaaactttcacgcggcccagagccccgctccgcgctccgccgaacccggcgcctcccggctccagcgacgtctcctccgctttctcgggaccgcagcttcctgtctcgctcaggggaacgaagccggctgggggcgatggctgggggcggcttatatgggactcagctcccggcatagcggcgcagcccctctcgctttcggcctccgtgcggcgaattttcccacctctctggcagcggtggatggggcacagcgcgaccccgcagcggcggcggcggctgcttccatcaccgggaggatgcccgggcggacagcgcaggcaacccccgccgctccgcagcctccgactggaccaaaggaccccgaacacacagctctaggcaaggaaacccaggtgtgcagcactgcccgacccgacccaacccgcccccggtaccagcgcttctggccaacgaggtatttaagcaaagaaagaccccgccgcagccgccgccgccgcgcgaaagcggcgcccaggaggatgctgctacccgactccccttacgccgggcgcccgcaacgcgctcggaccagcctctgcgcggctcctgccagccggcgcccggttggtgcgcgccgccgtctgtcgccgcggctcctcccctccgccgcgcagccctcccccttcgccggccccgcccccgcccccaacgccgagccggctcccaccgtcgctgcgcctcgggggctggagacgcgacccgctttaccgcgacgcgcgggggctgcagtccacgggtccgaaggcttagctctgcgcgcaaagcgccgggatgcgaacgcgggatctggagctcgtcggtgccgagagctgccagagagttggattctgcgtgcagctgccggactcggccccatgtttttgctctcagaaagagttggtgatgaagtttgggcagaaatcccctgtcggccgtccgctccacgcttccctcggggccgacactgccaacctctccgggcactgaggacacctctgcgccctggagcggtgggaggacgcggagcgccgttctctggcttccgacaccctgcccgccctctctagtgggtctgtggctgcgccctctcgaaggaagtaataaatctttctgaccttgggggtcagaggagacgcttcagttttccggaggggtgtgcgggcgggaccgtctttccgctttactggacctctggccggggctgctcttgtttcattgtgccccacatgcggagccccgatgctctccgcatttccgctcgcggtgctgcgtccactgtgattgacgt

SEQ ID NO: 5606 - DNA, 2954 bp, Homo sapiens; identical to SEQ ID NO: 5605
  source 1..2954: mol_type = unassigned DNA

SEQ ID NO: 5607 - DNA, 885 bp, Homo sapiens
  source 1..885: mol_type = unassigned DNA
cgcccgccgcccttttgaggtcacggcgcaggagagaaggagggcgcggaaacgccggcaccggctgggaagcttcggtgctccgggtccctcttggcgagggcggagaagtcggcggcctctgcctagaattctgtgattgtagggatcgagacatcaagggcgggggtgcagaggattacaagttccctagcgcgtctcatttgcacataaatgtgctttgcctcctaaccttgtctctgttacctgtgcacctgccttccaccaaaccaaccaaccacccgtggctcaggaagaaaccagaactggggggattgtcttcccaagggggacacagttgaacgtggccggcagcctctggcctcccgggcctgggttcagacggactccggcgctgcttccaagaccgacatcgggcacctggccgccggcgcacccaggagcacgatttcatgcgtgtgcacgctctctgctcgggccaggagctctgtttcagccccactccgggctataaatccctggttccgcccagcgcagcctcggctcggagggcagcctgctagccaggtcctgggttagggatggcccacggtgcgcgcggggaccgccacactccttagcgccacgctggggccgcgcgggccggagcagggggagggggcccgatgacgtcatggaacagttggaggatttagctcgggaacccgccggggagcgggccccggggccggcgttccatttaggccgacagcgtcccgggctcggctccactttcccagacggcacggctgccttccacgtccagagcgggcctggggttctgaaggaaatcagtgcacgatcgcgaggccaggaactctggagaatgggcacgcaggcgtgcgc

SEQ ID NO: 5608 - DNA, 2174 bp, Homo sapiens
  source 1..2174: mol_type = unassigned DNA
cgcgctgtgcttcccagcgctccaggggcccggcccccagctcggccccacctgggcgctctttcgctcttccgtgggtcggcgggccgtgcgggaggaactctggctgccgcgggctctgcgtcccacctgccatctcggtggctctcgcccgggccccgagtttcctgcggagctagcactccagctgagccagccggaggggcggcggcggctccgcgcgcccagagcctcagcccatgaatgggactccaccctgagcgccccctcccgggcctggggaggcggcggcgcggcggcggggggcgccccgcaagcccgcggctctgagcggccacccgcgcagcaagttgggcgagttggcagccgcctgcacctgcctcctggccccggcccctgattccgcctccggccccaagcgcccgggttgcgccctcggctgcctcgcgaggtagccccaggaggcctaggggccccgcctgcgcccctggcgccagaccatggtgggcagctccggccaggagcctcagccgccgcgagccaacatcgcctgcagccagcccccgccccacccgagcggacgcgcgggtattcgcagcgcgcgggtcacttccttcctcggccgggatgggcggcgcgggactgagtgatcggccttgcgtccggcgggtaatccccatctgatctgctgcctgtgagctgctgactgccggggcgcgcgagcctagggggcacgggcagcagcgcggcgatgacctgatcccgagcccgccagggcgccccttccttccctcccttccctcgctccctctgagcctgtgcggagaccagctcggtgcggcggccccgggtggaccatggcggggagctccagttaaaggcgtgtgggcgccgagctggagaggacaccttcggcatcgctgccttttgagggggcttatttaaactactgagtcattccagatttaggattccctaaataatcaccaactgtgcccgtctcgtgccggaaagcaagcggaaagagaaagagcgcccactcttgggaccccgcagatcgcctctcgctggtttctccccgaggggtgcttggccctcgaggatctccctccctccctcgcgccctcccccctccctcgcctcccgctctctttgcagtgctgctggccgggagttgctctcaccgcagctggaaacagctgcccccgccccgcgcccctacccagactccgggtaaccgctcccacttcgcgcctctcggaattccagaactcgggtggccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttttattcactttttagtattttctaccgggggcgcgctacccgcctgggtccagactctgctttgtaaacgggttttctatgtatgtatgtgtaggtatactttggacaccttacaacgcttgcgcctctccaacagaggcacgtcttgttattttgggcatcgttcttccccttccacttggtaccccgaacgcagtgtgactaaactccccactgccccttggacgccgatcgccttggggtgcaagtttggggtgcaaacgtctacttcgcaagagggcctgggaccgccccgccccgccccccggccgccagaggttggggaagtttacatctggattttcacacattttgtcgccactgcccagactttgactaaccttgtgagcgccgggttttcgatactgcagcctcctcaaattttagcactgcctccccgcgactgccctttccctggccgcccaggtcctgccctcgccccggcggagcgcaagccggagggcgcagtagaggctggggcctgaggccctcgctgagcagctatggctgcggcgatagccagctccttgatccggcagaagcggcaggcgagggagtccaacagcgaccgagtgtcggcctccaagcgccgctccagccccagcaaagacgggcgctccctgtgcgagaggcacgtcctcggggtgttcagcaaagtgcgcttctgcagcggccgcaagaggccggtgaggcgg

SEQ ID NO: 5609 - DNA, 873 bp, Homo sapiens
  source 1..873: mol_type = unassigned DNA
cggccgggcttagcgatgcggctgagctgcccacccgcgtctgttgaatcggccaatcagcggcgcccccggacctagcgggagcgtttccatgccgaccgcggcaggcgtgcgctctccggggccgcatcgccatggcgacctgctcacctgactcgctccgggtggactcgccgcgacccctgggcgttcaggcccctgagggcccaacgggcgacggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcggcagtgttgcgtctccatcgcgggggtccttgcgggccgcgcctgccccgcccggctcccggtgcatgtggcctgcgaggcggcagaggagatgtggggatttagggtcgcacgtcgtgctcgaggtccccacgagaggtcttcccccgcgggctcctgcgcaactgcgtgaagccggcccgggaaagccaagattgtggcccaggaagaggaaggaacgcgggcgacagagctggggcttgggacgttgagggggtcggtggcagctctccgg

SEQ ID NO: 5610 - DNA, 2174 bp, Homo sapiens; identical to SEQ ID NO: 5608
  source 1..2174: mol_type = unassigned DNA

SEQ ID NO: 5611 - DNA, 510 bp, Homo sapiens
  source 1..510: mol_type = unassigned DNA
cgcgcagccggagaggagggggcggcatccgggatctggcgcggcttttgccttttgcgccagcgtgagctcggttagggtctccacggccgtgctttcacccctcagggaggcgtcggtgattcggtcacagcctcagcctccgtcgctctgtgacctgcgggtattggatgattcgtagctgagactccgctacacccctgaagtggggaaatggtgagtgtgggggcagggcgtcccaaggctggggaggcctcatccgaaccggcgggaaatggcggcggcgggacggagtctgcgaacggagtctccgctgccgccgctcagccctcagtccttggtcccttccggtgagggacccgggttcatgtcggtccccgcaaggcggctttggcccagcctgcagccctacttgtgcagctctgcgcccgcagccccgcaccttccctgggctgtggggtgaggaggagctcatcgggaaaacgcctgcgtggcgtgcgaggtgcccgc

SEQ ID NO: 5612 - DNA, 511 bp, Homo sapiens
  source 1..511: mol_type = unassigned DNA
cgctctgattcggtttgggcgcaagcaaacccaggcctggccgccgggcgcctgggccgcgccaactcgctctccccctcccacgcccgtccggcacctcctggcccgccaagccccagatgcgggtgtttgttccagaaaactttcggcggcggctcgcactgagcatgctcggcggcggggcgggcctggggtccggaagctccagcgactcggcggcacccgccgctttgaggtagcgggtcccgacaggcgatggacccctcgggctcccgggggcgccccacgtgggtgctggccgggggtctcctggcagtggccctggcgctggggggccgaggctgtctcggcgccagctcacgtccccgctggcgccccctcggcgcgcagccaccccgggatccccaggtggctcctaggtctgggcccggcctgaggatccctccggggcggagcggggcggggcccgagagcagcacgcaggtaaggagggcccgaccccaggctccgg

SEQ ID NO: 5613 - DNA, 417 bp, Homo sapiens
  source 1..417: mol_type = unassigned DNA
cgccgccacctccctcctggagcagaaggggaacccgacgcctaagcggttgcgtgcgaagttcccaaccaggctcaaggagtcgcagagccggggctccgggcccgcaggacccagaagccacgcgccccgcgctccccgccccgccgctgtctgctcggccgacccacctggtgtcgcgtgcgctggcggcccgcgcggcagccaagccaaaggccgaggccgaggccgagcgcggcgcccagcagcacggcgggggccagcagggcgggcgccggccgcagcgcgtcccgccccagcagcagccgcgcgtcgctcttgcaggccgccccgccgcgggccatccggggcgctcaggctgccgccccgccgcatcccgccgcctgctgcaccgtccccgccagggcggcgacgcgg

SEQ ID NO: 5614 - DNA, 1748 bp, Homo sapiens
  source 1..1748: mol_type = unassigned DNA
cgcgggtcggggagctgcacctcttgcaggctcggctctcggccccgccccctagcgtcggagcccgggagccgcggctgcagcctatctctttaaatgacagctgaggctcgggtcccagtccggggcttgacgtcagtgcctcctcccgtgctgccaggagtagttagcgccaccgtcggcgctccggcctcgcggcacgcttgcaagctgccggggcggcgagttttctttgcttcggcccctcctcccgccctccccacggagagccgagcagcagccctagagcctctcgcaagtctctctcacacttccccgccctcgccccaaaggagcagcagctccttcttgcctctccattgccgccgccgcaccggcggagctcctctctcgcgcgtctctcctccgatggagctcgggcgccgccgacgccgccgctgccccgaaccctgagcggggccgccccggtcggaggaacgcgccgcccagtccgagggcgcagagcgccaggagcacgcggagggctggggcgcgggctccgggaacgagaaagtgcagctctctcgggtcactgggccggcggcggggggactatggctctgaaggacacgggcagcggcggcagcaccatcctgcccattagcgagatggtttcctcgtccagctcgcccggcgcgtcggccgccgccgccccggggccctgcgcaccctcgcccttccctgaagtagtggagctgaacgtaggcggccaggtttatgtgaccaagcactcgacgctgctcagcgtcccggacagtactttggccagcatgttctcgccctctagtccccgtggcggcgcccggcgccggggcgagctgcccagggacagccgggcgcgcttcttcatcgaccgggacggcttccttttcaggtacgtgctggattatctgcgggacaagcaactcgcgctgccggagcacttccccgagaaggagcggctgctgcgcgaggccgagtatttccagctcaccgacttggtcaagctgctgtcgcccaaggtcaccaagcagaactctctcaacgacgagggctgccagagcgacctggaggacaacgtctcgcagggtagcagcgacgcgctgctgctgcgcggggcggcggccgccgtgccctcgggcccgggagcgcacggtggtggcggcggcggcggcgcgcaggacaagcgctcgggcttcctcacgctgggctaccggggctcctacaccaccgtgcgcgacaaccaggccgacgccaaattccggcgtgtggcgcgcatcatggtgtgcgggcgcatcgcgctggccaaggaggtcttcggggacacgctcaacgagagccgcgaccccgaccggcagccggagaagtacacgtcccgcttctacctcaagttcacctacttggagcaggcctttgatcgcctgtccgaggccggcttccacatggtggcgtgtaactcctcgggcaccgccgccttcgtcaaccagtaccgcgacgacaagatctggagcagctacaccgagtacattttcttccgtaagttcgcagccccggcgtttcccagcacccctcgccccctgctgagccgccgccagtttgagccccgctggaggccccgcgggggtgtccggggcaggcgctggttaactccttatagagagcggctctccctgcacgattcccttatgcagtagacacgatttacatttcaccgattcggatatttccgt

SEQ ID NO: 5615 - DNA, 1748 bp, Homo sapiens; identical to SEQ ID NO: 5614
  source 1..1748: mol_type = unassigned DNA

SEQ ID NO: 5616 - DNA, 648 bp, Homo sapiens
  source 1..648: mol_type = unassigned DNA
cggctgtgtcgggagtaaaggttcgggctagtgtgcgtgcgggcgcgggtgaccccacctttagggaagccggcgcccaactatccaggcagtagccccggctgaccccctccctcctccttccctcctctcttccctccctccctgcgtgtctcctctgcaccggcccccgccgcggagccaggcggcagcaccgacgccgccgcagctcctgcccgcatcgcgctaacccgcgcccccggctcacacgtagccggagcgactgagccggcagccccgggcccacgctgcgcaccgtgtgcacggcggggctggctgagctgacctgcgctgggctccggcgccgcaggcggctggggagggcggcgtgggagaggacgctgagacgcaggggcggccgcgccgaggtgacaagctgcgcacctggaaagttacccggctgtctggtgaggttcgtgggccgggggtcttgggcgccggggtgtgagggcgcgcggggagggacggggtcggggtgcgcgcgtgtgcatgctgtgaatgcgttgcgcgatgtgcgcctctattccacacccagccggtctcttgcttgtgctgttcgagtgtggacgtgtgtacgcgttgcattcgctcggtgtggcagcgtttcgt

SEQ ID NO: 5617 - DNA, 863 bp, Homo sapiens
  source 1..863: mol_type = unassigned DNA
cgacccctaacgttgtaacctgtgaccgtgattaaatttcagcgatgcgagggcaaagcgctctcggcggtgcggtgtgagccacctcccggcgctgcctgtctcctccagcagctccccaagggataggctctgcccttggtggtcgaccctcaggccctcggctctcccagggcgactctgacgaggggtagggggtggtccccgggaggacccagaggaaaggcggggacaagaagggaggggaaggggaaagaggaagaggcatcatccctagcccaaccgctcccgatctccacaagagtgctcgtgaccctaaacttaacgtgaggcgcaaaagcgcccccactttcccgccttgcgcggccaggcaggcggctggagttgatggctcaccccgcgccccctgccccatccccatccgagatagggacgaggagcacgctgcagggaaagcagcgagcgccgggagaggggcgggcagaagcgctgacaaatcagcggtgggggcggagagccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgc

SEQ ID NO: 5618 - DNA, 1288 bp, Homo sapiens
  source 1..1288: mol_type = unassigned DNA
cgcctcttgcgcagccgaccccgcttcggccccggcccaggccagagaggtggccctcggagatgctgaagttactccgcgcagggggaggggtcgccaggctcctctccaatcacggtggccgctccagctatttgcatacattatgctaataacagacctcctgccccgctcccacccaagcttcccgcctcccttgggggttccccgggccggcccgcgggctgggccaaggtgaatacattatgataataaggcgggctcctgctttgccttcggaaggggggcgcgcagcagcgggagcggcaggccggacgccgggcgccgggagggggtcgggggagggacgtcgtgctcggagcgcgcgcgcactcacacactcacacacacactcacgcgagcatcgcgaagggtatttaaggatcgcgcacgcggggctgcggagatccttcgggcagccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggtccgtatccgctcgtgggcttgactccaccaactagttgtgcagccacagggactgaactttggaggaatcgacctttttctttccttttaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgc

SEQ ID NO: 5619 - DNA, 1275 bp, Homo sapiens
  source 1..1275: mol_type = unassigned DNA
cgcttactccgctctgcctgctcgctcccactgtccccaagcccgccccgcccgcggcaagtgcgtgcccaggcgcagccaccggcgagatcaggagcgcagcgcccgcagcctgagggaaccggcgcagggcagcagcggctgcagctggattcgcgcgccccagcgctcagtggcggcggccgggacaccctgggcagcaccccgcaccgcagcaccccagactacgagcaatcgtgcccgtccccgccggggctggagggcgcagggccgccaccctgcaagttcgtgggcccccggccacccttatgagagaaggcgaagccgggcgaaggagcaggacgctcggcagcaggactcctccgcaagccccgcgggccctctgttcccgcgccccccgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgagtggcccagcgggcgcgggggaggggagccggcggggacggaggtgcctagagggatccagcgcctgcctccaggctccttctgggaagtccgtgcggcgcggaagacgtgtctgggttccctggaccgattaagttttgctccgcgt

SEQ ID NO: 5620 - DNA, 1071 bp, Homo sapiens
  source 1..1071: mol_type = unassigned DNA
cggcgctgagtcctgcccagcgcgacccggaccgacggacgcgcagagaccctgccgggacccgccctccagccggcgcccggggagccgccggccggctctacctcccgcccgggagccgggcagggcgagaaggcagcgcgagtggcggtggcgacccccgccggggttcctgcgacgagcggtgaccagcagcgcccgcagccgcggtcccgctctccactcggacgtggccaagcggcggcggccacgacgtccggcttcccgggatcgtccggctgcgccctgggcgcatctgcgcgcctggccccgcgccccgcggagagggcgatgggtcccggtcaggactgagccccccttcccctctccccagtcccgcctggcaccccctcctctgccccgagggcgagccacggtctgcgccgccgccttcccctccggtgcccccggctcgccgtcctcccgcgccctccctccccggacccgttcccggggccaccatggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaaggtctgtgggggtcatggtcgggagatgcgccccgggtcgccccctccccgcctaaacggagcttctccaggctccttccctccctcggttttcccggcccaccccggccccggcctcccttctgagcactctgggtgccgtcgcggggaccctggagtccgctgtcgggcaacctgtagccgccgagaagtgcagccgccagagatggcaagttggctgctcctcgccggcggctcctgccctccgcgtccctgcaggctgggctctgggaaacctgttccccctgagtctcggcttcccgggaggatagggactggcactggctctggaacgcggggcaccccttcctgccacacccggggtcgagccaccgctcgc

SEQ ID NO: 5621 - DNA, 694 bp, Homo sapiens
  source 1..694: mol_type = unassigned DNA
cgccagggttgtcggacagctcgatgaccaggagctcccggccctcgaagctgcgccccaccgtgtaaatcctgctgatggcggtgcactgcagccacacggacacgagcgcctcgcgcagctcggggtagcggtggtactcgaaggagatgccgtcctcttgctgcagccgccggcgccgcctcatgcccgccgcgggcgccccgggctcctgggcttcggcgcccaggagccacccgcaggcagccagtgccccgcacagagccagcagcgcgctgccccctcgcccggccatcgctgcgctccgccgccgccggccgtgccttcctacgcgggcggcctcttttgtctgcccggccctgggcttagcccgccggcgctgctgggggcggcaagttccgcaccagcctctactcgcctcaccttccccggctgaatgagtgtcagcccgcgcactggggccacccagaggagacgggcaaagccgcggctccacgggctgcactactggccgcggagcccaggggagctgcaggagaaaccactgcgaggagggggccggcggagagacgggccggcgtggatctgggagggctgctggcgttatttgctggctcggaaccacgtcaacagccaaatggcgtccgggacgacgcaggtgaaatgacagctaaggtccggggttcgggaacgt

SEQ ID NO: 5622 - DNA, 694 bp, Homo sapiens; identical to SEQ ID NO: 5621
  source 1..694: mol_type = unassigned DNA

SEQ ID NO: 5623 - DNA, 1424 bp, Homo sapiens
  source 1..1424: mol_type = unassigned DNA
cgagagctcgaggcgccgcccctgccgccccgggattggcgtgaggagcctctgacgacatatattaacccgagcggccctaaagatgtagctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgccaggaccagctcgccgcgccccatggggagccggcggccgcagcgctgctgaggcgggcccggctggccaggcggggggacggggcccgggctgcagcagccccctctgcggctgccgggcgggcccgggcgcccgggggctggggggtggggggtgggggaggacgccgagcgctgaggcaggggcccgggccgagggcgcggcggggctgcgcgcacgctggggcgcgtggaggggcgcggagggcgaaatgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccga

SEQ ID NO: 5624 - DNA, 1215 bp, Homo sapiens
  source 1..1215: mol_type = unassigned DNA
cgtgcgggagggaggacaagaactcgggagtggccgaggataaagcgggggctccctccaccccacggtgcccagtttctccccgctgcacgtggtccagggtggtcgcatcacctctaaagccggtcccgccaaccgccagccccgggactgaacttgcccctccggccgcccgctccccgcaggggacaggggcggggagggagagatccagaggggggccgggggaggtggggccgccggggaggaggcgagggaaacggggagctccagggagacggcttccgagggagagtgagaggggagggcagcccgggctcggcacgctccctccctcggccgctttctctcacataagcgcaggcagagggcgcgtcagtcatgccctgcccctgcgcccgccgccgccgccgccgccgctcagcccggcgcgctctggaggatcctgcgccgcggcgctcccgggccccgccgccgccagccgccccgccgccctcctcccgcccccggcaccgccgccagcgcccccgccgcagcgcccgcggcccggctcctctcacttcggggaaggggagggaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggtaggtctgcgttagggtttgcggagaacccgagagtttgcgttagggtctgcggcggacccgagaacctgcgcgg

SEQ ID NO: 5625 - DNA, 1184 bp, Homo sapiens
  source 1..1184: mol_type = unassigned DNA
cgaatgttgcctccgcaccgattcaaacccgcgccgagcctcctcccattccgacaccacaagggagaagagcggagccgccgccgccgccgccgccaccaccgccaccgccaccgccgcggtccccggagcgagcgagcgaccctgccgcgcggggagcctcaccgggagccgcgctccgccagcccgccccaggccgccgccgccgccgccgctcacccaccttgccgcggcgcgccctcgctgtggccgtgaggaaccgagcccagcgctgccaagttgcctgggtctggagcgtatcgtgttacagcgcctggctccgggctcgggctgcgcgcggcggccagacatgataggctgaggctcctctgtttacacccggccgccgagggggcggtgcgccgcttaaccccttcgcgccgggccgccaccgccgcctcccgccagccccgcgcccagcgccccggctcggccgccgcctcaccccctcgcctcaccccctcgccccgctccacacacgcgggccggggcctgtgagcagccgtgcccccagcgaagacgggggaactgcactgagaacccgctcccggcaccctccgaagaccccgcggggcggcatcctcccctccacacacgcacgctcgcgagccgccccgggcagcggccgtgttcctcggcggggcttcgccggcggcttttgatcccgcctcagagctgttctccggcagcgctactttcccgtgctcacaaaagcatctctctcccaacccatgaacggatcccgacccctgctctgccaccattcatgcgtcccgcatccgaggtgtcgccttcacccacacgccccacggccccgcgaaactcggccctccagctcgcgggacgcgctgcctgccaggcgggcccggcggtacctcgggggcgggaggggtcggtcgcagggcccccagcctggcgcccgcggggcgtccgcagcgaaggggtgggtgtcgctcgtgaacgcagcagggaccagctcagcccgcgctcgcccctgggcctcggccaccgcctctccgccactttctcggcccctgcgtggaccggcccgtggcgggggctgctctgcgccctcgtccccgcagcagtcgcggacccccattaacgttgacgagtcagtgtcgcgacccggggagagaagacgg

SEQ ID NO: 5626 - DNA, 5820 bp, Homo sapiens
  source 1..5820: mol_type = unassigned DNA
cggagggaaaccgggccgacgacaagggtggctatttccgggctcttcgcgcccggcccaagcgtccctgggtggggcagcccaaacggggagaggggccccgtgggccgagggcccgaggccgcagcgagcttagcgtttggccaaatctggctcgcgcgccttcccactgtcctgttagggctgtgtgacctcccggagccctacgtccccgcccaaacagctcccagcgcccctgctggcacccggggcgccctcaccccagctcctgcacccggcgcgccgcgcgcagaccggacggaggggaaagttggcaagagcgcggcgcccgcgggagaaagcgttaatgggcggccgggtgggagcagcgcgctcgctcgcccacgtcacgccggtgcgggctcggctgacgaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcaggtaggtgaggtcccccgctcccgcccccgccccggggttccgagacccctccccccttccgaggaggcggaggctccgcgcggccgccgaggggagcgggcggcggcggctgcggcgactccccggtgcgtcccgggctgcgagctgctccccgcggccccggcagccacacggcgcgggcgggagcttccccagctcaggtagggagtgggctccgccgcacaaactttgcgaggattgctcttgcgcttaaggggacaaagtttgctacccgtcgctaggctctccagaggccgctgcgtttgctgcaagttgcgggaagcagggtgcgcgggccggcgcggggcggggggtggggggctcggagtggccaggcctgagtcctggacgcccggacggcgctccgtccagcctcaggccgtacccagggagcaagcggcgggggcgcagcgggagagaggagggagagggccgcgggcccccatggagggcggttgggaatccagagattcaccgcttgtccctgtggctccttctcctaccactggctccgagggggcctcggggctgtgaggaaatgacctgccaacctcgaggttcgccagtgcggcgtcagcgaccgtgaggcctctcaaacccacaccccagccgggtgtcccgagcggtgggcgggcacaggcgcccccaaggtctctggccccaggtctcagaaagaaaggcccttgcctggtgccccgggctcccggcttcgcctttggctggagttaacttctctgggctggaaggagctccctccggacgagctcttggtgcggggaactggtggcccccagggtaactcctgaagcaccagggctaggctggccgaagaagggtcagggcccggcctgtctccccggaggccttccatggttccgacggccaacggtaaccccgtcaaaataggcgacccgcctgcgcttcgcgttaggggctgaccatcccctgcctcccctgcggcctgctccggccctggtcctccgctcttcggagcgctccaggccagcgggagcacctcatctccccgaagctgagccggtgctgtgtactccgggagccggctgacttctggcccacctgctcacgggtgtatttagtaccgggggtccctagagggaggaaggctcagcactccgagtctatgcagacgcgttcagctgatacctgagatgctgagcgtcctatcgttggtgaaagggacactgggtgcctccgctccaggcttggccttttggtgaaggcacttggaaaatattccagtattatctatgggagaagggtggcccagtgagaatccccggtttgggcaggcgggcctaggccaggctacagggtttcagtgagatgtcccggtggtcgccaatccacaggctggattgaccctgtgtcctggaatgagtagtggggcctgggtgaggccgggcgggtcaggaggcctcctgggcagttgcgagcttcccgaggcagggtgactgtgactgggcccggaccccaggcgctggggcctgctggcgggcaggaagtggagcgtgtgtgtgcggcggcctgggaaagccgattcagaggccaggtttctgggtcacggagaaagggtcgcccgctggtggggactggagcgtcgatttatgcacacaggctggaaaggcaaaagagaacaggagaaggtggcggtggtggtcaaaggaagcccccgaaagggcccccacgtactggctgccctgggaagtggaggctgcttctcccagactctgctcagaagatgaatggccgcctgttctggggcttcggctccagttaagccccgccgggtctggaaggaaggaaatgcaccagcctcaggtctgggtgggctgagctgttgcactagagcccagaggtgcagggcataggtggctgggcccctgggccctggctctccccctcagccggcggagtgctcacagtcgccgaggccaggtccccgagtataggtgaggaaaggacaagccacagctgaatgcctcccctctgggggtctctactccccatcccagcccttggcccggctgggctcacacccctccttcagccgggcctcattacctggagagagcgagtagtttgtaaacaataaataatgggaagtagaaggatgctcgggaaaaaccagaaaactgcaaggagtggggaggagggagggtgggagaggggaggaaggagggtgggggaggggaggagcaggaggagagggaaaggggttgagagattcatttctagcgagaaaccccggtggctagtttcttattatttacaggaaggtgatattagcgattcaggtgagaaagaaagaaacgcggcctgccgcgaaatcaatacagaattcagaaacaattattaatgtcatttgactcgtgttctttatatatttctcgcggctaccgacgctaaactgtctgaataatttgcatggagcggctattcattatttccgatggtttccctctgcaagcagctcggacgtggcccgctccggtccaacgcgatcggagaactcgtattttcatctgtaaattaaagcaattacgcagcagatattatatgatgtgtactgtggtctccagatagtcatcaatcaccttcaaccgagctgtcaaaagagcaggcagatttcgtttctgggaggcaggcttgcagctggggagagggcgaggacgtcatcattaattagagggtgaccctggggcgattcacaggtctgaacccaggaatctttctgagcaagtctgcacaacgctgccttgcacggcttccttcccaacttaccacgggaggccggcccagggggcgagggcaaccggggcgagtcccggtcccggagggcgatggcgcagaaggcggggaacgggttcgggatggcccgggcgcccccttgccgcccccttgccgcctgctcactggcctccgctttgaacttgggcaaggtcccagggagggtactggccgagggagtcctggggtgggcgctcggtcccctcttccgattgctccgtgcgccccagacagaaagctgggcaaaatggacaggggagggcgcctccgccaggcacccaacgccccctccctcgcagccagccctgcggggcgccgggagggacgagcttagcgggaggggccggggcctgggttgaggaacctgctcttccgagcgcgcagggccgcccggcagtccccggcttagccgcgaggggcagggggaagccggcggagcacggccggcggaaaggggatcggggaggaaagtcggggaggcgaggtgggggcggtgggctgagcgggaacttaaaagaccgcggtggagaagatggggcgttctccgcgacactcggctgcccagaggtgcaaagccggtgggcgcacgcccggggcggccctacagccctcgggccgccagtctcagggtgtcgggctccaactaaggccccgaagcccccacgcacctgagggcattttgaccagctcttgcgggctgtcttgcggccgcagtgggttctgaaagtccattccggcgtagggtggaaaccggcgggaggcgttgctgattctcgattaaacaatagtgacgagacgcgtgcggggcgcctgcgagccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccggctctcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccaggtaagcggagccccgccccgcccaggccaccgcaggtgccggtagggcggatggggcggggacggggggtggggagtgtccgacctacgactgcctgcggcttccgagctagcaaggcctgggtcgcgcgcccctcacgcccaacccctgctccccaaacccccggggaaaggccgaggcgctaagaaaatccgacgggccgggcccgggttccctgatgtttgaaccacaaggctcaggctgtgccccaggggagtcctaggaccccaaggaacccctggggaaggaggcttggcgcgcaaatggcgtcagaggccttggaaaccctccggggaagggtgtaggtgctcggctgggccccacgtggcggaggaggccagacgcgcacaagctagtggaaaggggcgagcatcctggtgtggacggcgggaggcccgggggtactcggggcacgccctcgtgggcggcgcgcgggattggcaaggcccagggccccagcctccagcccggcttcccgccagtcctcgcggcctctctctgcagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgc

SEQ ID NO: 5627 - DNA, 1233 bp, Homo sapiens
  source 1..1233: mol_type = unassigned DNA
cgccggctgcgcagcccagcacaggccacaggccggggggtgggcccgggccctgcggagtgggcgggtctgagcgggttggaacgtcccgccggcttcaccgcaggccggcatctcagcctcaggccccacagcgggtctcccgtctccaccctcgcgggctctgcagggctggggctgctcctgagtttctggtaaggccttcgggagtcccagctctgcggagaccaaagcccccacatcctcggcagagcccgggcgagtgccccgcgggtggcggcggctgtggggccgtctgggattctccgcagcactgaccctgcaacctcctgtgtctgcgcttcgtggtgaggggcggcgggatgcgcgcgatccctttttgactcagccaaacggaaaagctcgcgcgtcccggctggaaggtggaggtcaggcaggacccggcaaaggcacattccaaacgaagcagaccccattcctcacctgcagagggaaggcggtgtggacggacagaaacggccctcacagccacagaaccaccgcggccacagcagcgcggcgtccggcagggagcggaccgtggtggaggcctctgagccgagcaggccacgcagacccgggaggcgctgaagcgggcgcagctgcgccctggagcaggcagaccaggccacggcggagggagaggcccggggacgcggcgcagcccctgcggagaggcacgggggcggcggggacgccctcccactggctgaaatgccagggaccggcctgggcgtggagcagccggggcgagcccgcctccaggcaccgccggctgccctaggcagggcctgcaggagtggcccggagccgggcaccgaggcaccgaggcggggacctggaggggtaggggtcggggcagggcctgccaatcaagtctacgggggtcgccgggtggtggaggtgggatgggggaaggaggctgagcaccagcctcgggcgatccaagattcctccggcctaatcccaggagggaggcagcgttggcgggtgaagccgtcaccctcccccgggaggccgcccagcagctgcccctccacgctccggggccactgcgccgggccttggtcaccacctgggccctggcccacgctcagacgaggggcagcgcgacttccccgtagccccaccccagcggctgtcgccgcagagcatgaagaggcctggctcctgcagaaacgcagcccagcgcga

SEQ ID NO: 5628 - DNA, 2865 bp, Homo sapiens
  source 1..2865: mol_type = unassigned DNA
cgcctcctgccctacccgggtggatgcccgcggctctggggctctccctatgccctgactctggggagccccggctggcattggctcgcgaaggtgacctgcggacagaccagtcagagatcacgttggctggtcgcggcgcgggccacaaagctcagcggaggtggggtaggggaccaagctgtcccggcgagggaagaaactgttgcttccaaatcattgcggctggaggagccgatctgcgccccagcgtgttaggacaagggcggcgcgaggggcccaggggccaaatggggcgctgggcaggaggggctgtctcctgcaggggaggaggaatggtcccctgccagggacctggggaaaggtaatagtcaggaggggaccgggccgcaagaagcccatcctggattgcagcacgggcagccagcgcgaattcagtcaggaggtccacggggaccggtaaacgagaaggggatgcggtgaggacgccggactggcgtttctgccgcgctgacacctcgactgctccctccccgcaccgcgtcccccagcctgagacggggaagccacccagggcaccgcgctcccaaacagcggggaaaaggcgctctgggcggcggctgagtgaccgagggaccggtccggagccaggagctgggaggcgcggggatgtggtggggaggaggggagtgggggcagtgagggggctcaaatcctgcggggacgcccgcttaccctgccgttgcggtcagtctcctgcgcctcctcgacgctcaccccgcgccgcaccagcgtccgcagcagccccacgttgttggcgcaggcggcgcgcaggagggtcgccgtctccgggacgctttccgggacgccctccgggacgctctccgcgctctcgacgccgtgctcctcctcgtcctcgaaagggtagaaagagtcgtccgaggcgatgctgcgggtgtctggcagactcgagaagtcctcaaactcttcgtagtcagcggggtcctcctcgacctgcgcgccccggggtggggacggcggtggtggggtcatgcagcgcgccccgccgccctccggcccggtcccggccagcagcaccatgccggcggccggggcgcgggccgggggccggggcgcgggcaggaagagcgggacgcggggcgcgcgccgaggtccccgcttctcgcttctgcgtccccagagaagccgtggcccgcgcgctccagctcggcggaaaccggcaccaggcggctgcgctcaaagaaaaaagtctccggaggctgagcgagcccctggggtgggcgggaccgcgggggctttccgaggcggggcggggcggggcgcggggacacgccttcccccggggccttcccctcgcgccccttcctggccagagttcagagccaggcaggcgctctctcgagcgcggggactgggcacctggcagcgttgccccagagctggggacagctggcgcgggagaagcagaagcaatcactaaagaagccgaacccgagtcgcgggcggcaagcggccccgcccctccctccgccggcccgcgggatgggggcggaggtggcggcggggggacgccggggcggagccggcctccagcttcgggaacctcggacccctggagccggcctccgccgagggcgtcgggcccccggacctgggtggggccggtttctcccgccgcttcagaggagcagagcgggttttctcccttcgggggatcccgggcttcggggctgactccacccggccgcggccgcttggaggccggggaatccccggggcgcttggcgggcagaggagccgggcgcgggagcggagccgtccacctgggacctgtgcccggggagcgctgcgggccgggccactctgaactgggggcggtcggctgctgtgggggagtcccagcccggaagggaggacaatcctcagagtcccccgtctcgcggaaccggggccggccgtggcttgagggttggtcagatcctgggatggggggcggggtgttccggaacctcagggagcatctgagtgggaacggacgacgaggaactccccgtccccatgcctggcctgtgtcacgtgcggggatctgcggactcacccccggaggctgcgactgggcgctgaccccacgtctggctgcccaaaagagcagggccgcgggcgacagccgcagtccaggcccacagcccctctggcccggccttgccctctccccgtcagtcctggcgccggggatgggcggggaggaggagggcgtgtgaggatttgccacagggagcccttgacttcggggtaggaggcgtcgtgagccaatcttgggggaaggtctctgcgcaaaggcgcggaggtgcgctcgcgcccgtcgcaggtcaaagactgcggaggccaccagccctgtgtccccctagcctccttccttcctttttttcccccgatcttgacagcgtgtccaccagctgccagccggtgggaggccctcgcggccccaaggtgaacacagctaggctggcgcagccgctggggaccaggcttgaggcccacgtgccgctgggcaagctgaggggcacgagggcaccgaatccgaaacagccgtgggaggtgtaggatgaggacacgtttaaactgcgaagccgctcgagccctcgtgtcacaccgcactggcccgacccgctgtcctggtcgcctggtcttccagtgtctccagcaggagccaaagggcctgctggcggcccccgacccggcatctgcagggccccggagggtggggcgcgcgggagcaccgatttctggtgaagacgccctcgcacctgggcggctctgagcgagcagcgaactgagactcgc

SEQ ID NO: 5629 - DNA, 1154 bp, Homo sapiens
  source 1..1154: mol_type = unassigned DNA
cgtgcgttcccaaggatgctcggccctctcccaacccgcggcctcctcccctctctcccgcggctgccgctgctgccgcgaaaaccaggagaagtggaacgcgcgcggcgaagcgccgctctcgcggcggcactgggcatgctccgcacccggggccggtttcggcggcggggcggacgctccctcactagccgggcgcccgggccggccgccgaggtttaggtggaggctgaggctgccgcgcgccgcgggaggagcctcgccctcggcggctgaggcggcggcggcacaggtggcgcgggccgcgcgcggggcgcagctcgggagcgctcggcgccgggcgccgcggcggccccaggctcgcgcccgcggcgacagccggctgagcggagctgcgggcgcggcggctgctctctcagcccggccggctggcggcggcgcccggagccccgaggagcccgcaggagcccgtggagcccgcggagccgggcagggggcgctgcgctcgccgagctcggaggggccgccgggccgggcgctgcgcactcgcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggtgagttgcggggctgggcggccggggccgggcgcagcctcctcccggcgccgtcctcctcctcttgccgctggtgggggtggtcctgggctcccggccggcaggcggcggcggcggctgctgcggggtttctgcctgcctcggggaggaccgcgatcgcgccaggtccccctcggaagccgctgtgcctggaagggggtccggggttagtgcctttcttggagcggttaccaagtggctgccctgcgtgctccccctccctgccacccatctccccgggaggaagcgtatttagggcaacaccgacaatgctgctccccgccaccctgagaacatactcggtgcattcatgacgtccctaatatacgggaggagacgg

SEQ ID NO: 5630 - DNA, 1154 bp, Homo sapiens; identical to SEQ ID NO: 5629
  source 1..1154: mol_type = unassigned DNA

SEQ ID NO: 5631 - DNA, 396 bp, Homo sapiens
  source 1..396: mol_type = unassigned DNA
cggcggtctttcgccctccccccactctccccgcccccacccccatcccttggccgctcgaacccccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaatagcgcagagaggtttccatccggcatccagttcgatgtgggccgtttttcccttcccagcgg

SEQ ID NO: 5632 - DNA, 438 bp, Homo sapiens
  source 1..438: mol_type = unassigned DNA
cgaggagcaggggctgcgggccgggcttttgttgctcgcggtccccgggggccgcgccgcgccgggccacgtgggggctctcgccttccgagcgggcgtcggtgggaaacctgcgcggcgagagacagggggatggggcgcttttgacgcgactgtggggtgcgggtagtcctggaggaggatgtccggccaagctcaccctgcccaggtgccggatccccagcccaggctgcggcctgctctgggctcgtgaggcgaggccgcagcgccccgacgccgggtgggcgtgtgggtggagtggagacttgggtccctcggcgcatgggagtcccgccgcctgcggtagggaaccgcctcccacccctggcccggcccgggccgggagccgtgtcccgcgttgactcggtgtaactctccagctcatttctctccacgcga

SEQ ID NO: 5633 - DNA, 438 bp, Homo sapiens; identical to SEQ ID NO: 5632
  source 1..438: mol_type = unassigned DNA

SEQ ID NO: 5634 - DNA, 411 bp, Homo sapiens
  source 1..411: mol_type = unassigned DNA
cgcgctccggctctcggggagccgccttccagacctgtctacccgggagccccctccccgcgcacttcccagacttctcctgagacccgagagcgctggttttcccccactcgcgatagtcctgggatgacagtgcgggccccctcactcgcagctcccaccacctggcggccaggggttcgcggcccgggcgggcggcgccagtgccctctggagctgggcggggagggcggggcgggcggagcgggcatggtggggtgtcgggggccgcaggcgtagcgctctcgccctggccatggagcggccggcgcccggcgaggtggtcatgagccaagccatccagccggcgcacgccactgcgcgcggcgagctgagcgcggggcagctgctcaagtggatcgacaccaccgc

SEQ ID NO: 5635 - DNA, 1137 bp, Homo sapiens
  source 1..1137: mol_type = unassigned DNA
cgcgcctgccaggctcagactcacacgcacgccgcctctgtttgtacacagtgcgctcccggcggcccgctcgctcccctccagctcacgcttcattgttctccaagtcagaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtaaggcgtcgggacccggacagctgggtgagggatgggctgggagtcccctgagaaacgccgcgcagggggccggaggcggtccctccggcgtgccaagggtggcgagcgccgctggcggcgcggaggaggcgtcgagtcctgggtgccccgagaaagtgcttgtaaagtctgagcagagtgcgcggggccgagcggggagaagggtgcggggtaccggggtgagatacaggaaagaggaggacggtggggagcggtagaagacagcgtccccaggaccagcgactctgtggctcactcggccactgggtctcggcgcaaaccctccctaggcagtgcgggcgatgctgactgcagacgtcgggcagggctttcgtgcgggcgggagcgggggaagccagtgcgcccgggcgtcagctagttgatgcgggaagaggctggggagctgcagggccgtccgcccccgggtgcggtgctctggcgcagggcctgggctgagccgttcgcaaacccagacccggcgctgggcgttttggccgcgg

SEQ ID NO: 5636 - DNA, 2383 bp, Homo sapiens
  source 1..2383: mol_type = unassigned DNA
cggactccccaggaccgcggcgccggctggctgcctcggccccccgcggccgcgtgagctccctcttggtggtggagggcgcatttcaatctggaaactcccagcccctaatttggtcccgcagactgacgccgctcccggtggggcggtgggggtaggagggcaaaggggaggtctcctccttcttggattgaggctgcaaccaacagccccgtgagcctctattcctggctgactgcgaatccccccatcccaggtcaggggccgggaccctacagaaagacccgttctcatcctcaaccttgcggcctctgtccggcggggaagttcagctgcgggtcagttcagctgcgggtccggccaagcctggcgcgcttaggcaccctagtccctggtccgcggccgggcgaggacggagggggaggggaaggggctgctgcctcctttcccaaatccggtccctaatcgccccatcccccgccgtctactcgctttgtacaggcagtcaaaacagagctagcggccaattgacggggacgggaagcaaagccgcctagcgcctcgccccctccagccggccccccgggcccctcctctcggcgcccggaccttggccctccctctcctttcccacttctctctttgccctaacttcgcccccatcccccgctcatttcctctcgcacccgggctcgccaatccctctttccaagtccctcttccagcccggccttcctctcgggttcgccccccttctccccaatctccgtcctcttccctcccttcgccctcccccccttccttcctcttcccctcacccaaccctggttcccctcgttcctcagtcccgatctctcccttactctgtccccgcccactctgcgccggcctctcagtccgggttgagccccacgtgtggacggccgcgcccccactgacagccgccgcccgccggcccgccccgcgccccgccgggcctctaaaacccccgcgccgcgccctccaccgccgcatcttctccagcgcccagcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggtaagtgggcaagcggctccgcacctagggctccggcttgggggaggggggaatcctcagtttggcggctttctggcccactccgtcccagaccctttagctggagcctagagctgcagccccctttgccagaatatccaaagacccccaggagcgcgtcccccttttccttcccaaccccgcagctcagcgggcggaaagccctctctccgggggttgggcggcgggtggttagggggtccaggggtgccgatcgcagagcgtgtgcagagctcgcgctgcgggaacaggttctgaatgtccggcggcaggcgggcctgggtccgcctgctgcaggggccagagaagcctgcttgctccccacgtcggggccgccgctcgtgagccttttgtttgaggacgtgtgcagggttcacagctcaccttctcatcgtcaacccgagcgctccaccttgcgacgcgctttccttgacacgtcgg

SEQ ID NO: 5637 - DNA, 2367 bp, Homo sapiens
  source 1..2367: mol_type = unassigned DNA
cgggccggcttcccgcttcggaggttggggagggggtcgtgggtctctgcgttcccaggccaagcggccctggaggcacggactagcaggacgccgaggtggcgcgggtcgcggcctctcccgcagcagctgtcggcgagaaccaggcagggaggcgccgctgctgactgcatctcatgaaagattcaggcccggctgccgcgctgccatctcccggcaccttgcgccggaaacggtcgctctggagcccgtggccgtcggcgggcaggcttagccgctccagtccctgagaaaggcaggccacagcccgacctgccctgtggtcccatcccataatcccaacagcaagcaggctcaggctgggcacttcggggtaccaggagtaggttcggccaactggtttccaccatgaggcttcgcgcacagggttatctggccacgaggcaacgctggggagccctgtggcctgagggtgggcaaaggacaggctcccagttcccttgcgtccagcccgtctcccagcggcagccagccaggaacggcctgcggggccacaggggtggaggcgtcaccgttcgcaggcccgcagcaggatggtcgctgggggatgtgcaggcataggggttggacaaggggccccagaagtgtctgtcctgaggggttggtgtgccctttcctcaccagcccagcccctgaggagagggaagaaggcaattcccccaaccagggcaggtcgggcggttgccccaccctaacaccccctacccccaaacacagaaaacctggggtctgtcctcaaacctccctggctgccacgctctgggcagcggactctccctgccaacacgcaagaccagctccctcccgcaggctgagcagaaagaagaaaggtccaatctcaaaaccccaaactcgaccaccagcccccgtctaaacggaagtagggccagcccctcacgagtcaggtgggaaactgggcccagggagagaaagtgccccagggccaggctgggacccgctctggcttcgtccgcatgcggcagggcccctccacggaggtcccagggcgcgctccccggcctcgaggcccggccgccagccgcgcggaccccagcctacgccccgagggaggccaggacccctagccggcgggactgcgcgccgcccctctccccgcaggtcccggcgaacacctagcttcccctccccccacccttcccgcctcccggccagtgtccccgccttccccgcgggcgacgggcggcggcggcgggaggagcgggccgagccgaggaagccccggcctcgcgcgctgggatgtagcgaaccagcaggggccgaagaaccgtgcagtgccagagccagagctggatccggggccccagccggagccgaaacctgagccagagtccgcggcgggcgagcccggagcccacgagccgcagacgcagcgctgcccaggtggggtaagagacgctgggctaggggcgcagggtctccgcggtggaggggcgcagggaggtggcggccgagtcctgcgcagtttgctcctggcgtgtgtgggtccacccggcggcgcgggacagcgcaaggcgcggaaggtcaggagccttcgaggcagcgcgaggagctcgttcctgcgcccagggcacagtcatagccgccgtcaccgggtgctacctcacccaaccggcgggatcaaccctctgctttggctccgggcacctcaagagggtagcagcctcgggggcacgggccacggccccgcgaagggcacaacctgagaagcccgtggcagcccctcgcagcgtcgggtgacacagggctcccccacccccaggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgccgcagaaaagcagcagacgtcggtccgcgccctggctctcttcgccccggaccccgacgtcccgccgcagcgctcggaggtgcccccagcccaaggcagcctgctctcgccggcacaggtcgggctttttcttcccaggagagaaaccccaattcccttcgtaacgtccaataaagacattcccgcggcttctcccaggtttggttgttgacgcagggtcccggagcacgcagtcgcttctcaagaaccgggtctcggatttctgaaattgaccagcttcgtaaattggagcctattctcccgcggcaaaggcagggccccaaagccgggatcgc

SEQ ID NO: 5638 - DNA, 1235 bp, Homo sapiens
  source 1..1235: mol_type = unassigned DNA
cgaagtccagccgacccttgattgtcagcatcccggttacaaggtctaaggcgaatagttgccgcacgccggcgcggttgtggctgccgaaggagtaaataatttcaccgttggggccttcatccagatccgttgcaaggacttgtaccacgcgcgtgccggagggtgcatcctccaggacgcgcgcccggtacaaggactggttgaagacaggcgcattgtcattcgcgtccagcaccttgatgtgaataggcaggctggcggagagagctggggtccctccgtccaacgccgtcagcactaactggagactaggctcccgttctcggtccagggcgcgctccaacaccagctccgcgtacttggtgctgtcctcccgcgtctgcacgcgaagcgcaaagtattcatttcggctcagctcataggtttgtaaagagttgcttcccacatcgggatcgtgcgcgctctcgagcggaaagcgcgtccccggagccacggcctcgctaatctccaatttcatttcctgggtagggaaagcaggattgttgtcgttgatgtcctggatcaccacttccacgctgaacagctccagcgggttctccactaccaactccagagttacagtgcaagagggcagtgtcccacacagctcctctcgatccagacggtcgttcacaaacatctctccggtctcccggttcacctcaaagaatcttcggctagctccagacaccacccggaacctgcgggctgagaggctaccgagatccaaaccaaggttcgcgaccacgttgcccacagcgaaacccttctctctttcctccgggatctcatagtgaatgaccgtggaagccttgttcaaggcaccaagcagaagcaaaactcccactaccctcccggtgcttaccagtccgctcctccaggcctctgggaccatctcactcaaaagcagttcctctcagcggggtccagatcgtccctgagatttcgctgagaaactttcagcgggttagcgcttgggcgctgggcgccgagtccgacatggctttctggatgccgttgatttgctcgccggctgttcagtctctgcctcatcccggggcgcagaaaggggacgggcaggggcccgatctccagcgtcttcattggccgacagcggcacacagagtcccagccaataactgcacgaagaatgagctagcgccgggctctctgagcaggacacgcgctagcgc

SEQ ID NO: 5639 - DNA, 3043 bp, Homo sapiens
  source 1..3043: mol_type = unassigned DNA
cgactcaggagagctcgacacgccggatagctgcggccagccgtggccatcctggccccccgcctccgccttccccactcccgcgtgcagccgggacacgggaaaggaaagctttggaagtcaagcgccggccaaaagatgacctgcccgcgtgtctcctcgccccctcccccagccgtgtcacatggcggccccaaccaggcgggcagtgcgccccgccgcggagacccagggccgcgtcgcctgggcagtgggtgatgaaacttcccaggcgcattaccgcagagggcgcgggcggggcgcggggcgggggtgggggatcgagagctggtaccggggctcacctgttctccaggaggagggtggggacggggggaggggcgagtgcgcgccaacgccgggtgcgtgccctggggcgcttgggcgcggcgctcgtgtccccgccctcccccagccctgcgagccccccgagctgcgccgtggggtgacgggaccgagagcagttcctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacaggtaagtgcatgtgcccccgcagccgggagctactgggagaggacaccgtgcacccacgcggcgcgccccaggcgtttcgccgggagccaggcgcccacccagggccacgcaaactcttgggatggcacgggacgtgcaaagggaagcgcgaggcaaggcgaggtccgcgccgggctccgagggcccggaatctgcacgtgctagcagggtgatgaaatggctggggcaggacttgttgctgtcctccccagggtcgaggggaaatgaagcagcgtctgacgctgccagcgccagcccccgcccccgaatcccgggtccggtgcaaagcgcgcttcatcccggccggcacgcgggaggcccagagggtccccggagctgggctgcgccctgcgcccggagaacttctcttcctggcctgccggcctcagtaagggtgccgcgtcttccccctcctcaaaagatgcccgacatcccagaactttgccggcgagacaaatggcattgcgaactttccccctgggggcactgctttcggaagggagcgtgagggcagcgcaaagcgtacctccgcggtgctgccgccatccccagctcctggccaggtcagcaagccaagaaatggtgacacgacccgaaccgtgcgcctcctctgctctaccggctcttggctcaccggcaagctgcaaagcagagccaggcgtgcagggcacggggctggcccttttcccagctcggaaagagaaagaaaatctgcctacagctccttcgctccacgacccctcccccgactttggggggccgtgtgaacgcggcagcggcggcgtgcgtgcgctcaccgcacgagctggaatgcacgagtgcccattagggacgccccaagtgagtgaatggcggccctgtgcggtcctgccccggcggcgcgtggggtcttacggatcctgtcgcctccacatgctggggccggcacccccaccaccccgagaccctcgc

SEQ ID NO: 5640 - DNA, 864 bp, Homo sapiens
  source 1..864: mol_type = unassigned DNA
cgcgatccaacccccaatccgcgatccaacccccaatccgtgatccaactcaaaatccccgatccaaatcccaatccgcgataccaagtctgcgatctagcccagaatccgcgatcccgcctggtccacccttcagcagcgacactggcggcctccgacctctcagacctagtgagcctcgcaaagccgcccggctcccggaagccgcaggtgcaggcgccgctgggctcgcgggttctcctggctggcccgggctgccccaggaccacggacggaaaatcgcaggcgcgcggcccaccccgccttaaggggagggcccgcctggccgtgtagcccgccccgctcctccttccgaagagagatctggtgctggcatgggcaccccgcggccaccggagtggcttcccggatgagcctggcttcggcgctgacgctctggccctgggggctgcctggctggtgtcaggtagcggaagacgcctggagagtcactcgctccttcccccacccgcccccaccgctgctcgtgccaggacgcgcagtttgcagttgcagctcaggcactggcgcgggatggcggagcttcccttggatggcgtcagggtcaccgagtgcacagcctacctggtctgagggtctgctcctcctggacacctctccggatcctgatccctggcgctgggcaatccacaggatgagactcatcggctgctggcgaagccgaccgcctgactttgctgcctgggcggctggccccgggatccgcgctgctggggacgcgggcctggtctgcggtgtccagccacttgctgcgggcgcgccacgtctaggctggtggctgcagccgcagctccgcgcctgcgg

SEQ ID NO: 5641 - DNA, 2071 bp, Homo sapiens
  source 1..2071: mol_type = unassigned DNA
cgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgc

SEQ ID NO: 5642 - DNA, 1170 bp, Homo sapiens
  source 1..1170: mol_type = unassigned DNA
cgagcccgcgccaagagctacgccgagacgcgccgtcggtggggccacgcgagatgcaaccggagagtttaaaactagcccaggaccaaccccccagggatccgctcaactctccccgcagaagagtttaagtggggcagtggccgccacaggctgaggatgatttccggacgcgccccaggcgcgaccgcactactcgtcctcagttcaaagcctgagtgacttggcaccacttccccaattgttttttatttccttcgcatccctgttgtgtctaccgctttcacgtatttgagagcctaaatcatgttaagacgacttggagaaacgcccgatttgcctcccaagccacgcaaggatccacccagacgcacgcccgcgcggagacgcacgctggcacacgcgctcacacacgcgagcacacacacgcgcacactacccggttcgtgcgcgcgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcggtggcctcagctccaccagtaactgccgctggcaggagcaccacacgctctaggagtttcccgggtatcaagtatgggtccagcccgtcccagttatcctcttcccctatggcttcattcccgttgtcagtaccccgacctcagcttgcaaccttgatcttgggcttgattataaatgacgaaagaccgcggcagccttcaaagtgcgggagcgagccccgtactggtcagcgcggcggagggatctttccaggaggccccaagcccccaagcctgtggagagacttggtaacagctggcaaggcctgctccagccaccctcgctggctccttgcccctgcattcagcgcctgagggcgttattcgccctctccctgcgtcccacgcaagcggctcaaggaactcactcgatccggattccgcctcgtatgctctccaagccttcgccacctccgcaggcgctctagaaaggcgtgatggccccagctcagtgcccgccagcccga

SEQ ID NO: 5643 - DNA, 2168 bp, Homo sapiens
  source 1..2168: mol_type = unassigned DNA
cgcgccacaaacggggacttaacccactgcccgatctctgtcagaggcgacccatttgcgcttctgctatcgcacctccgcccgcgttcctgcgccccaggttccccgctgcctccccgccccctgcagcgcgggagcgttgcttcgcctggcctgctggcctcctctagaccttggccaccttctccgtggcaggaagggctacatgcactgacagattttccgttggtggtggctgggtggtggcgaggcgtgtttccgggcgcgcttaaaacctagcagctctctccaagtagcagcttcccctactccgcccctaggactgaggacctagccctcgatgccccctcacttctccccgtcctaccccgccatcacctcctaacctctccagtatactctcaagcctcacacgggcgcctgtcctccctttgcattccctagctcccgggcgccccgttcggttgaagtttacgtatcttgggacctaattgctcccaattatccgcgcagcctaagtcccgcgtctgcctggctctcgccccgggagcctgaagctaccgggcagttcattgggtgtcctcggggaaaaggttcaagctgtagagatgagagaagtggggctgggggaggggagaggctccagaaggaagaccacgaacacgtgcgaagaaataaaagccaccacgtgtgcacgcgcgcgggggcccaagggcgcgagcgcggagcacgccccagggggccagggacagtggtcccctgcagcgggcatagcagggggcgcgggtactcacacgaaagcgtggtagatgaacgcccagccgcggggtctctccagcacgttgtacaggtagttctgcacccgccggtacttgacgttgcgccggcagctctggctactcgtgtaagagagcggcttccccagcaggctcatccgggccccctgcttgccccggcggctctccctcaggccaccgccgccgccaccgagcgtggccgcgcgggtgcccagcagtagcaggccgtcgcccctggcggctgccgagttcagcagcaccctgccccggccggactccacatccttcatgccgctgcccaagcgccccccgcccgccgccgccgccgctgcgccgctcttcacccagagcccggcggcgccgccctcctctcctcccgcgtggtggcggggcatggcatcaccacgggcaccgcgagggggccgccagcgcctgcggcgggggcagcggcctcatgtgcgccggcgggtttcaaggaggaagccggcggccgacggggcgcccgccagccagagacctctgagccgggggcggggaagcaggcagccagcaaaccgcccgggcttcggggcgggaaaggaggggctgcagaggaggccgaggagtcccaatttctaacagcctttagcttcgaattctaaatccggacctgtttggggcgtcactttgagagggtttctcttgctccctcattcccgcgactaccactccctccttcccaaactgcccccggggatagagtgggggagtgcggggcgctccgaggcgcgctcccacgcgcgcacacccagccccaggcttccccttccctctctccactccccacgccctgcagcgaaacggccccagaagcccctctccgaggcgcgagttcggtttggttctggcaggggctttgcagctgtccggaaggtgaagtcagccttgtgtcctgaggagaaactggagatgcaggtcgctgtgccctcccgctgctacgtcgctgcgccggatcctgccatccttccgcaaggggtgagagcgggaacagccctgccctgccttccaggtattatctagcctggaggctggagcgcaaggtaacgctccgggaagtggcactcgggtccccgcacacgggcgagtcctcagcagttcagtggacagacccgcaggacgcggctgccaagtccgcgaggcaaggaccaggcatcttcccgcgcctcactccagcctgcggactgtgactttccatcccagtatcagacaagctcgcgagtaactgaacatcctttccagtccatgggtggggtgtggaaagggcgtaaaactccaaagtggctcctccgcggtgagcgagctgccccggggctctgcctgactgcagcgcga

SEQ ID NO: 5644 - DNA, 2053 bp, Homo sapiens
  source 1..2053: mol_type = unassigned DNA
cgggaagacctggaggtcggtaaaacggagcggtgcgggatgatgtctgggaacaccggcaaggtgtcataaaatgaacgccaaggcggccacaagaggacggccgggaaccgaacccagcgcccagcacggggcccttgtggccgacgtgacgtggctccgtcaggtggaaaccgtgcgatcctctcccgatccaactcacgagagataaagatgtctaaataaccacgaccgccgccgcacaccctgcagggccccgggggcggaggggaggggagcgcctcctcggcagaagcggcggcccaggcttgtttggaggttcgcaattcaccatgataaatgtaaagaccaattaaggtttgatccgtgcacacaggaggcagacggcggctgatagtggaaacaattaacgagcatgtcccctaattcctgccgcggctgctgagcacaccgcggctccccaggcgcccgccgctgccgcccccgagtcccagagcccccagtccggccctggagtggggcgtcctcctccagcgaaaaggtgcgaggagcggggccccgggtggccggggagggggcgcgccgggccgggaggcgcggagccagccgcctacggagcccaactgtttgcatcggggaccggcgggcggggcgcgcccgagtggtctcgccgggaaagggcggcgggcgctggagaaggcgcctggcgcgaagctgggcggcgccccgagggcggaggacaggtggccgcgcgaccgcagccaggtagcgaacggctcgggggctgcgcagcgcggtcccaaagctcagcccggccccgggcccagctcgctgccgcctgccacgggagcggccttgcgcggagggagggggcgcgagaccgcacccccgggcccggcgcgcctcggcctctgggctcccgctccccttccccttccggctcagcccgctgccccagacgtgacccccgcggaaggtgttggcgatgcgcgctgcccgggagcgtgtgattaatggccccgaggtcgtgggcggcgcatgcaccagccccttcttggcctggtcagggtgtgagggtatccgggagcacagcgaggtcatggcagcgggggcctccgggagcgcggcggcggaggaggaggaggaagaggagaagtaggtgacgcgggccgaagaggcttgtcccctctggccccagggctggcgccgcggcgggtcccccgccccaagcaaagtttggggctacgggcgctgcgctcaggtccctccccgcgcagttccctcggcggggtctgtgccgccgccgctgccagggcaggacaaaggctcattaacacgtgatgggaccgcgcttcataaatgggactggagcgagagggagccagagacagcgcgagcggagggagcggcagggactgcgcgagcgggacgaggcgacgggcgcccgggctggcggagacgggcggccccacgccgggccaggcggggctcgcgggaggacccagtgaagagcctgggaaggggcgaggctcgccggcggtcggagcagcggggcgccagtcccggtcgctgtcgcgggcgggcgctggagaccgggacgccggcgctcggacggactgacttgctgaccgcccgccggaggcacaccccactccaccccaccccgcctcgccagcagcccggcgccggcgccgcctcccgcacgctactccctctgccaccccttccttctccacttcttttccgcctccgcctcttcttgtctcccgcggcgccagcgccttcccttggcccgggcgggggcctcggctccctgcagagctctccgtagtcagtgggggatatttcgttctagcggacaaccagcccctgagctgggcgagaggtgccaagggagcttctgtcccgaggaccaggggatgcgaagggtaagacctggcagagttgcgtttggaaatactttttccgcctcccgccccctcgggtacgaccagtgtggtccccaagtgtccttcgtggagttcttattccgtgtgagcgaatcgtgcgtcgg

SEQ ID NO: 5645 - DNA, 1679 bp, Homo sapiens
  source 1..1679: mol_type = unassigned DNA
cgccccttcccgggaagactcgttacaagtcgcgctccccgccgcccccaacctcggggtcgctctggtcgtctgtgaagcagacgtccacgtcactgtcgtcgctcttgggatccccaggctccgggggatagccgggctcggcacccgggccgtcgcccgctttggcgagcagactctggccagggtggcgggacttgacatgtcgctccaggtcccggcggcgcacaagtaccttgccgcagaactcgcagcggtagggcgtattgccctcggcgtgcagccggatgtgcttgttgagattgctggggtcgccgaagggccgcagacagactttgcacttgagtggcttgtagcccgtgtgcgtccgcatgtggatcttgagcccatacttgcgcgagtacagcttgccacagtagaggcacaggtggccggtcttgggcttacctgcgccgctgcctccgctgccgccgcccccggtgcctcccgccgccgcgacggccggtggcaacgtccccgagtccaggcgtccgcgacccttcccggcagccatctcggacagctgctgattgtgcatggcgatctctcggtcgatgctggccagcgaccccagctcggcggggcttagggcggccgctgcaggcccgctgaagtaggagatggactccggatacttcagcagcccgccgaagtgcaatttgagcgggtaataagcggtggtggccggtgagccgtagagcagctccccgttgtagactgtaaaggccggcatgacggcgggcaggtggctgcactcaccacccggataggctttgagaccgcccgggtcgaggggcggcagcgcgcagcgctcgaggggcaaccccggcgcagggggcagctgcgcataacgcgctcctggcagcgcggcggctgcgggcggggcgcgctccacgtgcttgaaggcggacgcctcttccggggggacggagagcagagggaagccgcgcagggccccagagcagggcaggccaggcggcggcggcggcggcgggtccccagcgagcaggcacttgggatggtggtggtggtgcgcgtggtggtgatggtggtgacccgcgccgcccgccgccgagttctccccgctcccggggcgcccgcacgcccggcccccgcccagcagcctgcccaaagcgaggccggctccttgcttgctgctgctctcctcccggtaggggtcgccgtgagcggccgccgccgccctcgctaggccggcgggcttgaaagctgagcgcacgccggggtagaaagccaggctgccgacccccgccgaggagccgcccacgatgccgaggaagtgcccttgtcctcgggcggctccgctcatgtccagggcacggtccagctgctccttgcccttcttgggctgcccccacttgcctggggtcggcgaggtggccgagggcgcggaagaggcctcgcgcttgatgccctcccgcgcaccgcaggcctgaactggtggcgggcccagggggtggggtcgcaaagttcctgcctgggaaggcgcggcgaaatcgggcgccgggggttttggggagagaccgaggccatcagccgctgggacggcgccttggcgagccgcgtgttcgtggtgcaggaaggcgccgcctccaccgccgctgaacacgcagtggaaacgc

SEQ ID NO: 5646 - DNA, 1474 bp, Homo sapiens
  source 1..1474: mol_type = unassigned DNA
cgcgtgtcagaagtccctcccgcgcggcctcttccccctcttcctccgcagcaggaggcctgacccccgcgtcctgcacccgtgtggaccaaacgttcagcctcccccgccacaatcggacgggaactcgcgcgctttccgggctattccctgtttgtgctgagttatgggcgaatctcccaaaaaggagatatacgagtgggtcgtccaactttgaggggaaacgaggattctctttctcattttctctcctgatttctctccctacccggaccgcacttctcgaattatccccgtaaggaggaacgacgaatgccgccggtcccacgagactgccgccccccactcatgcccaaacaaggatagaatcttgtagcgaggcgacaagaaaataaataagcgggcgtttcaaaccgagtcctcgggtgtgcagacccgcagcggagtcgcgggagcgaggtgggaaatcctggccgcggcgccgggctccgcccgccggggggcgcggggcggcgggcgcatgcgcgtgcgcggtgcggccccagccctggctgccgccgcctgccgccgccgtcgcgatgcctattttagtcaaagcggctgcgggcttggggacccggcccgggcagcggagcttccggacccgccgacccgccgaggagcgcgcgtcgggctcccgtcgagcagctgagcccgtgtgccccgcgtcccgcgccccgaagctgccgctccgaactttggtcggcgctgcccaggctccccgccagggaccagccgggtaaggatgggaggcgcagctgcagccggctttccccccgcgccgggttgtgtgcggcctcgcgctcccctggctaaatcgggaagcgaaagttggatctcagcccctcggggagcaactttgtcggccctggcggcagctgcttgttctacgcgcccgggcagccgggggcgccgccctctgtccctcctcgctggccgcgccctcgaggggctcccggcccttggaggccgcccttctccccgggtctgggcgctgcggccacagagaccctcaacggtcagcggccgccgctcaggtcaggcagccccagcgtccccgggccctcggccccaccgagtgccggctcccgcgctctgcggcggcaagccccttggtgagctccgtctctgctctctccgccgagtctccggggttcctcctcgccccctgtagggccgcctcgagccgcgcagagcctgcgtgcagccgggcgcgcggtgtcgcccactccgtccccgctcggagagtagggtgggccacggcgctcactcctcacccccgcgtcccgagagcgcctggccgaggaggaccgttgccacggaccctcctcctttaaggagcgaggtcagagggccccgggagagcgccgatggctggggacccgaggtccgcgccacccacccgcaacctccttccccgagcctttgggaacgg

SEQ ID NO: 5647 - DNA, 675 bp, Homo sapiens
  source 1..675: mol_type = unassigned DNA
cggctccggcaatccccgcatcccggctgcgccggtcgtggtcggacgcccgagacgcgcggaggcacagcagaccttggcgtacaggccatgccgccgcaaacggggggcgcgcactccttcccaaagtccccagaggagacacgtacctggtggtagggggtgtaggcggctgcgaagtagggctgcggaggaccatagacttggtacataacatccagacagctcatgactctccgcagcggagacggttaagtgttttttcattaactctccttccccggagctcaggggtgctgcatgggcggcgcttggacccgcgctctggagtcatcaggcggagcaaagccagcgcgctccgcggctcggaatccagctggctcgctaccctcccactcctgcgattttactcccgaccgcgctccagggcagaagcgcctgagctcccgctagtgggcatttaaagcccatgcccggcgggcgtgctgacgccactcgggggctgcggagcgggagggggcggtggggggcggggaccggggggccaatggggagcgagggacgcttgttggaggggcagcgagtgtgtttcccggggcccacctctgacaagcatgcggccaagggtgccggagactatgcggttcccagcggatccgaggcttcgcaccgcga

SEQ ID NO: 5648 - DNA, 1133 bp, Homo sapiens
  source 1..1133: mol_type = unassigned DNA
cgtcggccaccgtcgagcccccactttatccaatcagatcgcggggaaggacacgcaaacctgccgagggctcgggggctccgggctgctgctgctgccagcgtcctgggaagtgacaggcattaggacctgctggcgcggcggcggcggcggcggcagctccagccgcgcccgccacacataccttcactcgctcggtgcacacgccgcgccgcgggcagtgccgcctgcggaggcgcgctcggggcccgcaggggcagcagcggcagcctggcagcgccgccgcgccctcgggcatctggcccgcgaagtttcgcccctgccgctctccgcgccgctcgcctcacgccccccagcgcggccgccgcccgacgcgcgctcgccctgcgctcgccgcgcgccggctccgggggcggcagaagcgcgcgagggccgctgcccgcctccctgcgcagcccgcggctcctaggcaccctgcgttgctgggcccggcgggcgggggtggggcggggagcggggcgcgggccgagcgggggcgtcccggctccgcggtccccggcggctgctgcagcggctgctgcgcgcaatgatgcgggtccgcgccgcgtcccagcagcggcgctgcccctcccttcgcccagatgtgtgaatcctcctcctacaacaaatccttcatcctgctccctgccgccccctcccagggggccaactttgaggaccgcaggggctgccgcccaggcggccgcaggcggcggtgtctaggcggaaaggagcggcgcgaaagcggcggcggcggggaccggggcctcggggcgaggagtctgggcggcatgaccgcggtttgctgagctgaagtcggtcgtgctcccagagccactccgcgggagcgaaccgagtgtgtgtgtgcgcgcgcgctcgggggagaagggaccaagaggagggttagggaaggaagctggggtcatggaacaggggtgcaaccgaggcatccagagcggccggaaagcccgagtggcggagaggccagaggtggcgagaaggggcgcggcggcaccggacgcaccgcccagcacctggctcccctgggctcccgaggatctgaagggtcggagcgcggagagctacggagccga

SEQ ID NO: 5649 - DNA, 1808 bp, Homo sapiens
  source 1..1808: mol_type = unassigned DNA
cgggcgggggacgtccggcagctctgcaaacgcgcagacacgcgaaccccatcgcctcgcgcgccctttggctccgctggtgcgtgtcggggatgcggccgcgcaggcgctcgctccctggcttcctggccgggtagcgggcgttcggctaccggagtccagcctaagggcccagccgaggtctccccgcgcgaggcggttgcgctaggtgagcgggtaccgcggccgcgcctcccttgtcatttactcagcggtcagaggcatcctgcgtctgggagtcccaagtgccttcggctgggtgcccctgtccgatcctcaaaaggaaagcacaaatcccgggtgcgagtctaacccaggaccgaactttcccgcgaacctgaagttaccatggggcgggagccaccttagcgccgcgtccgcccgcccctcgcaccggctaggatgctgcggaaggcaggggcgccgagaggcaagggtgaaagacgccgtccatacccccaaagcccgaacctgcatctcctctgcgaggcgcagggcgggaggaccgctgcagttgggagccggctccggacaggcaaagcgacccgacaggtgaacgcggcgggagggagcaaacgcgtaaaaaaccctgcacttacttcttcgctggcgccttccccgggaggcgttttggctgccgatgtattccataaagttcaaaatgataaaaagccaagaaatcagtcgcaagtgcatagtaacccagtaatgcttcccttcctttctcctctttcttttgattgttaattatatttaatgtttttaaaatatatgtaggtgttaggcgtatatagacagtgcccgagcagcgggacttctcctctcacatccgataggcgtgctgtgatggcaagcgaagtggggcgggtggacagggaaaccaactattgtactttcaaattatccaagcactgaactgcggcggcttcgctggggtggctggcatcgccgcgaaccggggttccaggagccgccggggcggccgcaggtagcatgttgtgcggcaactgccgcaggcgggatccgggcgggcgagcggcggcggcggcggctgcagcggcggccccttgggctcagaagctgcggcggctgcggctgcagcggcgggggcccctggagcgcaggggagcgggcgccgtcggcacagcggccatggccaaggggcggcggagagaccccgagctgcttctggcgtgcgcgagcaggagacgctccagtgttgggctgggctcccgggagcaccacataggggaggaggaggaggagggcagggaggggggagggagaggagggcagggagggggagaggaggggggatggctgtggggggcgggggggagctcgggggcggggaaggaaactgctggagcaacaaccctgagcgacctcaataactttcaatttcaagagggaaagagggagctggaaaagtacaggcgttgcgctttggcagagggacgggaagaggcgcctaaggggtcccgggtctacagcgcagcatctctggacactgcagtgacggccggagaattccagccagaagaatggggaaagcagtgcgtgcgaagagcccctccagaagggcagctctggcggggagacttgggcgcactggggctggcaggcagtgttgaggccgaagaccccccacccatcccagttcggctcctctccgcggcctcaagctaggcgcacccggctgtcggtggccgtgcgcccctgcgcccttgtgccccagcgcccccaccccatccccagcgccggcgcgc

SEQ ID NO: 5650 - DNA, 1323 bp, Homo sapiens
  source 1..1323: mol_type = unassigned DNA
cggtttcggctgcggtggccgcccacccacctccccactcccgtcagcaccctttccttcccctcacctgtcctgagcaccgggccctgggggtcgggtcgcctctccctgttctcagtcctggtctcactccaggagctgtcgggacgtcgggcgcctctggaggcggacgaagaaggcggcagggtcgggggcgtcagcgggaatctcggccgccgcgggcagccgcggtctccctccccatcccagggctcgggcggccaccgcgggcggatgagtcaggcgagggggcgggtggcaaggggtgcaagcggacggagggtgggggcgcccctatgcccgcgccgggggggcaccggaggcctcggggcaggggatgcgccgctgccggtgctcacagagggccgccgccatccgggcgcagagtccaggcgcgcctgccctcggagggcaccgggcgcagcaagccgggcaggggagagggagtcgccgctcaggcggcgccgccaccgcgtccaagaaagacaaaagggaccgggaacgggaggggaaaagttttctgctcggctccagatggatcccagccccaaacctcacgccataaagccccgaagaggcgggttgggggcgggggccggggcggacttccaggggcgtggctgcgcgcctgcgaccccggaccgtgccaatctcgccgccgccccaaaacctgtgggaaaccccagtcctgccacccactcctcctggaggacgcagacaggatctgctctgcaggagcccaggccggccgatccgcgtcccggccacaaagttgcacttcgagagcccaaatcacccgcagacaaaacccatctttgggaacaaagtacccgcttgcaggcgctcttcccgggctggaaggctggcgtgcggaaacggacacacccacccgtggggcccgcctctagctaccgcgggaccaccggttaccgagccagggacccggctcccccagttctccggagcggctggggagctccagccgactcgcagtattcccggagcaggcaccgcaggaccctggctccacgcccctcggacgctttctcctcagatgccgcccggcgggccggggtccccctggcgggctgcgcgggcgctgcgcgagctaaaccaaacctggccggaaaagacgcggccaaggcccgctcggtccacgcttcccgccggcccggcaaggggttccggagaacggcttgggggggcgagaaccatgggcgggggaaatggaagacagagggaactgaagcacgggggtcttcgatgagcagtgcggatgttcga

SEQ ID NO: 5651 - DNA, 1501 bp, Homo sapiens
  source 1..1501: mol_type = unassigned DNA
cgctactcgagccaatgaacgcgactgctctgacaaggcgcctctaatttcaccgaccctggcaaactgcaggagacattcagtccacgccacataaaaactattaaagtgggatcgccgcagttgaaaagcccgatcagtgcctggagattagaacgcgagcctttaaagtacacacgcacccggcaccgggaaagcccaggcgcctgtgaccctccgaaggactctgggtcagcatcctcgcgcctggaccatctagggggtcatcagaaagtaatacacgtcataagaaagatgtgggggagaccccgatgctcgcgcctctgccaggtggaggcggggtgcaggtagaagccgcgcgctggactgctggatgaactccgttacgcgcaggctccgcgccgaccccggaagggacaggcaggctcggaagggacccttggggcttggggacgtcttctagggcagagagcaccgctgcggtccgagcggcccgggccctcaggcgtggggcacccggcctccaagcgccccccggggacgcaggcgcccacgcaccgtccagctgcgcgtcctcagtacccagcgctcggcgtccccggcggagcctcgcgcactttcccggaaagtttgggggttctctcaactcaggctcccccgggagccctggggcgggggttggaagaaggggtcactcacctcgtcgcccggtccgcctcgggttcccgaagtgtctgtcccagccgcggttcagtgcgtccgtaattaagtatttattctcgttccttccagtgtcgaagtttccccttcgcgctgtgcctctggtgaaaacaggacatccccttcggccaccccacaacaaatagcgtacacaagcgggggagaagcggggcggagggagaagccggctccgagggggaggaggaaaggagaggagccaaaactccggactgcgacaggggggaaaggagaagaaaagaaaatgagagagcgcgcccagccgccgcagtcgtcactccccggcttttcccgcagctctttccccctctctaaggcagcgacaacttcacgtggacaggatggaagttttgcgcggaagccgggaacggccggagcgtgcgccgcgctgccggcagcctcgcacttgcgcagggaggtggggcgggggcgacgtcgccaccggctactgcgggctcgtgaggccgccgggggcctcgggggaggccgccagggacgcggggggcggcggcgcgcgggggacccactccgtttttatttgacctcgggtgactgcctattgtcatggtttgcgatctcgcgtggggaccgcccagggcctcggggccctggatgtcccgggtggcgccgccgtaatctccgtgccctccgcgccgcccccaccccgcccccacccgggccgactcgagcggctgcagcctccaggctgaggggagggacccgcgaccgcgctctcctccctgggccggagagccactgtcga

SEQ ID NO: 5652 - DNA, 1744 bp, Homo sapiens
  source 1..1744: mol_type = unassigned DNA
cgtcctcgcggttgccctcctcccagggccgccggtggtccaggatctggccatcggggaggggcgtggtcttgccgaagtcgatgagccacacgccggcgcgatggcagtgatcgtgcacaaagaggagcgagctgccgatcacctgcgagccccgcaccgtcaggccgcggccctgcccagagacgcccttgccgggttcccgccctagccctcgcggcccgggcacccgggcagccgccgcttacctcgtgcctcctgaagaactcggatacctccagggtgtcccggatctgctgcaggcggttcagataccgcctctgcagagggtggggtgggagaggagggcaaattaactaaacgccaaatgagcccctgctaacgatgaggagccgggacccacgctgtgcttggcaaatgccgccaggaggaggacccagggccccgcccagcgtggcccagaagggaaggagcgtagagcagttgcgagccagcgcggtgagggccatggtggggacacagccgagggcactgggccagatgacaggggcagtcctcggcttcaggctccccaacacctcagggtttgggatcccgctctcaccagcacttcctcatctccttgcacaaactcttcaaagacgcgaagcacctgctctcggcttcgcgtagtcttgaagtcggtgctgcaggagccgtccgctttctggatgtgggacaggagtgtcaggggccccgggcccgccagtggggaagaggacagcgtagagcagcggtacctcccagttgcaggggacggcgaggcggtgggagagggcggaggggcaggcggggcgggagcgggggatcgggaaagacagcgcgcagtggggctgcggcggtgccagcgaagcgcgcctgcctcaccttgatgccctcgatgcggaagccgagggtggtgctggagctgatgccttcccgccactgcatgtagcgcggcttggtgacggcgcgctgcgcgtgctcctcctccgtgggagcttcaggatccaccgccagcattttcttgtacatgtccttccgcagcttgggccgctcacgggccttggtcagctcctcctctaggtaagtcctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcccagccccttcccgtcgcgggcacccgcccacccgccccactgctcaccagtgtgccctgccagctgcacccaggcgtagcgcttcttgaaagggcttatgaccggcagattgaccatggtccggatcttctgccagtggtttttctgaaagcgacagggtcaaggtctgataatcggcgtctcggcaatgcataagccctccctccactgaaacagggtctcgccacgcccccgacccaccgg

SEQ ID NO: 5653 - DNA, 1801 bp, Homo sapiens
  source 1..1801: mol_type = unassigned DNA
cgcgcagcccaggacagcagcgcgcgggctacgggcgagtggagttgcaggggcccgggcggagagccgctgtcacccagggaagctctcgggactccgggcctcccgcgaagctccggacgggcgtcaccgaagccgagagtcccggccgagcccctccgcacggtgggcgccgcgcccaggcgagcgcgcgaggtcgggcggggccgggggccgcccggggagggggcggggccgggactctcgcggccgcgcgcaggggctgggaagctgcccctccggccgcgccgggcgaggggctgcgccggcccgcgaggcgcatgcgcgctgccgagcggctctcgctccctccccgcccaccgctccctcctccccctccccctcctctgcatcctcgccgctctccctctctcctcgcccgctgggtgctgaagttgggcggatggcagcaaaccggctccgctagaggaccgagccgcccagccccgctcccccggacccatcggcgcgctgcccacacctccaggcgaccgggtaagacgctgcctccaaaacaagcggtgctaagtaaatgacatcaaaatgtctgctttgcaccaatggatggatttttttcaaggtaggggggaggtgaaggaaggagggggcggagagcgcgaccgcccatgccccggcgggggcggctgcgcggcgctggggtctcagctgtggccgcggcgccctgagcgggagcgggggccgcgccgcgggtccgggaagttgaatcccgcgtcgctgcctggacgcggtccgctcgccgccctcagctgctgcagggaaccgggcgagtgtcctgcccgccggggaacgctcggccaggtcccagagttcccgcggagagcggggcgcctgctgggggcggccgggagggccgggccaggggcgcgggagaccccgcggggacgcgaggtgttgcgggttttgtgcggttggttgggaacgaggagaatgtgccatcaacagtgtccaatcgactgatcaccttgggtgctgtgtttcctcccttatctctctttacctttgggaaaatgcactgctcaggtggggaaggtgttcgaagaagaggttgcgaaaatgaatcctttgaccagcagtaaaataccggaggggtgtgtgtgtgtgtgtgtgtgtgtgtatgtgtatgtatgtatagggggtggggggtctcttttgttccttcccctccccttagtcaaaggaaagggagtcctggcgtgtgcggcgcggggtggattccacagccaccgagggggcgaggacgaggaacgcccaccaaccgcgagtcgctgcccgggtgggcgcatcggagcctcctttgctgtaggtgatggtggtctttccgtgatcgatggaatcatagtttaatctctgcctccccgccagcctccctgctgtccctcatcgagtgctgcggcagaggctgggtgcagacacggccgctttctcctcttctctctgcctccctgtctccctgaataaatgccggaggactaggggatggcggagggacagagctggactcggaagccgcgggtgggagctgctcctcgcgagcccgaggctgctggcaccttgtcgcgggcagcccgcgccagcctcgggagtccctgggctccgggagagcgagccggggtcgcctggccacaaagatgcccgcgcgcccgccctgcgtacgggacccgccctgcgccctgagccctgcgcctcgcccggagcccgggacgtcggttcacgtgggagaacccctgtcgcccggggacga

SEQ ID NO: 5654 - DNA, 1801 bp, Homo sapiens; identical to SEQ ID NO: 5653
  source 1..1801: mol_type = unassigned DNA

SEQ ID NO: 5655 - DNA, 1684 bp, Homo sapiens
  source 1..1684: mol_type = unassigned DNA
cgttccccccgggcgcgcgggcctcctgccgcctggagccgagctggcactggagcgcttctcctctggagcgcagaggcacccgacgccctgcggcagctcgcagcctttcccccacgaccttctagaacagccctgctctgcctccctccggtctcccgagtgcgcccgtcatcctgcctcgcgagaggtgaacgcggagaaagtaggatgaccacctacgctcccgagaaattctgggcaaagaaaggcattaccccagtccgcacgctgaaagtcgcctttcttttccttttttccccgctgtgcctgaatctcccgggacacttagacggctggagcctcccgactccaaggcgggcgacggcaaagttaaacgccagcgcgctgcggtccccgggcaccgaggcgtccccgctcccgccacccacacagggcgccaagtgccccgacccgcgagtgacgaggacgcacaggctagtgacacgacccgtagccagcactgagcgggacgacggggcccgagcgcaggagggtgcgcggggagctgaggagcgccgggggcccgggcgcggcgcgtacctgaggccgccgccgaggaggcgacggggagcagcgcggccaagagcagcagcgccgcccaggacagccggcgcggcgcgcgcagggtcgccccggcctcgggggccatcgagagcccggggtgggccggggctgggtgcttgcggctggcaggggggcgctggccggagtctggggagtgccgaggcgccgccgtcgggtccccgccgccgtccgtctgttctgcgcgctctgcgcggtgcccgccgcgcccctgccccgcggcgatcgctcccggccgcacaccggcagccgcgctccgccactgaggccgccgacctcccgccgagccttttagctgcgctcgggcgccccctgccggtgtgcggggccggggccagggccggcgggggcgacccgggcgacaggggcgacgggggcggcggggcccgggctggaggcgggcggggcgcgggacgaaggggccggagcgccccggactgacttagcggttctgaacttggggcggtcgctgtgccgggccaagtggctgaggaagttcctcccctcgtctaaccctctcattttctggctggggaagtcgcccatcgcgccgaggagtgccctttgtccccttacagaaacacctctgcgccccaagtggggactcgggccgggacccctcacccggtccgcagcgctgtagttcctgtggctagcccagtccttccacgtccctacccgcacccggcgcgcccacgtcaggggttttcagcgtccttagaccctgctccgtctggctgtcatttctagggcgcgcacgatgcgggtcgaaaaggaacccagttttcagtgtgccttgttgcccaggccaaggactcagcggacctcgcctctcccttttctgtaattgtaacactgccccaggtctccctattcctccttctccctattcctccttccagcctggaagcctcgcggccctccagatggactcggagcgcccctggaggctacagtgacctaagctctaggaaggccgggtcctggacgccgcgtgctgctgtccgccgccgaccggtgtcctcgcagagataacctggctgaactcaccgcccagcgc

SEQ ID NO: 5656 - DNA, 6657 bp, Homo sapiens
  source 1..6657: mol_type = unassigned DNA
cgtgcgtgactggacggtccccgcgcggagcgaggaggctcgcagcgtcggggggagggcggcccagcagggagggcgatgcgagcctggggaggggtcagcgactcggccaggaggtgaggacagccccctaatttccgggaagggaagggcagggggccgcgtctggggggcgccgggcagggtgcggacggcgaagggggacggaagggagagaggcgctggggaagggacctctcggaggcacggggcagcgtgcgggctgcggcagcgaccccgacccgggcccccgggctttgtcgggctgagcctgcgcccgctccgccgccgccaagttcctccaactttgcccgctgcgctcggatcgcgcgccaggcctgggggcgcagcaggggctgggggcgcacgctgcgcactcggggacgcccggggttcgaggtggcggggggcttggccgcgccgctccccgggggtggtccgggtcccaagtcccccaggttcagcgcccggccgcgctcgccgcttacctgcccgcccggcctcggttccggggctgcgcccgcagccgccgccgtccttcaagctctaacttcgctcccgggattgaaattcctccccagcttcgcccatcgatctgcgcgcgcggccccgcccctcgccgcgcggccgggggggaattcaagctcgccctgccccctcccgccccccttccctccctccctccctccttctctccctccctcgctccctcgcccgcctgcgcgctcccttccaccccctcttcctccgccgcgagtccggctcggagcctctggccctccccttctctccctggcctcccgagccccctgctctcctcggctccccgcggcaacccgctccttccctctcccggcgacgcgcaggggctggggaaggaggggaggtcctagaaagcgcagggggcgtcctcgcggtccgtccccggccctccccgcccacatctaaaaggtggagggggtgggtgggtgggtggggggagtgggggcgacagctgttggctgaacaagctacccgcgactcccaccacctcaagcaaagccaaggcgttctcaggtcctcccgtcggtccgccccttatccgggagggcagggacctaggggcggagaacgcagggcgcaggccgggcctcctctgcccagccctggccccgcttccttccttcattcaccccaacctctgtgaggacttcagggggttctggagcactcttcggctcagtttcaccctgacaacctgcctgtgcggaagcccccgtccgcatgttacaggaagggaaactgagtcaagagaggcccagaatctggccctacacagcgcgtcgaaggcagagccccaggggcagcctggacccccggcaggagcctcgggactccacgctcgggccgggcaggccccggcggtgcctggacaagcccgcgttcgcagaacggccggcgcctggggaccctctccagtccccgcgcagcccgcgcgtccccgccggcgccccctccccgcttcctgtcccccgcccgcctctggttcccggcctcagtacccccggcacgctctccgctcgccgccagcagctgggcaattcaacgagcatacaaaagagttgactcaattcaaaggcagcaaatcaagataaatcctatagtgtgtggggaccggagagggaatgtgaatgaacgcccacgacgccgttcagtcctgtatggaccggcctagcccggctgcagggcctgacacgcccgggtcctagggttctccaggagccagaatcggagagtgggctctgagctgccttggctcccaggcccccagcactggcccgaatttagtaatttagagcttgtggcctccttcggctggctgggtggggctcccgtgataggggtgcagagccttgaaggggagtgctaggacgaaagccagtgcgcccccacgatttcatgcaaatactggggggcaggggccctggaaacccagcacagccccaggggccggcaggaagggcaccggtggtttggaacacctaagctgtggcctttctccctctgccccgacctggaccacggtcagagccaggccgcaggccaagagcaggtccttgtttacccaccagatagatactgcaagcctgggatgtgccaggcctgggcctgtggaacgaggccggcggtgagcggggcaccctctcctccctgcctgtctgtgaggtctccccagctgcagctccactagggagaagctggtcggcccccagagcttccttggtcacgcttggaaggtcccagtaagctaccctccagcttctggcctggccagccttgtgcagaagatgaccaccgggctccgggccccagcctatccactccgcctgccaaacataaaccccaagagaggtactggatccccatttccagcaggttcccccaggcctgtgctggccaagtgcagccgaagctctggaatgagcctcctttgccttcgcaggtgtcccccgtgtgccctgcgctgtgctgggcgcctgcccggaggagccgcgccaggacgtcctgctacttcccaggagcaggcatgatgagtccatttcctcggggtgcaaactgaggccgagggcctcttcagagcgcccttgaccggtactgcctgaccccagaggtcagttctgcggtcactcggggtctgagatccacggagaacctcagaggtcaacttgaggggcgggtaggggtacgcgcgcggggccgtgggaggcgagatcccgcaacctgaggagccaggaccccagcagagagcgaaacctggagctgggggaggggacggcagaggactggaggccgggctgcacggcaggggtcgagtcctcgcggccgccccccccccccaccccgagcggaggctgcgccgtccggctgcgaccgagtccccggagtcccggccgggtcgcccctcccccgtggccgcgccgattggcggcctgctgttacccggacgccggcgccgccgccgcgaggacatctgtccggggcccaacgccgcgctccacgccccctgcccctcccccagacccagaaccggggagaggacgcggcggtgaagctgggaggttggaacctggagggcggcggagtcccggagttaacggggcggggggcggggccggcgctggccctggggacaaagatccccacgctgcctgagggctgggctctgcagacaccgaggcaggaagaaggactccgtattccccgtcccccagatcctcaaatccactcaggctcagacctgagtgtccaggtggggtgggggagaccgaaccctcctgggccctcgaggcgcgcgaaggcgacgctgaaggggggacgccgggacgctgcttcctccctgcacacgccgcccgagctgcatccctaaacgctccaggagcttcgcgggtcccccctgccctccacaacccccgaagctgcccccagcgacctctccccgccctcagatggggccgcaggggcgggcgaatgtgttgcgctcgccgtgggttgggaggaagggcgcggattgtaggaagtccctgctcctccctgggcagcctggccccggggactcgcgctcagcccgcggcggaggactcggtcgggaatggtgctgagattgcgcgggtacggcccagggccgtgaccgggtggccaccgtgcagtttgggaagagaaaaagttcgggggggggccgacaccccgagatcgaagagggaaaatgggaggaaagcaggcggcagggagggaagagcggcggaagagggaccaggagagctgggggtccgctctgggccccggggtcccgccccactcggcagcccagcccagcccagccccgccgcgccagcttcccggaccgggagaggctagggtcaccgacgcctattaatagccgcgagcgggtccttcccgggagctccgcagcggtcggcagagcccagccaccggctggggtgggggcgggggtcccgtaacaccccctccggaggttcaagcggcgcggggcggggcgctgcgcccccccacgccggctttgcgaagtcgaggcacccacagcccactccctccccacctccgactccgagaccaggtttcagatgaagaggggttcgtctgtggttcaacttggggcgccgcggctaccccagcgcactcgaaggcgcgcccagccccctccccctctttctgcccagccggctttttgctctcagcgcgctccggaaagtttcggggtccccgcggcgcctccctagccctaggggtccggagtcctggcccttccagccgcggcgtcggggagggaagtttgtccggcccaggctcggcggccgctaacttcgggtgcgcccgcctccgaacctgggtgggtggatggggacgcccgggagccgcgggccccgagcgccgcatccagagccccgcgggcggggagactcggccctggcgcggacgccgaggtcagggcaccagggatggggtggcccgggctgcgagagccgctggggaccctgcgctgccccccgccgccccccccagagagcatcctcttccctgcctcccctaggggcggggaccctccgatcccgcagcggcgacagaggggtcccccggccccggacagccccctgcccctcaggccccttcttacctgggccggggtgcgggccccgggctggaggcactgtcgcgggcgagcagagcgcgcgcaccccggttccccgagcgcggcggcggcggcggcggcttcccctccttcctcctcctcttcctcctccgggctcgctggctccagacagccctcctccccctcccgccctgccggcccctcccggagcccgcccggctggactcggcctgcgacccggagcccagcggagccggcgggagccaggctgcggcgctcactgcgtcaagcgcggggcgagcgcggggcggcggcggcggggaccgcgcgctcggagcccggggctggccgggcaggcgggggagcggcggctccggctccgactcgggctcgggcgcgggcgcagtggtggcggccgcggcagcgccgaggttgtagcacattctttctgagcgtgatggaaggtttcatgtgggagagcgcgcggggagggatggggagggggcgggggccgcggcgggggcgaccggaggggcggggggcggggtcgctgcccgcacgtcggtgggctggggggtggccggaggggggctccggaggggaagttggagccagccgcgggggcggcgtgggaagccgagtggcggcctcgccccctcctcctggcccgccccgctcgccccctgcccccgccccaggccacccagaggctcccaggcttcggtttggaagagaagcgtccgaaggtctgggggtcgggaccctggtggcgctgggaggtgggcccctgggtggggacacggctgtgctcacaggcgcccggcaacctcgtggaagttgaccccaagtcagaccctctgtgagcgcgcgcgtccgcgagggccaaagcacagcccgcaggacgcgcgtttgcggggcggggggagagcggggcacttgggggcggggaggtggagcgagagggtcgtcgggcccctggcggccccgcgtccccagagactcgccctcccctaaggtcgccgacccctccctcccttccctccccgttgcgcgtcgccccccgcctttcggccgggaggagggggaggcgtgggagcggcccggcgccttccgattcccggaaggttcggtttagcggatttccctctcccttcatgtgcctccggaatcccagcggatccgaaatcgcgccctcgggctctgagccgaggggtcccccgtcgctccctggtggtcccgagccctcgccgagcggtctcacggcttcccagggcgtctcccgctcccacccgccccttccccagcctgcggctttcgtgtgggctaaaaattccaaaccaggctcaagagcgccctcgcccggctaagcccccgcgcgccgcttcacaaaccggccgcgtgcggagctgcggagcccgggacccccagcgcgcgctgggcgcgacactctggaccccgctgccagcgccgcgcccctccggccggggagccccacaccgtcaagagggcagggagaggggaggggaggggactactggaggggagggggctgctccccgggtgtctttcccggaggaggtcccgggacaggggtgggggtggcgcgggaggccgcagacagcgcgccccgaggatggccgggccggggatgggcgcgcggggctcctgtccggacgtgggtccaacggcctctccgcagcccagaaactccgtccagcccgcgggacggccgcccgccctccgaccccgagcctctaccacacttgttcctgcaggacggggttggggggactgagaccgtgattgaggccggggcatggaggaagtgccgccgcctgctcccgggattgctggacacgaagggtggaggccaaggacggagcccctgcctgcggctgtccagcccttagtccctgcgcgggggcgcccagacctccagggaacagggagacagagcgggccgagcccgg

SEQ ID NO: 5657 - DNA, 546 bp, Homo sapiens
  source 1..546: mol_type = unassigned DNA
cggaggcggcggggtcgcgggagggagggggccgggcttaggcgattggcagcgcgagcccgggagcccccccgtgcccccgcccgccccgcccccgccaccatctgctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggtgagcggcggccgcggaggtccgcggggagggagggaggggcgcgcggcggcgggggccgcggaggccaccttggttctcgggccccgccgcccggagcgctagaggggatcggcggacccctgacccccgcccgagaaaaccaggacccaggcagcctcgtcttctcgctgggatggagtaaccggggcgcccgc

SEQ ID NO: 5658 - DNA, 288 bp, Homo sapiens
  source 1..288: mol_type = unassigned DNA
cgcgcggcgcactgcgggccgggaacgtgctgcgcgctgacaccgggtcagctccctgtgatgggacttcctttccaaaaacgtaggcgttttcccgggtcgcagtcgcagtcgggagactgagggttagggcgcggccgcggggtctcctgggccggggcgcggcccacgtctcaggcctctgcggctctgaccagaagccgctgcgcctttggccgcttcccacccgtcccgtccccgcaatcccaggcccagggttacagcggctcagctctcttcctctcgcga

SEQ ID NO: 5659 - DNA, 947 bp, Homo sapiens
  source 1..947: mol_type = unassigned DNA
cgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccgggtgagtcccgaaaagcgcgcggggactccggctgagcgctgggccgtcagcaacccggctcccagagagtcacacgaaggaggggaagcggctctctctggggcttctgggaggtctggcccgggcccctcccgcagcctccggcggccagtcccgcggctctggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcgggtaagtgcgcggcgggcgcgggctgcgggatccgctccgggctccactccggatcctctttggtctgtttgggtgtcccgggccgggggcagccgaggccgcgcggcgctttctctctgggccaccctcccctcgctccttcctaggggagacgaatcgattggctgcccggccgccggaacggcaggtcccgtcgctcccctcgcctcccgcattcccggcccggtcccctcccatcaccgcgtcccgccccaactcgcagtcagcatccccttcccatcctctccccgtccccgctgccacttccttccttggatgttggaagcgcagctggtattttcgttctcccaaccccccaaaccccccctccccattcgttcatcctttgtgttccggtctcttctctgggtgctgcggaggctctcccggctcgggggcgtgtgtgcagggaggcggaccgcggaacagatacgg

SEQ ID NO: 5660 - DNA, 1313 bp, Homo sapiens
  source 1..1313: mol_type = unassigned DNA
cgagaatctgccgcagggggagactccgccgccaggtcttgggaattgcctgggcgccgccaaagctcgagccggagctgtcatttggggcagcggccgggaagaggtaacgatgccagcaagaaagcagcggaggcaggaggcggccggaggagtggactggagcggacggagcctcgccgctctccagcccggagcgcctggagcgaaagccaagcgccctccgagggcgacctcccctccccgggcgcgcgcccacccgctgcagccggcagcccggcgggagaggtggcagctgcagctccgcaccggggagagcgagccccctgcgcgcgcgcccacccgccccctaggtgacccggcgtcctcgccgcgcccgctggaagtttgcaaactttctccgggggttccgccgccacgctgggaagctggggacgcggggggaggttcctggctcgccgtctccgctgccgcttgaccgcacttctggagggctccgcaccttgccaggtctctggaggcaaacacacacccccgattcataactggtccccgcgtcaggggactcgcgcgctcccacacacgcacgcacgccgggcggactcggcgccggctccacgttagcatccctccaggcgcgcggcgcggcggccaccgagcgctccggcactcacgcggcgcggggtctctagggtggcctcaggacacagccgaattccacagtctaccagcactcggggccggacttccctctggtccgccaaaatgtttacaaacacagatcaccctccagaaaaaaatgcatcgcatcttccctactccttgccctgtgacctgcccactggaccaagtaacctcgcggctgctgccgagaaccaacccctgcaaacaagtacactcccgagatggctcctgcggcaagtgcaacaaaagtggctaaatgcaaaagccccagaagtggccgagccgtatttttaggaacttaccaaacaagtgtggagaaggcaagagcggagcccgggtgaagggaccacgttggactgagcaaagattacaatacattctatttagagtgcattacatcacccccccggtgacgtcacgtgggattcctgaacttctaaatcattgcggtccgctggggagggacggagcgaggggcggggccggcgcgtcgagggggcaggccccgccccggtcccgccccgaccccgccccgcccgcgcggaccctggtgcacccgcccgggagcggcagcggcgggggcgactgcgcaagcaacagcttgcagagcccagcgccgtgtgacacgg

SEQ ID NO: 5661 - DNA, 848 bp, Homo sapiens
  source 1..848: mol_type = unassigned DNA
cgcgaagcctcgcggcttctgcgtgccctggccccgggaggataaggatttcccttccctcctacttgcgcgcggagccgagctcttgttgaggtgagggttccggaagcccacgcagctccgcaggtcggtggtggccgcggctgccctgcgggggtgagtgtgcccggccggggtcggagcccagcgtgtgcccggcagacggcggtgcccgcgcgcccctccctccgcgcccgcggtgacagcccagacaccagcccgggcgctgacagacgacttttctcacttgtcagttttctcgcttgtcagcagagctgctggtaagtgagagaaaacagaggggcgcgaaggcaggcgcggccagggagtgagcggggcgctgggcgcggggcggagccgggtgcgcggcgtccgggtcaggccccaccgcccgcgccggctcccgctttgctcagccgccgcttttctctcccttctcactttctctcctccccacccagccctccttttcacctccaaaccctttagctgcgcgctgatcgcttctgtggctttgtttgggggtagggggagaatacgaatagacccgaggtgctttctcttggagctggagtccaatcccaatccctatctctatccctatccctgtgcttatccctgggcattagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacgg

SEQ ID NO: 5662 - DNA, 2406 bp, Homo sapiens
  source 1..2406: mol_type = unassigned DNA
cgggggaggggtatacgcagtttccgtgcggaaagatggtgtctttccttcacagggctgcgcgggcacccatccccgctgcaaagcgcccgggccaggcgcggcttgctccgggtcggggcgagctcgctgccctctgcggcagacagcgatgcgcgctccccgccccagctcccggctcgcccggcggcccgcgcgccctcccggtgcagcatgcgggcgctgtgacgttctcggataaatgccgtgtaactgtgtaggcgaatgagagctaaaaataagaacggaaaatctatcattaaggtatcattgcgccagcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtagctggggaagccgccgggagtgcagccggatgctggaattcaatgtgacccggctgactatgcaaagactaggactggacgcttttgcagctctatttcgccacccaccttcctccttccacctcgtattagaaataaagtggggggggggggcgagcctttggaggagaaaatgacaactggcacttaaccccaggtctacagtgcgccgcggtggggcgcaaagacgcaaactcccgggatggcgagccttcggggtttcattgggttaaacgaaaattgatctgatttgctttttaacatccgagggagagaaggggagatgaggggagggagggcagggtttgagtgtgtgcgtgtgcgtgtgcgtgtgtgtgtgtctggggagggggaggaggcaccaagttgcagcctgcgcgcggctctgcgcctcggcggggctgcgtgcgtgtgtccctgtccgcgctgctgaaacgggctcttcgagggatcggcgtcacatgactccgcctgcccctcgccagcgcgcagatcgccagtccctcagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacaggtgaggcgagcgtcgcgtcctgacctccctgcgtcccggccgcggccctgggggctcagggccttcggctggctgatggcgcttgaactttggcccctctactcttggcgccctaggcgctctctgcaccctcagcgagaggggaggcttgctcccagccaggcgagtgactgcggcgggcagagggggcagggattgagggcggggagtagatgtgggctgcggctgcccttcgccggacgagccccgtgggaggcgggtacagaggggccgacacctggagatgcagaggaagatggggtcctaaggaccagagacgatgagtctggacacacgtccagccaaaaatggtgctcccaacccccactcccaccgcccagccctaatagccccgatcgtctgttctacaccgggaacgtgtaattccccgcgcttaggcatgggaagggcaagacggaggcgtccgagcgctgccagcccttgcctcgccgcagctgagggcggagagcggtctgcgctagctcctcggagttgggctggggttatggggctacacgggtcggttcggtaccatcgagcggtggtgggctcccagctggcggccgccggagcaacaagcccaaagattcccaaggaccgctctgatgcgccggggctagggccagggctgctgcggaggcagcgggacgaagtgggcgcttctctcctcccccgccccctgcgccgccgccgccgccgcagtcgcggctatagcgctgcgc

SEQ ID NO: 5663 - DNA, 1218 bp, Homo sapiens
  source 1..1218: mol_type = unassigned DNA
cggactcacgccggctctgccacgtgttgcccgcagtctccgcccgttccctccgcgttggcaacgggcactgactgcccgatacctcagcgatcgtagagactttcctaatgccgggcgcaccaccggcgggccagcggttccgttggcttccctgacacacttcctacagtcatttctttcagctgagatcttcccctttaatacctcgttaattaacgtgtaaccttttggttaaaatgtcagagctaagactaaacctgaagaaaagaatgaaaccacaggaagttcttcagacttagtcgccagcaaggttatggcccgaagcggtgcaggggcggcgcgccgggaagctactggcagagctgtgcgcactggggggtgctgcaagcgctggggagagtgtggagaggctgcgtggagctgcgcgctcggggtgggagctgcactcccaatgaagcgcgtgaagggcaagcggtgatgggttctgcgccagtggggctgggagcgtgttgggggctgtacgtggggctgcgcgcaaggtgagaactgcgcatgtgggcttggggactgcgcgcaccgaaggctgcaggcgctggggagggtgttgggggctgtgcgtggggctgccctcaccggaagctgcacgctcggggaagcgcagaggcggggtgctgcgcgcgctggggagcacgtggggggacacgcagggggacacgcagggactgcccgcgcgaatggcttcgaacgcatgcgctccaccctacatttcacagtcgccatgacgaccgggaggtccgctcgtcaacggctagtcaacggctgcggggacaagtccgttgaggctgccaggcgagtcaggcctttctggacctcgcctgactcggatgggctgtgcctgaaattgacccagctccactagggattatgaagaaacaaggagtaaacccaaagccgctgcaatcttcccgccccagcccgtctaagcggccgtacggggcctcccccgcccgggagctggaggtggaaaagtcggccctaggcggcgggaaactgccagggggcgccaggaggtcctccccggggaggatcccaaatctgaaaaagcgaaaaggcttggagctaaaggtggtggccaagacccttctcgaccccttccagttcgtccgtaattccctggcgcagctccgggaagaggtgcacgaactgcaggcgcgg

SEQ ID NO: 5664 - DNA, 1848 bp, Homo sapiens
  source 1..1848: mol_type = unassigned DNA
cgcagcacgagtgccagggcgcgcatttggggggtgtcctggcggtgtggagagagaagagagagggcgcgggtgacatcacgcccgggcccccttcccctcgccgggtgggtggggcttcggcgcgccgggagggcgcggggtcaagtagggggaagaggaggagcaggcatgaatgtgtctgtgtgaagaccggggaggggcggaggaggaggaggaggaggagaaggaggaggaggaggaggaggcggcggcggcggcggcggcggcggcggagggcggggagggagcgcgcgcgtggctcgcggcgcccgggctcccccccagcccccgaccccggcccgcgacgcgccgcctcccagccgccgccgcccgcctcgcagctgggacccactccgggcttggggacccggcgggcgggagaagcgggggctcccggcgcggcctggaaggagcgagaaagcaaaagtaaggcgagcagcactccaagttttcccaacttcgccccctgcggcggcaggcgtcctgctgctcagcgcgtcccctccgagcccgagagtggctgaaagaaaagggactgggcgggggccggggcggaggaagagagagtgcgagggagcgaggagagtccggcaacatctgttaaaacttgggggaggaggagcgcggggaggaggaggaagaggaggagagaagggaaggagggagcgcgcgggaggggagcgcggagccgagggacaacttttccaccccgtgagtagtgcaggcggtgccaggtcggggcggggggcttctccacccagcacggggcaccaggccgggatgggacctttttccagaaagtcgattggatgccaggagaggcgtacggctgggggtttctttctttctctttcccctccctcccgcggttgaaccaaatcagaactgtcactcagggcttgtgagtcagaagggatcggattacacgatccccgaaactgatgccggagctgcacgagcgggagggagcgggcaggggcagcgccaccggcgcgctcgcacactcgcactcgcgcacacccgccgctcccactcacccgcgccgctctcccgccttccccgcgcgccccgcggccgcccgcgccgcaccatgcccgcggcgggcgcaccccgcgcccagcccggccgctcgcggtagccgtagccgcccgcggccgcgcggagcggggagccgccagcctgcgccccgtccgcgggtctatgggaagttcggggacttgacagccgctgccgccgcaggtacgtcccgctcgaagttctttgtttcgcggaccccgcagcccgctcctgcggccgcgcccgcgcctccggggccagaggtggtccccagcgtggggacgggatggagtgaaaatggctgtcaaaaggcgcccagatttagagagccgccggtgaggcgtccgagcaaggcttgcattcgctccctcctcctggaaggtcctttccgaagagtccgacccgcggaccggccggagacggattggagaatttcacctcccggaggggggacgaagtttgccgcagtggtggcggcgcccctcgcctccgcccccatccaaagggttcagaagaactccgcgagccccgcacgcgcctggctccttcctttgcgcggtggcgctctacggctcgggcttcgggcgcgcacggcgctcgggatgggcggaaggaggcgggaggcatggtgggtgcgcgcggggacctccgccgcgggggccgccgccgctggggcttctccagcccgggctatgcttcggagggcgggggtgtggtgtgagcggatggagagaggcgcgccttcgtcgt

SEQ ID NO: 5665 - DNA, 2119 bp, Homo sapiens
  source 1..2119: mol_type = unassigned DNA
cgcgggaggcagacagcgtccccgtccttgcaaccatctcgcccgcccgactgggaagacagtgacaaagttcgggcgcagaaaaggcagggtcagggcaaccgccgagtggcagcggcagggactagactgtgtttgaccttggcaaaccccactctttctgggccggaggcatgtccacagaagggtggccagcaaggctggaagagccgaagtcctttcccaccacccatataccaccctcgggtccgcagggttgggaggcgagcccagcacgcgctctaggtgcgcaggggaagagcccagcgctgcgcgcagagccggccttggagcttgccctgggggtctgctctcctcgcccactttcagtccctctgtggggatgggtgcggcaaaagaccggcggacccctctggccgccgtctggccgctcatcagctccctgaccttggccaaacctttctctctccacacctgtctcccctctccacacttcacgccaggggcgcttcgtggattgtaactctgaagagagccctggccggagggtgccagccccgactgcgtccccaactcgtaggagtgaccttgaacacacccccactcggagcctcagtgtccccacccgccgcataggaaaaagcgcgcccgactccgggcattcccagcatcgtcccagcaagtgtgtccgagaccagatgaggggtgcgcggctgcacttaccgtcctccagagacgtgggcgcttggcggggaccaaggtggctgtgaccagcaagtgcgacgcagccaccacgagcccaaagcctatggccagcaggctgcgcacgggcagcaaggcataggacacgaaggtgaccaaaaggagctgccaaaccccttgttcggcggtcgctggccccccagcggccccggcggaaccccgggcggggccgcccagcgcgaaaggacagcagagcagcgcgaaggtgaggctgaagagcagcgccagctggccgacctgctgcagctggggcacctgcagggaccggacgttggttaccacgagcagcgccaggaagaggacgcagtgcaccgggtgtgagcccttggccaggccgggcgcgggccccggcgcgcccagcagctcggccagcgccagcgcgcccgccagcaggctgagaacggccagcgccttcagcgtggccgcctgctccagccgcagcgtgtagccgcggaacagcgcctccagctctgggcaagcgaactcctcgtcgcacgcccggagcccgcgccggcggcttgtcccggccgcccgctcggcgcccccgggctcgcccgcgccgcctccgccgccgcctccgccgcgcggcgcccccgccatctcagcgccatgcagcggccgcggccgcgggcgcgcccctcgccggcccggggcgccggggcgcgggcggcggcgccggggcgggcgggcggcgggcggcgaggcgccggggcgcggggcgcggggcgggcggagttggggcgccggctgccccgcgcgcgcgcccggagcgcgtcccctcccgcccgccgcgcctgcgcactggagcccgcccgcgccccgaccgtggtcctcggcggcgaccgcgctgcgacagccgagccccgggagccgcgaacctgggcgcgcacagcccgcgccccaactccgcgtcctgcgttcccgcccgccggaggagccgcgtgacctcgagtaccttccttgtcccctccgagcctcagtttccccaccgtgcacagtggaacccaccctcttggcgtcacctggggagtcgaaaatactgaaatcctgcgaaattccctgttgcggggcagttaatcttggaaaatatgtgccttcccccactcaataaaaccaggccactagatttgagaggggcccgcgtctgactgcgaacccagggccctcgcccctacgagacggagaatcgacgtccaagaatccccggggtcaggaggaaggtggaggcctggggcgtacgtcccttccatgcgcatgagggaccccccgcccctcggcaattcttccctaagctctagggtcgcggagaccctgtgggcgggtgcgggctgcgggagctgtgctggggaggcggcgg

SEQ ID NO: 5666 - DNA, 562 bp, Homo sapiens
  source 1..562: mol_type = unassigned DNA
cgggccgccaggagggggagggggacgcgcgccgccgggcccgccaccctgcacccggggccgctggtcggtcggggcaccctcacgctcgccccgctggcgagactggagggactcgggacatcgtaaagcactttccccagtgtctgggagcgcccgctgtacgctcagcttcacgtccctggaactggggccccttggctcccgggttcaggctccggccccaggatgcgagtgcccacccgagggggtgggaaaagttgatcctccgcaagggaggggaaggtgcaattcattttcccagacaaccaatggaatacctctcgtctctcttccctcccacctgctcacggcagaagttaggatggcgccttccatgttggcctgggtgcacacacaagtgcgtgcggaagggtggctgcaggcggaggtgacagcgaagcaatcccgcagcccgctcgacggctctttgcgtctcagacctctccctggcgtgtaagacaccgtgtgtctccgtaaaacgggaatgccacatctgacagcgcaccccttcgccctacgg

SEQ ID NO: 5667 - DNA, 1404 bp, Homo sapiens
  source 1..1404: mol_type = unassigned DNA
cgcctgtcctagcgcggctctcgggggaggcagcagcgccccctgcctcccggcctggcccctgcggccgcagcttcccggctctgccagggctgccggcggctccgcttgctcagccagggctgcggctcagaggaacgcgcgccggtgccccgggttgccgcgccgctggacctcagcctgcatcccgttcccctctccctgaaaaggcaccaggaaaagagagagggagagaagagttcacagcaggtaagtctggtttgggtcacctgctactccagtgggagggtgtgctggagaccgcggtgctaagcggggatagccgggatttgggggtggctgtgggtccgaagtggaggacgagcatggtttgggagataaggaaccgtcctgagacagagaaggctcccgggagcggacagagagtgggcgaaatcggtgcgcagtaatcgcggcgccagcttcagcgcggcccctggggcgcagtcccaccccgcctcagcagctgcggagccttctgacgagcctccgcctggcagcactgcacaaagttttcctcctgagacgcgtccaggaactttgctctctccctggcttcctggttcccccaccacccctcctggtctgggcagcagagagcgtctatgaatgtgtccccggcttccgcaggctgcaggttcatttggagacgctttagtcgggaacatccggggagtacttgaccaaagggcatctgcgccctcgctcgctcctttccttgttggtctgggagaagggaaaggggcaaggaagaaggaagggaagcgtggtggtttttgttgtagcgttttggaagaggaatgggcgacgcctttttcttcgccggggaatcgcgacgttccgtctgatggaagtgtgcatccttttagatttagagggaaagttggagtcaaacagcagccacaaagctggctgtctgaaatgtggttaaggcaaaacactcgggggatctctttgtagtagtgggcttggctcgctttggaaaggccggatttgactcgtgctgggcatttaaccaggagtgcggtccccagggtgtttcctcccggcttctgcccaacgagcctggagttaatgcgttaatgggctaccctggtagcgcacgggccgttttcggcactgtttctccttctctgatgactcgagttcaacctcctgggctgagttgctttgcctccgtcacagtgcaaggagggaagttgacaggaggaggagacgccgcgctgtggcagggagctttgggatccaggggactggaagagagccgcgcgccagcagctggggccgctggtgtccgggattccgagttatggggacaggagttaaatagccgaactttcagcgatttcgcctcgagcgaagcgg

SEQ ID NO: 5668 - DNA, 819 bp, Homo sapiens
  source 1..819: mol_type = unassigned DNA
cgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggtatctggccgctccaggagcttctctccccaaccggcggagagggcgcagcgggccatggggccccgtgtaggcgccctccaagcctcgctttctccaggtccctgccgcgcgctccgctggcaggggggactcgctcccaagtttgcactttctctgcagaggcccctccgctcggaaggggacagaactccccgggatgttctttcctcctaggagctacgcctgaccactttccctctcttttgctctccttctgccccttcttcaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaagtaagtgccctgcgcgcacccaggactctcgcgctccttgcgccggcggctggtagcagcttcgccagtttcccacgtctcgc

SEQ ID NO: 5669 - DNA, 1128 bp, Homo sapiens
  source 1..1128: mol_type = unassigned DNA
cgcgagggcccctagcggttcgcggcctcgggcggattcccagaacgagtgcgggccgcccggactggcagactgcgagccccgaggggcgcgggacgcagccggctcagacaaagaaaccggcgccagcggccgtccctgccgcccctctccttccctcacgcatcctcccaggaaaaacagggcacactgacggccaaaggggctggccttccccttcagacagctggacgggaggtgccctctgcggggctttgacgtccctcgcagaagagtcgcgggctcagcggtcctcgacagcgtccccgtcccgctccccggcgggcgcccctccctgtcctcccgggtgcgaaccgggcgctggccggggactccggggacgcgtgcgcccctcgccgcgcgaggtgccgccgagccagcccgagagggcggggggcgggcggggcggcgcgcgggggcgggggagcggccgggacacgtgtggcggcggcgggggggacgcggcgcccggggctttaagaaggtgtggagcggggcgggcgctttcccaggcctggccgaggggcgtcgcgcagaggcggcggcggcgcacggaggcggcagacgacgcgctctcggcgcccgcagccccggtcccgcgctcccgcggcccaaagtaactttgggagccgccgtctcccgcggaacttctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatggtaggtaccgcagcacctccgcgctcgccgccgccgggtgcgcccgccagcgc

SEQ ID NO: 5670 - DNA, 1128 bp, Homo sapiens; identical to SEQ ID NO: 5669
  source 1..1128: mol_type = unassigned DNA

SEQ ID NO: 5671 - DNA, 1128 bp, Homo sapiens; identical to SEQ ID NO: 5669
  source 1..1128: mol_type = unassigned DNA

SEQ ID NO: 5672 - DNA, 1921 bp, Homo sapiens
  source 1..1921: mol_type = unassigned DNA
cgggcgctgccccctgcggccccctccgccgaggcctgtgcgtggcggggttcccaggagcggcagtccgtgcggcctgggggcggccccctccccgcatcgcagcggggcgtgcaaagcgtctgcggctgtagtgtgggcgctcacttcacgtgctcggcggcgtgcgaggagcagtaatacttcttgtgggcgatgaaggtggacaggctgctgaacttgatgttgcaaagacggcagtaccggtggttgccgttgggcagcggcgccggcgtgcccttgctgggagtctggacgcccttgtccgagtaggaggggggcgccggcgggggcggcacggcctcgggcgcggcggccggggacgggggcgggccgggcggcggctcctggggctccgggccgaggccgtcccgggggccacgggacccgggctgcggggaggcggcgggggcgggagcgggcgaggggccgcggtcggccggcgtccgggcctcgacccccgggccggccaggggcgcgccgagcagcaggccgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcgggtcgtggcgcgaggcgcagtagtaccgcttgtgcacggtgtaggtctcgtggcggctgaagcggatgttgcaggcctcgcacagcgtgcggctggggtcgtcctccgcgtcgtccacggagctacccgggctctggctgccctcgctgccccggccgcccgcgccgtcctcgggcgtggccgcgcccccagccccctcctcgcgcgctccggggcccggggacgagcgcggcgcgtcgggttcggcgggctggccggggggcgcgcgggccgggccggggggcgccttgggcctgcgcgcggcaggcgcgtcctcgggcgcacggcggcctgaacagtagaggcgcttgtgcacgtagtagttgttgacgttgctgaaggtgatctcgcactcgaagcacgtagcgcccttgggggccccggggaagagcccggtctgcgcgccgccggcgcccgcgcccgcgccctgctgcagccggctgtgcaccagctcggacatcttggccaggatctccgaggcggggggcgccgcgtcgggcccgaacacgtactgcggaaggaacagggccccggccaggcccagctcgccgggcaccgggctggagcccggcgtggggctggacagctcggccttgaccctggccggggcggggctgcgcggcgacggcgtccgcgacggggcctggggcccaggctctccggggcccaggatgggggccgcctccggctcctccaccgcctccaccttgatgctcctgggggccgccgggggctcgctgctgcctccattctgggccagaggctccgctctggcctctccgttggtggcctcggccagggcctttctgtccagtcctggcgatggggtgggcgccaggcccaggtccgcgg

SEQ ID NO: 5673 - DNA, 2872 bp, Homo sapiens
  source 1..2872: mol_type = unassigned DNA
cgggtgtcagggcgcgttgcggcctcgcgggtgggcagaggcgcgcagaaaacgcgcgggtggcgcgcgcggccacccagtgggtcccgcccgcgccgccggcgccgccgccgccgccgcacgtgcgccgccgcgagcgcgaagggcgttcggacccgcgctctgcccgcccgcctgcccgccggggccactgtggacttccaggtaacagccaagtgagaagccctccctatcaccgaaaggtgtctgcgctcctcccacgtcccctcaccaagtgccgcgaggtgcgatttcaccccaaacccacccacaaacagccaggcgacctctctaaagcggaataaaagtaaaaccaggccagacaccgggggaagccggtcgtgctaacgcgtggacagggaaaggaacgcgatcaaggcagcagtcatccctgtgcacggttatcccgaagcgtcagtagggcccaggagtttcttgactccagaaacaggagtgtcccctttccatctctctccttcctggagaagtacttctgagatgaacgctgaagtgcccaacttagacgcgagaagcgtgcacttgcccaactgagtaaataaaggtcagcagttggatcaataaagtgtgtgcttctaaccgccagatgtttttactgttgtttctcctcccgaggttgggggtgggggtgcggggaggaaggggaaaagacaacaaacaattaaaaagaagagagtaaacaaacacacatctggtgtttcgacacacattctcctccagccgaggtctctccggacgaagcaacattttgcattatccaaactaaaaatcatccgtgagccaacagcaaatctcccctctccacccctttttcccccatcacaaagcaaaatgaaagagaacaacaagtggtgatgctgggtccggaatgcgaccccaacgccgagcccaaatttgacacatgtcacactcgccccggcaagcagggcgctgcctttggggcgaaactttgtcgccaccgcgggaggagcgcggagcagagtaaagtcgcagctcggcccagcgtggaggtggctgggacagggtggggtgcggaggtgtagcgcgccagagtgagggccaagaaacttaccgcgaccggggacgccgtgggcagcgtcccgggaggtggcacccgcggcggcgaggcagaagcccccaaacaacacacccacgcgcgagtccgggcagctgctgccgcgagtggggggcgcgcccggggagggggggggccgaggaagccgcagccagcggacgcggccgccgcataaataaccggggcgggcgttcgcgggcgggctgcgggtggcgcggggctagagctagggcgaagcggcggccgcggagctgcacgcgccggcgtgtctcgcgctttctcggaggctcgcgctgtctcgcgcagccgctccccccacccggatctgtgtgtgtgtgtgtgtgtgtgtgtgtgtctgtgtgtctgtgtgtgtgaatgtgcgctggcaggcgcgcgcacccggccgcgcgcgcgtgttgttggcaatgcgaactgtacacacactgctcgcggggctgcctctcctcggaggggcggggtgggggacaggacgccgcagaggattctgaagtaccgccggaccacttgtttgttttgttttactttgcgttgttattgtcgttgttgttgttgataggtttggaaccagctggttaggatgcctttctcccccgtccacctatctccccccgttccctaacttctttaaggagggggaaacgcggggaagaatattgttcggatttgcagcggagcctcctggctgacgtcaggtccacctgctatgtaaacaacccgctggagaacttgtttgtgctacgccagaccttcccccacccccacccttctccccacctcctgctccgccttctccagctcgccccagacggcgagtcagggaagggggtggggagggaggcgagaacaaaaccgtatgctgtattggcaaagccgagttgtgtctgctgcttcttggcagtccccaaagtacgtcctctcagcagacggagctgctggcaaatgaaacaggggattccacttgaagtgcagaaagcctcgaagggatccaaagccctcggtggcagggagttaaaagtacatggtagtcggaaagggagacccgagcgtgcgttaaagcgctgattggcctttcttttcacggtgtgcgcctctgcggcctggggtggagagaggccgagtgtctttctcttcattgttgccctggttcctgtctcacttgggccaaggagttctcgggcttcctcgtggtcgcgcagcccaggtcaccggggcgcggcttggaaggaaggggccgccaagctgggacttagagagtctgaggttttcgggaagggtcctatcagtgactgaggggagcaaaagtaaccggaaagaaaggaaagaagaaacggtcagagcctgctccgcgcgcacttcaaagccgaggcgcccgcgtgggggatgcacgggcccagccgccagccctgggtcccggcttctatccaccgggtgtgacccggctgggcggcctgcttgggacccagggcggtgacaggggaaaggccgagggaggagagagcgggccccggaggggacgcacgaccggaatcttggcgaggggcttcctccggagccccagcccagaggggggccagcgctccctccccgccgtctccctccggtccctcccctgcccgcgggccgggcgactcttcgccggccgccttttccgcgcgccgcagactgagcccgctgctttgctcgcaagtcagtcgcaaagcgtggcgttccgagaggcgc

SEQ ID NO: 5674 - DNA, 2906 bp, Homo sapiens
  source 1..2906: mol_type = unassigned DNA
cgcgccccgctctccctggctcgcccgggcctagggcgccgcctgcagttgcgcgcggccgcctctagatggaactttctcaccaacgcaaggcccggccggagcagctacccgggagctgggcggcgaggggctactttctctcattccggcgggtgcaggatcggggggcctgggcagtaactagtggggaggagcgctggactgtgcacgtcgagcccggcaggtttccgcatgcggcatgcgaagggaatcccgaggtttccctgcagaacccgagcacggctcccccggagtttcctgccccgcgtctgcggctccttgaatcatctcaataaaatgaccgtcccggtagccacccatgccccttcctgcgcagtgcccgcagcggaccgcgctgtgtggtacctcgagccctggggactctgttgcacgcgtccctcagaccctcgggggcggggagtggggagacaatcgccagagccgcggggcgggacaaatggcggaaccgccgcgcggcgccaggcaaactttgcaagggaaccgcgcggcttgccggctctactttaagcattcccgaaaagaaagcatgtggcgggacacttgtcatctaccatgtgttattctcggtgacgctttctggagctgtgttcaccggggacccgggctcgcgggtgctgcccgctgtgctcgggcgggcgtcgcgcctccccgcgccggtcccgggctcgccaggcagccggagccgctgggctcctccacaaccatattccttcttctaccgctcccgcttcttcccaccctctcactctgtagttgggtcctcccctttttcttgggggcggggaaggggggatgatttttaaaaatcagaactattgacatttctggtctcctcgtcgcttcaggctgaagagcggagggggatccgcgggccgagggtccccctccctgcccgcgccagggccgctgggtgacaccgaaatccagaggctcccgcccctcgggggttcctcctcccgcttcccgaggtgactggttggcgcgaagcgattggcgatcccgggcgcgatcctggccgcggctccccgcgccgcgccgggtgaatggccgcgggcggaggatcgggaggcgccgggcgcagaccaatcgcggccgccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggtaagactcgccgcccggcagcagaaagcggctccgaggaaagcaagtgccgaaccacgggacaaaaagcccctggcccccaaacttccccaaaacgccctgcttgttggaaaaggagaatccccccgttttattcccctttccgttttcttctctaaaacctttcagcggacagccaggtgcaccattccttctcatatcactctagtgatttgtttttcctgagcacaagtagatggccctgcatgtccgtagtctgtgagagaaatagcgggcggaggtgacgggaatggggggagaaggagagtgggcaccagggggcgaggggctggccgggcattggagcttgattgggtgtctgttgattttacgttgcaaagaacaaggcagccacccctcttgtctgcccatgattacattacagtaaagaggttcagaaaagagggagactttacccggaactcccaaggcttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggtaccttcgtttcgcgaacctaacaggagggatttctgaagttagcggcttccgggatgagtcggggtaacccccgccctctgagcgtgggctggatggatgtctaaccaggatctagggaggatgggggtcgcgggggaagccgggcgcttcggggtcctcgacacccacatccccgcacggcgcacgctctgcctcgagtttgcgttctccgagttagcacggcgagcttgggatttccgtgcccctcttttgtggctttcgagaaacgccggagttccgtgtcctgctgggggttggggggatggagaaaaggtctcggggatcttgtttaaaaagcaaaggcaaacgcaccccaacagctcctcggtagctcccgcggctggcgcggccccagtttcgggcggccccgcgcggggcgtgggcgcgggcgctcgggcggccaggtgcggcgggggcggaggctgcatccccagcgcgccggaatgccccggggcgcgggaaaggcaaaagcagcctggcgctctccccacggccccagtctctatctacccagaacccggcttcaacagcccaaggaactgagaagaaaaaggaacctgcgctgggaaacaggggctcctggcgggctgagtggtcgctgttatggtagagatagaaacggagaggtagagatggaccgctcagccatgccaagcgcgaagcccatccgcccagccagaaagctcggatatcccttgagcttcgtacagttggtgaaaaaataacagaatcaccaaaaaagaaaaaaaaattcccttcgtctgacacgcgctcccttggtgcaaatgaaatgcggagggacacgcgagtcacccagttgcgcaaaaccgcacccccgcgg

SEQ ID NO: 5675 - DNA, 2906 bp, Homo sapiens; identical to SEQ ID NO: 5674
  source 1..2906: mol_type = unassigned DNA

SEQ ID NO: 5676 - DNA, 1696 bp, Homo sapiens
  source 1..1696: mol_type = unassigned DNA
cgaaggaggggctggcggcagtgcagcagcgaagcccgggctctcggtcctgggagcctcgtggccccggccgccgtcccccgagtccccaccacgcagttccgaactccgaacgcgagtccgcgccccgtcagcagtcagcgggggtgaggatgacgcgggccgggcgagaggcaggccaaatgcagcagccccgccgcgggccgccgggcccctgagccccgctcttcagagccagggggccccgggtgcgggccggagggcgggggccggcgcgggctctcccgccgcagccccgcgccgctccagcctatcagcggccacccaactgctccctccgaccggcccaaaatagctgcgaacgcctgcgacttgcgcgcggcccctcacttgacgctcactccggctcgctcgcccgctcgccctggccccgctccgctcgtctagagggggcggggaggaagcggcccggggaggggggaggggggagggggagagaggaagagaggaggaaggaaggaggaaagaggaagacgggcggccggaggcgcggggctgcgcggcgccggccggcgcggcgctggaaggcgccggcgttaaccccgcgaggcaggcgacggagggggagcggcgctaatacataagagcactgcatcacgctaatcttctcccagaacagtatgcgtcagcagtacattcacgttctgactgaaggacaaaaggatgagagagcagtctgcgtggctgccgcctgcaacaccgcgagcccggcgcgaggaggagacggtgggcgccgcgcgcaggggccccgctgctgctgctgccgccgctagccagcggggactatgttcctgggctccggagcgtttcccgcagccgcgacccccgctgctcacgccgctgcagcagtccgctggcggcgcggccactgagggcgccgggagccgaagccgcgaactcgctccctccgcacaaagccggagccggcggcgcgccgggggccgggcagcggcgggcggcgacgggcggttgcgcgccgccgggggctgcggccgccgccgccgccggacccgcgcccgcccccggactctctgaaggggcctgcggtgcgggcgcgaccgcgggcgccgcgcgctcctccggccggcggaccgggtccgagcgcagccgccacgccgctggtcctcgggggccggacggagcgccgccccgcgtgccggcagccggcggactggagaactgaccccccgtttttgtctcttccaccctccgagaagaggcgaggagaaagggggtgtgtgtctggggagggcgaaggcgccgcgaacacctcctcttaactctcgccgctccgcgagctcacgaccgcaatcagctgccgccggcccggagcggccgacgccgggagagggagcgcagcatccagcgagtgcggcctgggcggcttcggggcgcccccgcactccctccggcggcggcccgcagagcgggccggggccgccggagcgcactttggcgatgaagcgccttcccccgcggctggagcgagccggtgccagggtccaaggacaaagccgggaagcgctggtggcgccgctccttgggcggaggggggggcatgcacctgcatagcccgccgggccttggctctcccaggcgcgcctcaactccgcggcttcgccggctccggctccgg

SEQ ID NO: 5677 - DNA, 2054 bp, Homo sapiens
  source 1..2054: mol_type = unassigned DNA
cgacggccagcgcccagagctgcaaattccgaggcggctgagcgcctccctctgagcgcgcgccgtgcgctccggtcacccatgtatgcccctctctccgccccacatcgccaccgccagggtagctccgtgcgggccgaggggacccaggggggtgtcggcaaacgttggtgcggaggagagccggcaagccgggcggcggcgggtgggagcatgtagggaggcgccccctgccccctctgccggccgctctccctcgctctagatgtcagccgcgagctccgagccagcgagagcgagccagagagggagcggcggcgggcggcgggcggcagggaggagaggaggcgaggcgagggagggaggaagggaagcagggagggcgggagggaggagaggaggacccagagagcgccaggcagctggagtttttgcagcgcttggccgggcttcaatgcacagcagcagcgagccgcggcggcagcaggcagcccgggagctccggcggcggccgagccagcggcggccccgctccctgccccctgcaaactttgcgagcagcccgcccggggggccgggggcgcgcccgggaggcccggctcggcccgcggccgagctctccgccgccgcagcgccagccgccgcagccaccaccgccgcagccccgcgcctccccggggagcagccggcggctcccgcggccccccagccccggccccagggcactgcccggcgagtgtctcggcaagggtgggggctgccgcggcgcggccggccgcgggctgccggggggcggccgccgctacccagagaggcgcgcagaggcgccgagagcgctccccggcgggtcccccgcgcactcgccgcgcccgggcagcggcccgaccgggcgagcatgggcggcgcggagtgacgccgctgtgcccgcttggcatcaaggacattcagcccgcgggggtggggacgaaggggggcagcccggcgtcgccaccgcagcccccgagagccgccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccaggtaaggagccggcccgccggggagtggggccgggcgggcggcgagggcagcaaggtcggacagacctgggccgacccgggagtcctcagtgtcccggagccagcccgcggcacacgcacacgcacacacgcaggcacacacacagatccacaccggcacacacggcgctcgcgcacctgcccacgtcccacctggacgcccgcggaggtgcagcggccggagcagggatttcccgggtgtgttctcctctcacgctcctggactcagacttctctttcccgggactttcggggtgggattctgtgtattcccggctctgcctcccacccggggaggttgagggagcaatttttcagctcccagcccctttcgtccctagctgggctttaaaatgggagaagtcctgagaggtttccggagacctacccagtgtcatcgcggccccgtggcctttggacaccctgggatttcaacgggagacagacccacagatattcggacgcatatttggagagagtggtggcccagcgcccggggaggaggccagataggcggttggggctgcagttctgtagggcggcgcatatgaaacagacactgcgtttccccagtaagaggcagcacaaacgcctttctgaagcgtggcactgcttccccgggaatgcgccgagatttcaggcagaaagcggcttaaagcatcgccgcgt

SEQ ID NO: 5678 - DNA, 1258 bp, Homo sapiens
  source 1..1258: mol_type = unassigned DNA
cgaacaacgcagcggcgccaggcgccagggtcctcacttctgcctcctggatttcctccgcctttctgcttcaccgagggccctgtgatccgattccatcgaattaaccgctgtttaccgagggtctgctgcgcctaaggaaggcaccgggcgacgagcaaggcggggacgcagtttggggacgcaggggtccgggccccagtccagagacaggaggtcggcgcttcgacttggcacccgccgacgaattcactccaaggttcccactggcggagctcctgctacctcccccctcccctaaatgcagctcccgctaccttcccgcgcccaggggctgctgcctgagcccagctctgctcactggagggcggcggtggagagggtgctggcccagcgtcggcagctgggctcaggaccaaggtgggcgcccgccggtcctggtccccccagcctcacggtgcaggacccagggcgcggccactcgagttccccggacgctctccttcctgatgctcgctgtccctgccctggcgtccccagcccggggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggtaggtgcggggagccggcagccgagacaggtgcgccgcggcgggagacccactcttctacccagcaaggggcgcttccgcgg

SEQ ID NO: 5679 - DNA, 628 bp, Homo sapiens
  source 1..628: mol_type = unassigned DNA
cgcggtggcccccggttccctcccaccccaccccacgaaccggcgtctggccgccctgaaatgaatgactccgccgcgtcccggcgccgcgctcccagcgctcccctccgggacagcggccaaggtgactctgaccgcctccgggtcgcgggtcgggcctgggcaggggtccctgggccaggagagggaggccgctccgcgcttaccctccaaggccgccttccagctggtgctgccctcgtagcccgacccggatcgccgcagcagcccctcggggccgcgggcctcagcctctgcgggcgaacgcggcctgggggcggcgggggcgggcgcggggcgcgcggcgaggggcggcggcggccgggcccgcgaggggggctcccgggccggctccatgcggggcgctccgccgcgccgcgcccgcgctcctgcaccggggtgcggggcccagcccgacgcgcactcggcgctccgcgcgccctgcgggccccccaggccggcctcgggtgggctaggaccgcggcgctggcaggccggggctgagcccggctccccgcgctggagcctctgcgccgggtgccgccgcggtgcgctcagcgcctgccccgccgagccgcagcctccacgc

SEQ ID NO: 5680 - DNA, 1075 bp, Homo sapiens
  source 1..1075: mol_type = unassigned DNA
cggaggctcgcccccgctaggggtcccgggggtgcgtgatcatgaaccccagagggctgggctttgatttgagtgccgatccgttaatgaggacgggaggataaggttgccgacgcagcggaaggtaggggggaagcgactcgaggacctgacgattatccccaggcaggggcttcccaagcaggcacggaaaccaacttcaccaaaccgcggagtggggactgggcccgggcggtgttcagcagggcaggggcagggccagctggcgcgcaggcatctgcagggtggagcagaataaccgtggggacccgtttctctggaggggcactgtccacttcccatatgagcctcaggatacccccgtggggcggagtctcggagacgccccaggtcacgctctcgccgccccatccctgcttgcggggggccgagcagggagggaggcccagcgcgcgctgtgtgtccgcagtgttcacgggcagcggggacgcttgcgcccgggccttcgacgcgcagtctggagagctgcggagggtgttccggggccacacattcatcatcaactgcatccaggtaggtccctctgcccttctcggggccgccgcccgtgggagggaaggtgccccgccccgatccatccacgcgggcagcggtgtcccccccgcctaccgcgtcaccggtgacgcccgcccctgcgcccgcaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgc

SEQ ID NO: 5681 - DNA, 5566 bp, Homo sapiens
  source 1..5566: mol_type = unassigned DNA
cgaatcagtcctgccgctggactcctggccgctgcccgggccggcgtcagcttcacacaatgtcgcgtgagtctttgtgcgtgtgcgcgggggaggttcgagatgttttcctcccggtaagttcccgcgccagcaccgccccccagctccgcgggcctccccgcggcgagccgggacgcgtggtccccgcgggctcacctgaagaaggccggtccgagtagcgcgtacagtagacccacgccggccagagcatgggctgcgcgcccaggttggcgccggcttgcgagctgtccgagtccgagctcaccgacaggtcgccgccgcccaagccgcgggccttgagcgacccgtccagggggccgccggggtcgccgcctttcttggcgccaccgtgcagcgagagcgtcttggagccgccttccccgtcacccggagagtcgctgccggcggctgggagcggcccgcccgcgccgggcgcacatggcgggttctgccggggctctcgggagcccgagcccaagagctgctccgagccgcccgcgccgccgcctccctccgcaccgctcgcgccgccttcgccgccggctccgccgccccttcctcctcccgcgcccgcacagcaggtccccgcgtcctttcgccggccgaactcgggccgcaggatgttgtcgatgaagaagttggtgatgcggtgcgggtgctggtggttgccgggcgcctgcaggaccgcgggcagcatcagagcccgccggcgcccggtgtccgcttcgcccgggctgctaccgccgccgccgcccgagccgccgccggggctggattccggctgccgctgtccctccaccgccgccgctgcttcgccaggcttggggtcattctcctccatgctgttcacagtaaatcccacactggttctccggggacgcccttccaaatcagccttcggccctcccgcggcgcacacggagacccccgcgcccccaccccgccgagtcttccgagggcgtgcgcggcggccgcggccagggctgaggtcctacaagtcgccggccgcgctcggcgcggagccacctttgaatccacgaactgggttagaaacaccacgagccgccccgctcgcccagacgatgagagattcaacagagccaagtcctcgacttcgccgcgcagccggggtctagacagtcgcagtggtccggcggggacgcgggccgcctcccgggctccccgctcctctccgcgtccggccgcctcgggctccggcgccgccgcctgggccgcccggggcgagagctgcgcgcatgcaggcagcgcgttccccggcgctcacgcccgcccgggccggctccggccgccgccgccgcccggccgtccccgcccgcacgccctagccggccctcgagggtgccgggcgcccgcggtcagcgcgcccgccaccgcccgcacgcacatggaggccccctcctcgcggccgccgccccgctgcgggccggggcgccccaccggcgtgcggccgcgcccccgccgagccccgcagagctccgcggcccgagtcgcatgggtgagagacgcgaggccagggcccggccgggccgggctgggccgcccgcgctccccggccgtccgccgccctcgccgcctcggcctccgcgcgggctcggaaatttccaggccactcggcgcaacctgagacactttcactctggatttttgttcttatttttaacagagccccctcgagtgacgtcgcaggccggtctcctggacacgtgcctcgggccaatggccgcggcgccgcgcgcccacgtgacgctccggccgccgctgggtgacaggagcagcccgccgcccctcctccccttaaagcggccgcgtcccccgctccgggtgcgggagcccaggaacccggagagacccccgaccgcgtctcctgcgctcgcccgcgctttccctgtcgcttcgcggttcaggggtgtgagtcacccggcgacagccccgccaggtcaccccggggcgcgtaggtggacacgcacaggaagatcgctatttttaagatttccatattgtttaccgtggggcgaaatcccacaattccttgcacaaaatgcataaataatattaaatgagctgccgagatacaaagggacttttgtggtccgctttccttgctgatggagaggaatagtgtcactcccatttgactcggtaacccggcagcttcctgtcttaaacgcagagctggcgcgcaggacactcctcctgcagacacttattgtaagtgtgcgtgtgtgtgcgtgtgcagggaggcgcgtgcatacggccgcattccacccggggacagcgaccctcatgaaacatgcttagcgatccgaaagagcgggggaatgcagtatgcggctccatttgcgaagggagaaatccaggagcctcggaggttctaaaggaatcctttttgccaaggagaggaggggtgactgttcagctaagacttcaaaaccaagtcgcccgcccccctctaacttctctactctgattgaggagctcccagaccggtcatctcgttttctttgttttaaaatcctttaaactaattttgccggagagcagggcccatttgaaacgagaattaggaatccaacggcaagggtgggagccccagttggtttctcccctcctctctcttcatcttttctagactttccttccagctgttgtcagaatgtccaactggaagttctgtttcctcttctcttccccctcctccctcgggctccttcccatttgctcttgtctacccaccaaacacccgttgttaccccaggctcgcctgtccatcatttaaaatgcatttttatggaaatgtgtgaattcctggaaacatccgatagggcagctctgggggtgcgggagcatttgcacgccatgagtaccctcagtgcgggggaggcggggaggccgcagcctggcacggacaccctagggctgattggccctgggcagctgcaccgtgctcagcaacccagacccccgcagaggcagccagcaggttgctgccaggccctgagtgaacttggggagtctggcaagcatctccgaggcagcgtggcctgccaggccacctggggcctgaaggttgcaccctggccttgcgaagctccttccccagtgtccatcccacgtgctgtccttcccctgcaggcttcagagtgctggctgggctgggatgagaaacgacagttcccacagctgctcccaggaaaattacccccccacccaggacgggaatggtgggggaggaggtgctgggctggcctcctggccactggacgtggctctggtcagagtgtgccctctgtccggtgtgtctagggcagggtggggaagcctcttctcgctggggctggattcctccactttttcttcattggaggagtccttaccaaatgttctggctaggcacacatctgccaggggtcctccccgagtctcaaaaaatcaaaccccacagtctacctgccccccgggaaaatagggctggtgagagtttgtgggaagtcttattgacgcttacttggttttttggggggagaattttctgcaactctggaaactctgatgatcaccagtcaggaaagggagggtccaacgactctgggtctcctgaacatgatattggggggaggaggggccctgagctctttggttcctgcaaaaccatcccaggttaatggctccacctgtcccatgaaagccaattaggcggcttcctgagaagtattttctgaattcttgggactctttgcctctgactgcctcagtataaatggccccaagacgctgggcttcagccctgtgctttcctgcgacccagaccccaattcgtggctgcaacagagactctgggaagcagagcgtcacctccagggcgcctggcgggccggtgggcagagacctgccctcgcagggtctgcgggctgggccctggggttggctggaggaagaggaattcgtgggtcgctctcctggaaaggaggaaggtgagaggtggagggaggaataggagaaagagaaataaatgaagagagagataactagagggtaccgggccccccagagtggacccaaacacgaaacaactctgggaaagcggtaagaggggtcaccgttcaaagggccggggaagctgggatggggctgcagaaagttgagctgcccaggggctgggcggtgctgagttctatacacacggaactccgcaaggtgtttcaggaagcttcgagaagcgcgcatgaggaccggcctcggccgcctgccccagctgggacggcgcctcgcgctttctggggatgcggggcagtggcgtgtctctcctctgcgatgccagccccggctgccgcgctcccgcgagcccagagcctccgctttctcccccgaacgaccgccgccctcaaggtcggcctttctgtgcggatcagacgagccctctccggacattagtttctcccgggatggaaagtggggcactgacccgggaaccccgttttccctctagcttcacccaggaatcggagagcgcccgcgaccacccgcttgcggaggacggtcctccatatttctcaggctcgctgcacaaagaggggcctcggagagggcgagcaggaaagcagcttccagacgccgtgcgcttcaggacacggacgctagttttgcaaacaaaacctcagtgaagcgccccggagacaccgggcgcccggatgccgagccaggctcccgtttttatctgaaaacgaggccagagaagggtgacttttccggcccctctgcgtcccctccactcgcctcgcttctctagcttgacgtggtgacacttggaaaaatggactcaatgaaagccgttcgctcgcggcggtctcgttactcgcggggcagagacgcccaacaatccctgagagcgagatctccacctcagccaaagcaggcctggccagccctgcgccctcggctgggagccgagccccgcagccaagccccaggcgccgggcggggaattggggccgataggagagcaacaccttccccggggcgagcagagagccaccgtcggctcctggggctgacgttccgacccggcctgtagacaaaggccgaaacgaaggggcgcggggagcaggggtggggcgggcggggccaacgggcggacattgcgtgtctgcgctctcctctgggcgaaggaggaccggcctacaggcccaccgggcgagctcggggacggggtctgggaggctgggtctagggtctgagacttcttcagaataacccccggaaggagggggttaaatgcggcagcggcgggcctgaaaagggccaggagcgtcgtaggaactggggtgcacaggccctcgcgtgcccagcgcttcgcctttccccgccccaggcctgccaggggcgcgcgtggcgcgggcagagcctggtgggtgggttggcgcggacagaagctctgccggggagcggggaggggggggcagtcgcattgcacgtcctggttctgccccgatcgctggagaagcgc

SEQ ID NO: 5682 - DNA, 5566 bp, Homo sapiens; identical to SEQ ID NO: 5681
  source 1..5566: mol_type = unassigned DNA

SEQ ID NO: 5683 - DNA, 1164 bp, Homo sapiens
  source 1..1164: mol_type = unassigned DNA
cgaacgcctggaccccagcgagcgggcggttccctggcggcggtgaccaccgttgtgctcgctgcctccacgcggcgcccgtcaaccccacgtgctcgcagccgcgcggcggggccgggcgcccggagctgacctcagcccccaggacagaaagggtggccaaacgcagacctggcaaccccccgagtcggcgaccacagattgctggtggctgcgccacggtttcgggagggtcagcccctcgctgggttctcagggcactaagaaaagaggggcatgcgagcctggaagctggagagagtccggggctccccagagcgggtgggacgccgcgtccccaggactccgcgccacgcgtactttctccaccccgacacccactgccactcccacagcggagcgaggggccccgccgagggcgagcgtaccccgtgcggctgagatgcccggaacgcctccccgcgccccggcttccccagaaggggccacagtcggcccgcgagtccccgggcgggggctgagccgcagtgccaaccaaggcgaggtcaccttggcccgcgcgcctttcattccagggcccctccggcagagaggtgactgcaggtcaccgccagccgggcccttactccccgcctccgccgtcccggcccccacaccccggaacctccccggcggagcctgcgagcccgggaacgcggtcccagccagagtggaagggatagcgcgggaacccggcagagagaaaaagcgggaactgggcgccgccgcttcacgatcgggaggagattccctcccggcccctcctggatcccactccggggaccgtttcggggctagagcccaggctgggagagtccctgggcgcatccaccgccccttccaacttccttcttctcatcctcagttcgggtggcagtggccacccgccgggtctgcaggtggaggggagtttgcgcgcaaaacttacggtcggcggcggccacccctccgcgggaggcggtcagactctggagccacacggccagagtcagcacgagcagggctttgctctccatctcggggcgcgtccctctggaggagctgcaaggcgcggaccgactgatgagccggctgagccggaggctggagagggctggagccgcggtttggcgctgagcaagtcgc

SEQ ID NO: 5684 - DNA, 1495 bp, Homo sapiens
  source 1..1495: mol_type = unassigned DNA
cggcgcgcactctacatcgcttgccctgtgccccaaaacgccgaagctaacttcccacgcggcctcttgctcgaccacccacttctgcgctgccaggcacaccgaggggaccggctctccctccaggcggcccattccagcgtttcccgctagagggcacacggcccccgtgcaaagcgcttatggcgcggggcacgcgcgcacgcagcctcgactcctatagcccaggtcccactcccgggctgggctcagccgctaaggcgctggggaggggccgtgccagggagcgaagcgctcccgggactctgggagggtgcggccgggactgctgtcccttgccctgagctctgggcgtaggcgcccggtaggactcggcgcccaggtgagcggcggcccccaggaggggaagcaccgcgcgactcaacgggcgctcagagcgcagggcgaagaggacgggcgagggagagggggagggagaggccacggcatccgaggaggaggaggagtaggaggagcaggaggaggatcgtggggcccgggccgcgctgcgcacccacctgggctctggctgcccgccgcggactccggcttcttgccggagcctcgctccttcttcttgcccttccctttgcctctgccttctttgcgctcggacatctcgccggagacggagcgctctacgcggacggctctcggcgcaggcgagtttggtccaagggctcggatcgggtttgggaaaagtttgtccctcgagggggagagcgagcggccgcgctgaggcgctcgcgctgcgcgggggcgtctcccgttgcctgcagggagcgcggcgcggacgcggcgggcggtccggccacctggaacgggcgctcgccctggctctcggggctgctcctgtcgccccgggaagtcgtcgatgggtcccaccgctggcggctcgcgtcctggcctctgcccggcgccctcgcaacccgatcggggagaggttatcaccgtcctgctcacgctcccatcgtccggcagccgccgccgctcagctcctggcctccgcgcgagcccggagttccaacaagtttcggggaactcctcgccggctctttttcaattgccccgcagccacccacctcccgcccgcaggttggaggcaggcgcctccttcgcaccctcccctggcctcgccccctccctcttccccaccacacccccaccccgaggcgcggacacgccaccgggaggagcctgggctcggcgctcccgggcgcagccccttttcctcccgcgctggccgggcggggggtggcggcgcggctgccgggaacccccgacaggggtcgctggacgctgcgcggagaccgaggccagcgccccggagacccgggaacccaggcggagacccgaggctctcgctgcccgctcccctccgcagccaggcagcgcctgggagggctgctccgtcccattccacgcggaaaaggacggcgcagagaaaagtttgcga

SEQ ID NO: 5685 - DNA, 352 bp, Homo sapiens
  source 1..352: mol_type = unassigned DNA
cgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgc

SEQ ID NO: 5686 - DNA, 1141 bp, Homo sapiens
  source 1..1141: mol_type = unassigned DNA
cggggaccaggcggtgtgccgctcgggcagttagtgggccgggcgagcctgcggggctggaggggacgcggggctgggaggctggggagctgggggctgactccgggcgggcggggcggggcagggacctgccggcctggggcgggcgcaccagacgagctctccgcccgcaggcccccagcgcccagccgcgtcccggctgcgtcccgccggtcccgccccgccccgccccgcagagccgccgccagtagtgggagacgtgcgctgagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccataggtaagctttgggctttcgaggtgcagttctaggtagagctccgtgctgggaggtgggaagggggcttgaccctggggactcaggcagtctggggacagttccaccaggggccggtgcctagaattggtgagggaggcacctcaggggctgggggagaaggagcgagcgctcttcgcccctctctggcacccagcggcgcgcctgctggccggaaaggcagcgagaagtccgttctccctgtcctgcccccggcgacttgcggcccgggtgggagtccgcaggctccgggtccccagcgccgctggccagggcgcgggcaaagtttgcctctccgcgtccagccggttctttcgctcccgcagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccggtgagcgcggggacagcgcagcgctgggggctgggcgg

SEQ ID NO: 5687 - DNA, 3297 bp, Homo sapiens
  source 1..3297: mol_type = unassigned DNA
cgagacggacaggaatcgaggagattcccctgtagcgctctccaccttccggacagaaatcctgtagaccacgttcacttctccactccgtgcatcgcccgtggcccgtgggcagcagctgctcccctgggatccccctcgcctgtccgcgagctctcgcacggccgcgtccctgctgctggggtcgctcgctggccctggctgctcgccaggattttcctttgatgctgtcaagtccgggaagctcacgatgcacctcagtgcccgcgcgccgcctctcccaaagccccttccccactcactcccccacaagcgtggagggagatggggtaggtcgcggcgcctatagaccccctcccggcgcccactctctctcttccacttctctagcagcggtagggccgcagcgcacgcaaacctttccccaaaacgcccaccccactctcagctagccgcttctctcagggctcctccgcccgagctgggtgtggggatcgccgcgcacacagagacgggaaagccaccccggtcccggagcgccgcttccctagaggcccctggcccgtccgctcccccagcgctggaggacagccgcgcacacagaccctcccctccaacgcccaccgcggtccccagctgcagcctgcacctccacttcccgcccccagtctcccgccctccgccccctgctttccagtctccgcagtccgggcgcccagacttgtttcgacttcccagggcagctccgagggtgcggaagatcaagtgcccgggtttgttccaggaaaatcccggcggcgcctgcacgttaactgccctggcgcaggcgaagggtggagggcacttctctgttcattcggttttcaagagcgtgaacagaggctccgagtgaacgcccatacctagtcggtcttctagggtccacgcgtggggcgtccacttcctcaccctgcccctcggtgcccctgccctggttgcacttctcctaaaaggaggcgctacgattccaggaggctctgtctccttacccttcccagcggcgctcaaaccaccagccccgggcgcccaaccccttccttgtcctctccctatcccgtgagaaagccgacgcttccacccgcctggtctttccgaaatacgcttcgggtggtcaatgcgatttctagggtctaaagactagactcccgcgttccccaccaagacaccgacgcgaagccgcagaggtggaatcgcggacgccctggcaggcccgggacatattgatcctggtggcgcgatgcccctcttcgcacgcggacgcactcgcagccccactcccccaaactcgcactgcgggaaggaacccccgactcgcaccggctcccgccccgcagcaacggcgacaccctgaggtccggacgagcggcgcgcccctcccagcctcggccactttccagcacgaagcctcagggcgagcccgagacgaagaaagagagttcgaggaactgggatactcacgagcccaccgtccaccctgccggccggggaggaagccccggccggctcgcctccgtccgccgtgcgcatgcgtcccgcgggtgccttctcaatattgcagcgcggagggctgccctctctacgtcggcgattgctcaccgcgcctttcgcctttctccggctctcggtctttgctctagccctcttctcccggcctcttcctccccttgctctgcctcctccccgccccctcactccttttacccggccgggcaatcccacgtctcgcctccctccagcggcggcgcactccaccgccgcgggtgctaggggtacccccgaggccccacgcggggcgcgacctccaccccggccgcagccccactgctccagccccgcattagcaagtcccaagagtgtggatgcgaagccaggcgcgcgtagagggcgtccgcgaagccctctgtgtcatcgcctcccctcggcgcgcggggccgagcgagactagagtgtgctggactgcgtgctcggacctcgtgaatgaagggagcgggaggaaggagcgggggtgggcggcaggcatggagggggcgcttggtccccagagcttcgcgtctgtggactgcgcgtctctggagggcagccccctaccttctccccggcccggggcgcctctctgagctctgtccccgccccaccccggcgcagcctaggcctccggtcttcccgccctggaaagcggccctcgccccctcccagctagccagagcgcggaggccccacccagcaaccgagcgggggataagggggggaactaacccctgactccagatcccgctgagaccctcggcagtcgccctccgcgtccccttctccagggactccggagtccggggaaaggagtagaccagggggcagcgggagggggaacccagccgcccagctctccggactcgcagcaccgcgtgtccccgtagcccgcagcgtcccttcgggagtgggacccggtggggccgcggggttagttccctggagcccggagggctaagctgaagctggaaactgacctgacacaaaaataacatcacgtcatttcctcccttgcctgccgagagggcaggggagtgggagagcgagcgctgggagcaggcggaggcgcgtttgggggaggctcggagtaggcggaggagagcgacacgctgagagtttgaaaggcagcctcggggaagagcgagggctccctcccgttttcttggaccatggaaaggaaatggcccaggaaaaagtagcttggagtgtcttcccgcggggaggggcggtgtcccgggagccgccaatgtcccgtcctaggacttgcccagccacgtcccggccttcccgaccttgccaccctccctactgctagccccagcggagcgggtcagttggggttaggaagaatcgggagaggctggtgtcctggggaggctgggtgtggggcgtagtggagaccacggtactcaccggcataggcgagctctgcccagcggtggcgtcttcttccctgggcttggctaccggatgggggggcctcagcggacgaccccccgagggtcggccgggcagtgccagcgccgccccgagcaggagcgagaggcggcccggcagctcctcgtgccccctcgagagccgggcggccggcagggcgggaagcaggggggagaagtccaggcgcctccggggagcctcgggagggggtcgccggagaaggtgagagaagaaccttgcgaggctggaaagcgggctagaaaggaggccgaacagcttcggggcggcgggcga

SEQ ID NO: 5688 - DNA, 2213 bp, Homo sapiens
  source 1..2213: mol_type = unassigned DNA
cgaaggcgacgggtccaggacctgcagaaaccgctgcggtttggggcggtcggggacccacggcttcctggggcggctctgaacaggccttggggcgcagcgtccgctttctaaagaagcctgggatcgggtcctgcctcgctgcaagtcacgcttcccgtgagtccacaagtgcaaaaccagaaaagaatgtttcgcccaaataattaaagagcggtggcccccgcgggggcagcggaggcggtcagcagggtccccgtccccggggagaagtgcccacgatccaagggctgtctgctctaggaacttcttaaagaattacagacactgagagcattcggggtctggtaggaagtgcagtgtatctcccagctttagggtaactaggacagcatgaatcttttaccttgtggtagaataaacggctagcgcctcgatgtggcgcgctcgacttttcctcacagagcctaaaagtcacgctcaaccaaactgcagcgttcccgcctcagctgggcaccggcctggaagcggcctggaatcagactggactcgaggaggtaagacctcggcagcgcgaggttaaccacaggcctcacccgcggcctccagcccggccccaccgcagccggcggcagacaccccaaactctccacacgccgccctcagcgaggcgcctcggggaaagcagcgtgaggcagtgagccgaggggcggggccaggaggacgccccgcccccgagcccgccccgccggagggtttgattaatgaccctctaagccgcctcagcccccggcgtagcctctccggtgggccaggtcctccgcccgacctgccttagccggtcggagcacacacgcctggccgcggggcgcccgcataaaagtcacagccagcggaggttggaaacagccgtcgacttgggcatcggccggacgaggatggagtgaccagcgcggccctggccacacaggccctgctccacgcccctcgcccgccctcacgacggagcggagctccactcagccgctccaggaaaggtgaggggcccgtcagacgcgtactgcgcagctctcgggctcggaacggtggcgggtgccgtaccccgaggtgaggctaagggtcccccgctcctcgggcagaaatcccccctggcgtgaaaggccgagggcggctggtgagccgtggttttccgcggcgtcggcgagaaggagccgcgccacctctcgtgcgtgccgggttggataaagtcacccaagcgcgaacgagtgctgatcctgagctgtgcttccgagatctttcttcccgggtagagtagaccttttgcttaatttgcccctgaaaagcaaagccggcactgcgcctcttcttatccttctaggaagcccaagaactccggagttccgcaactctccccagacgtccggaagcaaatcgcgtcccaggcaaaacgagctcgcttgagagcgcccttagccccgttgggctgctggtgggcgcacggggagaaccagggggctgcgcctctcgggttaagcccgaccgccccccggcctcaccgcaccttcggtcctttgcagcgcgcgcggcgcgggaagctgccatggaccgcggccgcccagcgggcagccccctcagcgccagcgccgagcccgcgcccctggccgccgccatccgcgactcgcgtcccgggcggaccgggccggggccggcgggccctgggggcggctcgcgttccgggagcgggcggccggcggcggcgaatgcggcgcgggagcgcagccgggtgcagaccctgcggcacgctttcctggagctgcagcgcacgctgccgtccgtgccgcccgacaccaagctgtccaagctggacgtgctgctgctggccaccacctacatcgcgcatctcacccgcagcctgcaggacgacgccgaggcgccggcggacgccgggttgggcgccctgcgcggcgatggctacctgcacccggtcaaggtaagcgggcggggcgcaccgcggggctggggccgagaccaggacaccttgatctgccctgccagtcaccgtcttgggtagatgctctaattccttttcgggtgaggcgggaagccgaccgggagaacgacctcggcccgcgagggtactggtggcaaggtccccgccgcgaaagccggctccttcgcggttcacaggtggctggagaggcgtttaaagccgg

SEQ ID NO: 5689 - DNA, 363 bp, Homo sapiens
  source 1..363: mol_type = unassigned DNA
cgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgcccacatagtcccgctcggtcttctggagctcgctgagcacgcacacgcgcaggcgaagctgcttctccaggtccttggcgctctcggcgcggctgtctccgcggctgtcctcgctcatggtcggcggcggtgcgcagcgcggcgctgcccgccgtgctgagcgc

SEQ ID NO: 5690 - DNA, 960 bp, Homo sapiens
  source 1..960: mol_type = unassigned DNA
cgtagaaaacgctgcaggggccaggcgtccgagacaccccgcggggcagtgggcaccaggcccaggctccggctgcagagcggaggggcgtcgggcccaggaaaggggctgtgggtgggggtacgggggagacccgaggggtgctgggaagagggctcccctctccagcgccagccctggtgtcgctgtgcactcggagccgcgcgaagggcgcccctcgacccggaggcacaggagcgtttagagaggaaagaaagaaaaagccaccgctggctcgaatttctggaagccggagccgggttttttgccctaaacaccgaggcagaacccctcttagcgctgccccggcctctctgttacccattttcggtttgcttttggaagaaccggttcctcagccccccgtcgccgcagttgtgacacaagtaagtgcagccgcgctgcccggggcccgccagggtcccccgcgcccgctccccaccgtggctcgcggcggccgcgctcccgccccgccccgctcggccgccccgccggcttctgcctccagttgggttgccgtgacgaggagacgttgttgtgaaactaaatctgaccctgagttcccaggcggcggccgagagcccgcggctgctgatgcccctgggccccaccccggggcaggagggcggcgatcggcgcccgggaagcggctgaggggcgccgcgactctcagcgagcgccgcccgagccccagcccgcccgggcagcctccgaggcctagggcgccgccgccaggtacgcgaaagtcacctggaagggagctgggtgcgcgcaataatggggccttgagccgtggccggcaggggagaggtgcagccgcccaaggcccgtggcgtcgggcgctgcacgtggagggatgtgtcaagggccggtttgttttccttcggggaggtggtaactgattgggacgtcgggggacgg

SEQ ID NO: 5691 - DNA, 1404 bp, Homo sapiens
  source 1..1404: mol_type = unassigned DNA
cgcccgtccctcccaggcccggtgggaccagacccgaagccaaccctcgccaggcgtcaggtgtagaccccaggccaggccagagcagttcctgggtcttcggaccgggatgcccgccctgcccctcctcctggccccgcccggtctgtcacagggggaggcctcggcctcgcattccgggcagcgaacttcgccggccgaggttagccccgtgcgggggcctcccgcgggaccgaccgccaagcggcattgtccgtcccgggcgcccgcccggttccagacgcaggtcctgcggccgccccgtgacaagcacactgacgggccactgtcctttgacgagtgctaaaaagttcgtttgttttgaacgtcaattttcaagtgatcttcacgaggtttcccctcccggttccttcgctgctgcctcgcccgcactcggtccccagtaggtgctcaagaaacgtccagcaaacggcagcgcaggcgagtctgctctgcgcgctggcgcgtttcactgcccacggatggcgggcgacctcacgggatccccggttcgcaggatccccgcccccgaggctgcctctgggccgggaggggttaccccagaggggcgtccactctcgacggcgggggccggggcgccgcgggcaggggagggcgcagcctccaagcagccccagcctggcctagaccccgcgcctagcgagccggccggccaggcccacaccccccacctgccgcccgccccaggggaagggtccccccgacgacgcccgagcccccctcttcctcggagggccggaggccggcgcccattggccggccctgggcgacgccccgcccctccgacgccacgggccaatgagcgcgcgctgtcagctcatcagccgggctggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccaggtaagcccccgaccgaggtggggggcggcgggcgcggggggctcgggcggccgaggcgcggtcccggagggcttcttccccgcggatcccgagctcgccccgcgcggccccgcgccccctgcctctttgcaaagtaacttctagggccggcccggggcgccccctccccgcagcccgggcggccggggctcctgagtccggcggggccgcaccaggggtgggtgggccggggccccgggaggggaagcgcgagcgcgggagcgaggaagaaaggcggcggttcccggggaccccgcgt

SEQ ID NO: 5692 - DNA, 1247 bp, Homo sapiens
  source 1..1247: mol_type = unassigned DNA
cggggggcaggccgcgagagggagaggatcccgggagcagacgaagaagtggagcagctaaagtctgcgtcagaagaggttggggactgcgagaggagaggctggggcctgcaggggagcgcagcagcttttagcatcgatccaaactctaaagactcgtggcctttgcctgacctcgagggtcgggaatagacgcctgtctttgtggagagcgatacccaaccgagaaaatggggctgttccgagctgggccctgcgcctggcccagggcgaggcttctctggctccgggctggcccctgaggggcgcaaacggcaggcctggcggttggggccgaggagggagggtaccaccgccccgaggcagcacgcagcctgcagcagaggcgcctgctccaagctgtctcttgggggcgccgccgccgcttccctcctccggggccgctcgctcccaggaaagtggaggcggctggcgaggaccgagagccggggccgcgctgcggagggaccacacctccgggagttcgagggggaccctggcgcggcgggccagcctttgctccccggccacgggccggcagcgcccgccttcccccggtcagcgcttgcggcccgcgccgcgcgcaccgcccggcaaccccgcgcgcgtcccgcgggggcgctgcgtcttcctgccacaccggcgcaccgcggcccctctcccccacacctccggcccgcaccacccggctctcctcccaccctccccacccctcctctgccctccctccccattcctcccctcccggcgaggggcgggagggggcgtggcggggccggggtttgtgtggctgggacccggctcctcgcactccgagtccgcccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacga

SEQ ID NO: 5693 - DNA, 1861 bp, Homo sapiens
  source 1..1861: mol_type = unassigned DNA
cgctcattgggcgacgtggggaaacaagctccagcccccgaagcgcgaccaaaaggagaaatcaagttcccaccgccagggcgggggagggaagctgggtgccggcaggcgctccgccggagacgagactcctcccggccccagaagcgccccgccagggccagagagggcgagcgtggcgggagggaagcctctgtcccccagcggccaggcgacccgaagccgagcgccgtgtcacacgtaccccgcctcgccctgcttgcggcactcccgtgtaactcctatgaaaatgtcctcccgtccctgacgccccgcggtgcaacctccacccctcaacgaggagggggtcgccgcaggactgggaatccagtggccggcgtcccagcattttcggacgcgttccgtgcctcccccagtatccccttgagggatcgcctactgcgattccacgtagtgtcggttacctcgccctagccgcagggagcatcaaacaaaagaacttttgcaaacttttctctctggacactcgcgggtctcttaaatctggcccccatctccccagaacttgcatgcagtcaaacaggaaagctggcgcgggggggatggtgtgcggaggaagggaccccgaagtttccaggtcatccctggtctcgaggagcgcgcggagtggagccgttccctcgcgggcccgacccaggctcccccctcctgccaccctttcccctccgtccttcccagaccacgcagcaagacccgccgagggcgaagaagttgggagtgacttcaggggcctctgcggctagaccaaaccgcaattctcggtgcccccattcccgcggaccgcggggtaacgccagcgagcagcgcttttctgaggaagggaagagggggaaagggtgaccggacgagcgcatttgtcccagcggatctccggtgtatacttggggactgggggttccccaggtggcgctcccctattccctgcgggctcctctcgtagcttcaaacaccctaaacggcgcgcgcatcctccgcctggcccactcaccgactccgccgacacgcaggccaccaagcccaaggtgagcaggatccacgcgcgccgcatattccccagggaccggctgctcccagccgctgcttgcaaccagggcaaaacgaagcctcctgcccagcgctcggcgcagcccgcgcacacgaatccggagcagagtaccgcagcgattgcggctcaggctcggggactcgggctcggggctcgggggcgctcgcttcctcctcctgcgcctgctcccgccgcccgcagctgcgccccgggaacgcggcgccctctcacttgttggtttctgcactcccgacacggagttggtgctccgggaaggctgctctctgaagctcttcttgctctgctgtggttttgctcctccgcggactcctttcccgtgccgaggttcagtttctggttttaaggaataaattcgctggcttgaaagggagctacggcagaagtttaggggcagagcggcgggagcgcgcgatccgcgcggctggagctccgggggtatctggagagcagcgcgtccaagcggggccactggctccgcggctgcgcccctcctcctcccgcgccgcgcctccctccccgggtcctcctccttctcctcctcttcttttcctctggctccctccctcctgagcctgcttctccgggctcccctgggcgactggggagaggaggcggcagtgtgactcccagataaacccgggagaaattcctacaggattacacgccgattggcagctccgaggaccagtgggcgccgcggctccgcgctgtggctgcgccggctctgctcaccgg

SEQ ID NO: 5694 - DNA, 3044 bp, Homo sapiens
  source 1..3044: mol_type = unassigned DNA
cgccgagggggaggggctggaagatggcggcggacgcacacccacccgaccgcgacagagcttaggcccctagcccgcgccgccgcccgctgctcgcagccactgtgggcagccctgctctgtcccgcgttgctggtagagccgccccgcggaggcgtgggaccagggtggcgtccgcatcccctgccagcgcgccttcgcccgggtccgtccagggagcacctgtgcacggccatattggattctgtgccccagtcactgcctcagcgcggcgggaaaggagagggtacgcacagagcctgggttcagccccagtcccgctggggccccggagccaagatgaccagcgaggaaatccggaaaggcgccaaggaaaatcacaccgcctaaggctcgccaccctcacctcagccggccttggcgccctccctccccgacacacacccctgctctcagacacccctaaaacagcccgggcggccggcgctggccgcagccctcgtggcctgggcgccgccagcgggagggagggcggcgaactggggcgcgcaggcggccgcagggcagtgggcgagggggcggagggcagggagagaggcgggaatatggagccaggtccttacttgagcacggactgctccttctcctcttctttcttctgcctatccatgacggccaggatgattttcctctcctcctccgtgaggtggctgaggtcaggcatctcgggctgcagaggcggctgagaggccgccgggatgggagccaggcggccccggggcccgacaggagccgacatgtttggtggagccgaaccaccctagggaagcggggaggcaactccactggcagcggcggcaccggcgcggcggctggggcagcctccagcgctgggacaaatacatacaaatcaatggccttcaatccaaggcgacagcccccctcccccaagaaaagcagggggaggggagggcgagcgcgtggggaaggagggctgaggagtgcgcttcgggaaatgtttcttcttcccgggggcgaagggctgtgaagtgagcggttcaagggaaaggggaactggaggccgggacgcggagtgcgcggagaggcgggggagggtggtggagtaaggtggcggggacagctaagggtggggtgactggagggagcaggcgggagggcgacaggcggaccggggcgcgagtgtgtccggccgcggtcagggccgggagcgcgcgcgccgcctcggaggggaaggggtgcctgcgaacaagcccccggggaactcgcttcgagcgcccggaggcggagtactgccggcccgaggggcacccaggcgggagccgagagggtcgtgaggaagcgaggacggtttcccggagaagcaactcatccgtcccgccggctgacgcatcacagggctcccgcgcgccacagagggagaactcctccaggcacacccgggagcgggccgcggggccggaaacccccgcggagaccccaaccccacccaccccacccccggctagagtggagaagcgaaagcggagaagatatgacgggggctagcggcggagagtcccggggccagggcccttcggctgccaacgcccggatccaggcgagctccgacgtgcagcggggtctggcgccggcccctcctcatcacgcgcccggcccagggtcgctcagccgccgccaccgccgccgccccttgggtcgatggagtcggcgcggaaggcccgcgcgccctgcgccgccgccgctcagtgccgccgccagcacctcctccgcccctccgcctcccgggctcatcccgcgggggcggcgtcacctcctcgctgcccaggcccgggcaccgcgggcgccccgcgggcggcagccgcccctcccgagcgcgatctccaggctgggtccggggccgggcggggagggaggagagactgagcgtgaagggagagggcgcccgagttttcggggacggaagtgtggagaataggagcgtgtgagggggcgcccgaggtgtcgggggcgggggaagagtatgagcaggggtgggggcaggggtgccaggtgtagcaggtagggaggtagaggcggcgagtgggggcgcccgagggaccggggcggggcggggagcgtaagggtggcaaggcgcccgagagtcagggctggagctgaaggtgggtgacagggagggggcgcccaggtgtcaggacctgaggagaaagagtgcgcgtagcgggagggccccgaagtgtcggggcgggatcctggaaggagggagaacgtgaggagggaggaagggtccctggggtgtcagggatgggggccaggaaaggggcagagagctggaggcccacaagtggggatagcgggggagggaggttggagcgagtggggaacgcaggtggtgtcgagggcggggacagggcgaggggagcggggcgtgaggaagttgtgggaaaccgcgctggacgctgagaatgtgcggaaggatcctgaggggaggacgcgagacagcgcgaggagagacgaggagagttagggttggccgggagggtgcgaagatgaagcgaccactggaggctgtgagggtgaaaggagcaagaatcgtctagagacgggctgggccggtgctggggccaaaggcttctgtctgtcaggccctttttggcgctcactctagaaagaagaggcggagacgcgaagagatcgggttagagtcagattttcgaagcacggagatgggttcaatgaaaggacgaggaaagacgagaaaccagcggccggagaacggaggtggccgccgccgtcctttgctctgctcggggctgggcgccgcccggagagccctcccggagggggcggggcggggccgggtgaacagagctgggcgggctcgccagctcttccaggcgccctgggcaagcaatgtgggtgactgagctcgggtgtgtgtgcctgtgtgtgtgtgtgtgtgtgtgtgtgtgtacgtacacaagtgagcgtgtgtgcgcaccccacccagccttccacacgcgcgc

SEQ ID NO: 5695 - DNA, 1603 bp, Homo sapiens
  source 1..1603: mol_type = unassigned DNA
cgacttgatctctgcgagcgtgcctgtttcggaaggtgtctcttgacccgccgtgtcctctaagcaccatcgggacccccgggcacccgggggctcagggccatgcactcccctgcgcgcccaccgccttgaactcacagcttccgcgctgggaagtgactggcggcccctcccagggaggactccgcgcgccaccagggccagacaccacccgaatccccgctcggctgagcgtcctggcggcgtgagccggacccgcccgaagtcccaggacacgacctgccagccaccagcccgcgcccgcagggcagagacgcacggccgcccgccgcagaggcgcgaacttttacacctactttttgtttcgcttcgggtttggtgtggctctggcaccgcccaggatcgggaccctgacgctctgattttccaccgcgtggggaagttacctccctcgccccgaggtctcgaccgcccagcttttctgagaagtttctaccctggttactaaaagtggttcccaagagtagtcccacgtcaatcgcacaaagcaatgacaacaacaataataagcgtctaaaggagcgggactgcccctccggctggacgacagcgccggggactcgcagcgtgcgcgggtcggaattaaaaaagcagcccgggagcgcgagggctgagcggggcaagcatgggctgctcctcgcagcctctctcctgcccgaggctcgggctggccgtctgtctgtctatgactgtctagttgtcccttcgactgctcaggcaaagtttgagacatctaggggaccgggagcggatctcccctagccccgccacccacccaccgctttcccgtcccgcgcaccccgctcctgggcaataatcccaccaactcccggccccgcgcgcaaacttacgtttgatctgccggggtttgctttgctttcgccgggacatctcggcggcggctgctgccgctggggctcccgcggtgcccgcggtcgcggctgccgctccctcggctcccgccgccgccgccgccgccgccgccgctggccaggctcggcccgccgccggccggactccaggtgctccgggcgctgggctcctccgggagccgcggattcacgttcggagatgagcaagcaaatgagagaagagagacgggggcacagagagtgtgacagtgaggaggggagggggagaggagagcgacggggggagaatgggaatgtacaagcgaacggtcagggagagagaaaaggggaaagagaagagaaaaataacacggaaagaaggaagagaaggagggagggacgggagagcgagcagcgaggagagggggagcgcgggggcgcagggcgcgggaggaggagcgcgctcgctcgcccctcgccccggcgtgcgggacggatactccggcgccgccgccgccgctccgggccgcgcagctcctgttctgcggcgggaggcggcgaggcgcgcgagggaggggcgcgccggggctgtggggaggggagactattccatcagccaaaggaggattggctgcatccaaatccagtccggatgcaaactacggccccggccttggtcgggcgaagtgcgg

SEQ ID NO: 5696 - DNA, 1365 bp, Homo sapiens
  source 1..1365: mol_type = unassigned DNA
cggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagtgggttcgcttcctccttccctctcttctttaaattgggacgtgcgaaggcgcagctgcctccccggggctctctccatcccccacacaccctgttttcgcttcttgtctctcaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggtgggtccctctctgccaaaggtgcgtggtgggcttcaggggtggcgtgtggaggcgctcactcacgccctggctccgggggctcagatggtcagggctgtgctctccaccccagcttttgcgggtccccagtccccacctttaggaccctggagctctacaaaacactctgttttctgtaccctggaggcgcggggagccggagcgagacgcgctgggagctcggcgagccgggcgccaatcgggcgctcagggctaagtcgtgcggtccgcactcatgttcgccgc

SEQ ID NO: 5697 - DNA, 419 bp, Homo sapiens
  source 1..419: mol_type = unassigned DNA
cgtggcgggcgctgcccacccggcggagccgagcggcgtgcagaggctacaagtgccgtagctggtgattgggggactttctccgggaaccgtgccgggagagcgcgcggtgctggagccgcaccgggtggccgaagcagaaggtgagtggcggggagtgggatggggtggaggctttgaatgcaagggtgagagccctggagcctagcagagctggagcgcatatccccgctctctctccttcgtctccgagtactaggcggacacatccgtacctcgaatgcctcagtgggcgcagagttcaccagaaatggatagccggattcctcggcgcctgctgggggcaccgctgccaggtgcttggggctcgctctcccggctttgctcgcacagggcgcatccagaggtcgcctccccga

SEQ ID NO: 5698 - DNA, 3675 bp, Homo sapiens
  source 1..3675: mol_type = unassigned DNA
cgcagcgaggccggctgcgcggccgccgcgtgggtcggagtccagtgccccctggtggcgccgaggcgggcaggcggcttccggaccgcgcggaggcccgacggctgtgactcaggggtggcgccgctgccagggcggcgggaggcctgactggggttccgtcgtgggctgagccacggcgcaattaattaccagctgctgggaatccttgtcgcccgctcgcggtgactcacccggcagccaggctcacttgccgagcgcgggggccttggtttccaaaatgaatctggggagagtgcctgctcggggtagggctccccgctccctcgccccagggcgcccgcagacccagcgaggacctgacggctcagacgtagcccacagcgcgggctccccttccctggtgggcacccgtgatccctgaaagtggggtgcagagcgtcccagctgggaggcctcggtgaatcactggggtcccagaccctctgggcccggggtccctgaggccagggagcccgagcaccgctccagggggcgacccacagaagggactggtctcctggagcccgcgagctgcccgagggttaggtctgattccccagccaccccttggccagctgctagcctgccgccaggcaactctttcccatctccatcccttccttggctggggtcaggagaggaagaggagcccaggggtctctgaggcttgggtctgtccttttggagctccagggctccaggcgggattcaggaagccgaaggtcaaggaaaagcccctcgatagcctaaagggagagggcggggagggggaggaggtaaaggaggccaaaatgggaaggagataaagcctggagagggctcatctggaagcagggaataggtgcgccccagcccgagcctcgtgttcctaccccaggtggtctcgagggggctatcgcgtggctcagggctgcatccacggcgcaccttgcgcccagctgtggggaaccaaagagtgattatatatatcaaagagtgattatatatatatatatatatatatatatgtgtgtgtgtgtgtgtgtgtgtgtgtgtgtgtgtgtgtgtgtgtattttttttttttccttcagtaaagcaacagagaggttactgggtcgggggattgcgatgtctttccccgctgtcctgactccaaaagtggcggcccatgctgtccttagcgctctccagggaaacgactcgggtctgcaggtgctggcccaagcgggctgtgccgctgggaggcgagggggccgaggcagccctcgggaccccaccactccacgaggccatgtccctggccaatgacacgctcccgcgccgggtggctaggtggggggtggggggtggggaagacttcgtgaaccgctgctgccgctctcctgtgtgcccatggccccctccccttctgctccccactctctgcccaatctgcctgaagctgtcagcctgccatctctggctgaatcccgttttcctcctccaaccccgagtccctcaaactctccacccgccagggctgcttgcgctcttggggagcggggctagaaggacccaagaagccgcgtttatcctcccatcccccgccaaaacccgccggcggctccgcccccgccccctccctggcggctcaggccgcccctcccgggctccctccgcgtgcgccctgcgccgcgctgggtctgcagcgggagctgccacagcagcctcgccagctggctggggaccaggcgggaggtggcgcgccctggaggctgcgggagggagggagggagggaggcccggcctcggcgtagcccggcccccgctccccgaggccctcccgccggagcggggctgccaagcgcacacacacacacacacacacacgcacatacacacgcgcacacacacattcgggctcccaacggcgcgcacgcacgtagcgcccggggcagaccagcgcggcggccgcctcccgggacgcccggacgccggagggccccgacccccgcgcggctcatgcgcccgcgtccgccccgctgctccgcgaggcccgcgggacccctcccgccgccgccgccgcgcccgccgcccccggaggagcgggctggccgaccgccaccgcgccgtcccccggccgcccccgaagccgctccatcgcggtccctgccgtcctggggccgcgccccgctcccgcgccttgggggttgagccgagcaaacttcgcgcaccggccgacgcccggcggggaccccgctgcgcacccgcgcgcccgggtgggcgctgggcgcgcggacctttggggagcgggctgcccctcccgctgcacctgctcggccccctccccgcttgcaggggactccagagacaccgccacttcgcaaacttttcctccccaccaccgagagggggcgaggaggggtaaaaggggaagcaggttccgctgggcgcgcggacctgcaggctccttgctgggcaccgccacccgcgagctggacccacaggggtaccgggccccgcggccgccctccggccgctttctggctccggttcccgtccctgcgtttcccgcgggagcggggggcggggtgcggagggcagcaaggcccgcgcggtacccagcggggccgccctgcatggccctgcgcagtggggcgggctgcttcggccgggtctggcgcagggtgtcggggttcccggacgcctggccccggcgctcgagcagcctcctgtgcctgtccgccttctcggctgagcccgggcccgcgccgcccctgccccgccagccgcctcgcggtggcggtggctgtggcggccccagcggagggggccccccccagcctccccgccccccgcctccccgctgctgctgctgctgctgccgccgccgcttacaacttggaggcggcggcggcggcggcggaggaggaggcggcggcggccgccgggcgctgcagtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggtaagggctgggcgcgccgctgggctcccgcgccccgggaggagtccggggaggcggctgagcgcgccgcgccgggctgggtgcagggcgtcgagggttaaacgcagcctcccttgggggccttcccgcagcgccccctcctctctagggagccccccctccgcggcgcctccgagcctcacccttcggggaccccacccggtgctctccaccgcgctggtgtctgggccgggcgtgcgagccccgagcgagtgtgcctgagccgggagggcggaggcgccacttttgcgaagagagtggagcgctaagaataatcccatagcagacacccacccacccaccgccccggcgcgggctgggctgcgcgg

SEQ ID NO: 5699 - DNA, 3675 bp, Homo sapiens; identical to SEQ ID NO: 5698
  source 1..3675: mol_type = unassigned DNA

SEQ ID NO: 5700 - DNA, 3378 bp, Homo sapiens
  source 1..3378: mol_type = unassigned DNA
cgggccgggccggcgaggggggctccggccgagacgcgaggcgcgtcacgggacccggcggcgggagcggacggcgagcgagcgagcgagcgggcgggcgggcgggcgggagggaggtggcggccggggctgcccaagatggggccggagccgcgggccaggcgcggaggagacggaaggggcgggcagggccgcgcgggcgcggtgcgggcgccctctcccggcagtcagcggcagcgcgccggccctccgccttccgccactgcggccccgcgccggccgcctgggcctggagccccgcggcgtccccggaggacgggctccgcgccccacgacccactcccggaggcggggtcgggccgaccgggggcggaggacgccgcaggaggctgctcggaccccgggcgcttgctaggccctccctggggcccttcatgccaggccccgcggctgtgtccgcaagcgcagatggtctcgggactcgggccaccctgacgccgcagacccagcacgctgcggaccgggcacgttggatctcgggacaagtgcggagggtcgggggctggaagggatccgagagcagagcccgcgtccccatttcacggacgcggccaccgaggtccgagaggggccggagcctgcgggagagggaagggcctccgagggctccacaacttggctgcgccccctccctagcccgggatccggatgagtgctgcctgaggccgaggcgacgaatcgccctctatccgcccctgcgcgggaccccggcaggaacaagcgcccgtccctgggatcggaggcggcaaaccccaggctcgagccccccagcgcagcgcccacccgcggagccgcgcgcctctctggcgcatccctgggcttcgcggctcggccctcagccgccgggtctcccgggccagccttctgccccccagatcgaggcgcaacaagtctgaaagcagcgccaaggagcagctagcgagccgaagggagggcgtggggcgccgggcgctccgggatccccgaacgcgcgcaacgtccgcctccggggaccgggcgcgggcggcaggcgagcgggactgactcggcgggctgcgcacacccccttccaaggccccgactgtgcgcggacgggggcgcgcccaggaacccccgccccctccttcgcctgcttgaccttgctgggtactcaaagccggactcggcggcaccccggcgtgcgggcgcagagtttcgctgccgcccacgggagggagcggctcgacctccctcgttgcctcctcggcagccggggtcgcagacgagtggaaggcatgagggttctaggagacgtgacagtcgcctccccagaccccacacaccgtataccacctccctcccagatagaaaagggacccagctcccctttcccccgcctccgcccgcgcggcctctgctgttcccccgcggcggctctcgctccgagggggcgtgtgtttgtgtctgtggggagagtaccgagggtctccgtgggttcccaggatggagcgggagagcagacctcccagctccctccccaacacaaacgacaagcggctcctctggggcgggagtgcaggccccctacccgcccacacgccttcctgcctttcaactactccggagttgcagcccaggaatctgcgccccagacccggaggaagaacggggaggtcgcggcggggacgggtgctgaaagagggctggcttagggctcttcgggtcccagcctaggcgcctgcgctccaagaaacttagaagcccaaaataaaagtggaaaggggtaaggtgcccagcggcctggggctggggtgccagattaggcgttctcttcaggctgccggggagtggccaagcaggagccgccgcggccaggaggagggacgcgggctcggagccgcagcctccgtcaagccctcccggtcgcatcgcttcgcggtgattctcagctccgccgccccctcccgaggccggaggagctctctacctcgcccagggggccgcggggacctagggagagggctcctggccgggtccagagctcccagcctccccaggagggggcgggggccgtgctcgttcctcgaggcagctccgcgcggctccaagctagcgcggcgacggtggagggccggcggcctctgctcaccggcgacgcggacccgggagtgctcggcgcccgggagtgctcggcgcttggagcggagacggcatagggccggcccaaagttgagagcggcttatccgcgcggcctgtccgacccagtggaaaggtagacaaggagggaagagccaggcgttcgcgtgggggtggggggcgcaaaaatagccctccgcccgaagtgggggagagtacctccagggagtctccactgccaatgccaggtctacaggcgagggcttctacgagcgagggcttcgagaaggagtctggggttttctcctgcctgccccgagctctgtgcgtggggggaggacgtctcgggcccttacaatgtctgtagggggccctggacgtgattagcaggagggggacacgctcgggggctctccggagcctgctgcgtctatgtgtggctgttgggggccatggggggctcccttagacccccgccagcgtctgtgtgtgctgggggtacagcgggaacgccctccccagcctgccctgtgcatgtgatgaagaggggtgccaggctgtggtgtgtggatggggaggaggcggcggcgccgaggagcctctcctgcgtccagggtcgccccctcctcagcctgcccaatgcgggctcgcggggacctgccacattccatcgccaccgctggagaaggcagggggctgagggggtagggggtgggggtccaaactcctgagctctgagcgcaaaacctcggagctgcgaagccccaaacggcgaagttaggaagtctgggcgcccgcccctcccccgaccccctcccaccctcgctgcgcccccacccgccgcgcccccagccccccgccggagccttccttaccttccccagcagcagcggccccgccggcgaggactcgatccggcgagttgcaaatccccgcgagcgcctcgcgtcgccggcggctgagccgggcgcccgaccggaggtggggggggctcctccagccgccgccgcccccggcccgctctgggcctcgccgggacgccccctggagagcacccgccggcgcacgcaggccccctcccgttcccccgcgcctgctggagccccccgggcgcccggagggtccggatgcccgcgctgcggacgatgctggcgcgcgggcccgggccgggccaggacgcggcgcggccgcctgtgctcccggctctccggctccgcgctcgc

SEQ ID NO: 5701 - DNA, 1108 bp, Homo sapiens
  source 1..1108: mol_type = unassigned DNA
cgggggtcccgactcctcccaggcccgtctccaactccacactgccacccgctcggcgcccacccaccctctccagaggcgcatggaccccgccggccgggccaggccacggcggctgcgggccacagcgacccctccgggacaggacgggtgcgggccctccccacccgcaggcccgccggcagcccccgcccgcgcccctgcccggcgcccctcccgccggcccggccggggtctcaccgcgtcggcgctgagctgggctaagatggcgaaggtggagagccggtcacagaggcagcgcgtccggagggcgtcgaggggcaccgtgcggcagccgcgccacgaccagggcccgagctgcgggggggcggaggaggagggtctgggggcgggcgggacacgggagggagacaggcggagcgtcagcggcggcggggacgcgggcgccccggcccccgagcggcggctccgcgccccggccccggccccggcccgccgccccgcacctgcgcccgcagccgcgcgcccgtccgcccgccgccgccaggccccgcggcccgggcgcccatgccgcgctctgcgcccgccgccgccgccgccgagagccgcggagcgcagcccgagggagcgccgggcgggggagccgagcgatcgggggcggggcggggggcgagagctggcccggggcccggcagtcgcccgccccgcgcccccgccgcccccagctcctccggggcccgcgcccccggcccgcgcgggaaggagggggaggcccggaggggcgcgtgggcgcacgtggagcggggagggtgcgagccgggtgtggcctgggggcgcggggcgggttcggagcgcggcgagggtccgctccggagctctccggccccgcggcccagggcgccggctggagctgacgaccttgggaccgctccatcccccacatccacctcccccgggcctcatcacccctggtgcctgcggctcatctcctgggacagacacagccttccccgcggggaggcttgccgctggaaacttccctctgcggtctgacccagccgcccgctgtctacgggccgcgactgccccgcttttcatctgagcacgc

SEQ ID NO: 5702 - DNA, 1700 bp, Homo sapiens
  source 1..1700: mol_type = unassigned DNA
cgaacatccacacgcacacacacactcgggagcgcacggacgagctgccttctccaaggccactcaaacgtcccaaccactctcgggcgcgcaagtccaagcgcgggagccaggacttaccgccaagacgctctgggcgaggaaccccacggtcactgtccccagcagcagccacctgcatgggaaagggaggaagagagacgtgaacgtgcgggcccggcttgtcagtccccgagagttacaccgaagggtccatgcgcgcgtgacccacggggaccaggcagaaagtcgcttaccgccgtagggcagggccggccaccgcgcgctggtctctccccatgctggcggttcgtccactctgggccccggtcagtcccacttagcctagaggcgacagacaaagcgagtttagcgcaggatgagggaggcagcccatcctcaccgccggtctcggtccgcgagacgcggggacagcgcggtgcgcggcccgcatgcaggggtgaccggagggccgtcccccccacgacccggaaagaaggagagcctcccgttaggcccctgtgggtgctccttggccgaggagctcggtcttcgctctcccaccctccccctttctactcccaagcaggagagcgtgcagccctagcctgcacaaggcgctccaagtcggtgctctcgggccagggtctgggcgccgctcgggggtcgctctcacctcgggctcggcttcaggggctgctgcccgaacgcattggcccttccagaagcacccgccggcggcacaccggcagggcggccggccttgctgggctctctgggcgccggccccgggggctcgggcggcccctttcggtcctcggcctggatccgcgaacgcgcgggcgcgaggggttgggacgcgggagcctcttgagtgcggagcgcggagccctggtgtcccggcgcactgcagccacactcccgggccgcgcgctcccgccgcctcttacccgcgccgcagggtcctcccctttgaggcgccgcccgcgcaccgccgggggggagggggcagcgccaacaaattggggagctcggcccgccgcgctcaggtctccgcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaaggtgagttcccggccagctccgctcccggcgtcccgccccgagcttgggcgccccgagaggcccctttgtccgcgcctggacccgtccgcctgcccctcgggggtcgcgcgtggcacggccaggtgcattctctgggccggggttcgttgggggtccctgtaggctacgatcgcgcattggtggaccgagcctcctttgttatggtatgggtactggagagttaaggaattcctccggggaagggaggagaaacagcccgcgctgtggcggggtgagggtgcctgggagccggcgggatttgaacccgcgtcgcgggtatgctcggcagctgggcgccttcacccgtcccgggtgcgcgagggagttgggggctggagggccgggagcgcccaccccgcgc

SEQ ID NO: 5703 - DNA, 692 bp, Homo sapiens
  source 1..692: mol_type = unassigned DNA
cgacccgcgaccgcacatcctgcagagacccggcctcgcccctgcatccttcgtagatcccgccctgtgaccacacccctcgcccttcataggcactggcccgcggccgtgcacgccccgcttttattggctccgctccgtgaccacgcccccgcaaccttgatagactccacccccgaggacccttctcaggagcacagtgaccccgcctccacagggtccgctccgccacactgacccttccgtgtcgctcgcgggaccccacccctgtccgcctgctccggtgcccatggggaagcctggtgccaggggtcaccagtcagtccaattcaccgcccgactggtgggacaaggacaggtcagcgggtcacaggccggaagtgagactcgcccggccgctctgggacgcgggaagaccgaggcctcggtggttcccctctctcccgcctggctccctcaggagaaggagcggctaaggtaggacccgacaccgcggtcgtacccgccttcttttctgtcccagagtacagcctgggatctccaggggggagactgaatgagtgctgtcgaggaccggcgagagtctggaacgttcgcgccttcgtaggagaacgaggaggtgacggacagggaacggggagcggccgttgggtgggacgcctgagaccctcgggaaatggccgggtcgccga

SEQ ID NO: 5704 - DNA, 1924 bp, Homo sapiens
  source 1..1924: mol_type = unassigned DNA
cggcggagtaaattgaacgttattctccgatcaaacaggagcttcgggtccacctgtttggaagctcccaggcggcttggaggggtccggccttcgggcgcgacccgcaggggttgccttgcccggctcgcggaacggacgtttacccgtcgcagccacgaacccaccaacgacaccaagcactggccgggcagaccaggcgtcgtggaggcgccccagccccccagccccccgcaacgacgcgtcccaggggtgcgcagtgcttggcgcggtgaccggacccggccgccttcccgaccgcgcagagcgagaggccacaccctggatcccaggccgggtccctgcggttctgggagggaggtcccggacgcctcccagatctcgggcttctgtaaccccgaggccgggttttaaaatcacggctcttccgagttacacggagagtccgtggtcaagggtcaagggcggccttcgaccctcgggatcgtcttcttgagaaatggctgagagctaagcctagagctgcgcagggaagggagccaaagagctggcgccgagcgcgaagggccgggaggcgcggggaggccccttacccgccccactgtcctgcccgccaatgacgccgatgacagcgacagcgtcggccgagtgcttcccctgctccgggtcgtccaggcaccgggtcctccttcagcactcgcagcacgcactgaagaagacgctacggaagtctccgttttccagactcgggggaattaggaaacgcgcccggcgaccctcgggcagtagcaccgggccaggtttgctttcggaaccgctgacgccactcgccgcctttcccgcctgggcctctcgcgggtcgcaggggtggaagcccgacctgggccagggcccggatttcttcctcccggcctctgcgccgccgcccccggtgccaggacgcgctttgctctcgccgagacccagacgcgccgaaagcctcgcgcgggcagttccccgccccacgccccgggctgcgcgttctcccgcgaagcctctgccgagtgcgcgcgacggcgccgccggactcccccggaccgcgctcccgcgcacgcctgaccggagcaccccgcttcacgggggcgttctgcgcgtccttcctccccggtgcgatttccgttctttttcctctcgcggtccccaggagcccaggcacccctcgacgccgctgccggcggaaccgggaaccctccccggggctccctgcgggcccgaagccgccttcccgaggcggcggagttgggcagctccgggccccgcgccgccccgcgccgccccgcggagccggagtttctctccggagtctggacacagctctccgcttcgtcgccgcgcactggaccccggtagcgtggagcctgcccgggaagctgggctgcgccggcctggggcgaaggtccaaggggcgcgggggccgggacgcggggctgtggcgacgaccggccctctgcgaacgctcaggccggcgggtccggggccacaggctgggagtggagctggcggccactggggagtagagaggacgcccaggaacaggtgcaccagggtcccggcggctgggccgagggtcgcaagcagaggggaccggcggctgccagcaagtcccaagcagatgcctccggcggggcagccgcattttacagcgcccattccgcgtacatcgagtatccaaaacgagtaaaatcggtttatacgttggaatgtagcttatgattccaaaatctcatctccaggctgcctagatcacacggccccgtttcattcatttttactgaataacggtcgttggacaatttagagaagcagcagaaaccacgagaaaaacagtggagtcaaacggcggtaaggaccgacaaggctggcggggacattgagcaaacggcgg

SEQ ID NO: 5705 - DNA, 1991 bp, Homo sapiens
  source 1..1991: mol_type = unassigned DNA
cgctcagcctccatccacggagggcgaagacaaaaagcgccccaggcgcgcagggaaaccgcgcaacgctgtgtccattgcagcgacttttccagaaaaacaaacaaggctttccgacaggttacccgcgtaagcagcagccggccgagcctccctttcccgctaacctagcagccagcgctgccgccctccaagatcctttctaatttaagtgcaactcagcaaggagggagagtcagagattctggggacgctcgaggaaatcgaaccccgaaaccctctgctcccaaggcgcggtcggagatttttgggaccccaaagcggagagaattccttaattctctgctagaagagcggggctagagatccctgggattcccttggagtcgaaccctcccctctagcctcacctcggagggcgggagcgaagatcctgaagactcctctagcgcaataaaccctcccaattctgttggaacgcgggctctgggatcgcggggaagcccagaggggcgaaccccggaattccctgccctgagagcgggatcagggatctcagggacccgggagcagagggaacccccgcaactccgccgaaacacagggtgagagatcgtggggaaccccgagccgagcgaagcccgcaactctgcccggcgggcgggatcagacgcgtctccggcgctcccagaccggcgatgtagcgtggccgggagcccaggaccccaagcgccgccgctgtcggcaagtaccgccgcatctctccacaacccaggacccgcatggcaacggccatgctggggggacttcattcaagaaactcgggccccgccgggagcggtggcccacgcctgtaatcccagcactttgggaggccgaggcgggtggatcacctgaggtcaggagctcgagaccggcctgaccaatatggtgaaacccccgtctctactaaaaatacaaaaattagccgggcatggtggtgtgcgcctgtagtcccagctacttgggaggctgaggcaggagaattgcttgaacccgggaagcggaggttgcagtgagccaagatcgcgccactacactgcagcctgggcaaccgagcgagactccatctaaaaaaaaaaaaaaaaaaaaaaactaaggctgaacccgggctcccgcacgcccgcacccacctgcgcggccatcacgcgctgcctctcggcgatcaggttgcacttcttgcactggcagtcgcgccacatgcagaagcgcttgtggcccttgagcggcgaggcgtagccgtggttcctgcagcgtgcgcacttgggcagccgcggggacttcttgctcccggcacccaggtccgacgccccggagccggagccgcctcctctgctgctgcccccggcgctcgagccgctggccgcccccactagcgccccagacgctttgccaaagcccccggctctgccctgcggcggtaccccgggggcgtgaggggcttccgacggtgtagagggcttgctgaatgcctcgtcgttgggcatggtgcccctaggagaagtgcgagcactctggccccctctctcgcctggagactgctgcgagggatgaacccgacggacagcgacgctccggaggaggaggcgcaggagacgtgtgcgctgcagccggaggcgcagctggagtggcgaggtctgggcacgccacgcccggagtggtggggggttgtgccttttcttttggcgcgcgcgcgactcagaactttcggatacttttcagaacattcccgggactgcctgggagggagcgtggccacgcccaccgccccccgactccagccaccgctctccagctgcttgcaaacttgcaccggctgcaagcatccagggctttgctgcagggtccctgcaagcgcaccgagagatacagagcggcctgggaatcgcgtggcacccctcgccccgctctcggaggcgccaagacccggttgccaaagcacggtgcaccga

SEQ ID NO: 5706 - DNA, 1667 bp, Homo sapiens
  source 1..1667: mol_type = unassigned DNA
cgaccccaccgtagtgagtgtgcgcacgtgggttttaattttgtcctgtctcaactccgttgtctccctgctcaatctgacacgttccgaacccttcaacctgggaaggcacctggcgatactgacgcacagtcccgtcgtttggctgcccggaggcgccttccctgcgggcgcgagtgccactcgcgctgggtccagactcagccggcttctcccgggagaggaagccccggcctggcggagagtaggaaggaaagccccgacaggcccacgtcccaaaactttgcctccagtcctcccaagtggagctgcagctggcactccgaagttgcccccgcgcccggccaaactcccgcacctcagacgctcttacctggcttggcgagctgcgcctgcagagccccgggctgcggctcggcagtccaacgcagcgcggcggccgcggccaactcggcagcagggcgcggcggctgcggctgcgacggctgagaggctggcggcggctgcggggcggcgacggcgtcccccggcggcgggggccctggcagagcgcgcagcgagtcggggatgaggctctccaagctctcgttggcctgctgccggcgcagcgccacctgcgcagccatgacccgctgccgctcgatgatgaggatgcacttctcgcaggtgcagtccttgaagcggcagtaacgcttgtggcccttgagccaggacaggacgccatggttgcggcagcgcgcgcacttgggcgtgcgctgcaggggcgcccgtggcggctgcgacaccgggccgcccatgtacaggtagggggagccgtagccgttcatgccccgggctcccgaatgagttggcagcctggctgcgggagagggccagggagcgctggacggcggggctgcgaggcccgctcaggggcggcctccgggcgacgcggcccttggtcccgcagccccggtggtcgtgtgtgctccggggcggccggaggtgccgcagtcgtctctccagctcccttcgcgctcacagctcggcctcccagctcacgcccagccaacgccgacgcgggcctctgccttgggcgcgcagccgggtcggcacgtcctccttcgcggaggcgctgcggcggctgcaaggagccggcgacagctctgattaaggtctgagccagctcttctgcagctccctcgtgagccggccggacccaacacctccgccgccctcccccaacccctcctccttcccaccgccacccccgcccctggggtccctgtctccttgcactccccgccccacgccttcctcctcctttgcgcccctcgggtgcctgcacttcaccttccttgccacctgcagccaggccactctcgcgggggcgctcgcggccccctcctccaagccctctccgctaccccagcccgcggctggagactgcggcgctccagaacgcggcggtgctcgcggggcggagaaggggaggaccagcgggagtgagggtgggggtgcctgtaagcgagtgaggtggccgctccgcttctctctcttctcctccctccagtccagatctggccgcgtttttccgagcccaaggccgcttttatcccgacatttggccgcagaagctcagctccgggagaactcgaacctacgggagtgttgcggttgcaccccgg

SEQ ID NO: 5707 - DNA, 433 bp, Homo sapiens
  source 1..433: mol_type = unassigned DNA
cggtcttctgcagcctcgggcgcctcaccttgctgaggccgctttcggcttcctctgacccaggctgggcgggaaaggtcgggccgcccccgcctggctcagatcgctggctcacccggcgggcgcgcgcagttgcattcagcgcagcgccactggcttcagtctgcagactgcgctccccttcctagtactgtccgctcaggccccggagctttacgtcctctgattggccggttgtcaggcggtgtgaatactgattggccgaggcacgctggcagggagccctccgcctcccgcggtctacactcttctctctgaagcgctccgccagagtccgcctaccgggccttcggtgcagccggctcgcctgtccagaatctaaacccgaggtatgacggtgcctgcaagagagaagtcaccatttatctcgcgg

SEQ ID NO: 5708 - DNA, 896 bp, Homo sapiens
  source 1..896: mol_type = unassigned DNA
cggctccacaccctggcgggcggcgtacggagcgtcccggcccccggcaccagccagcgtcggagtgggtaggactggagatggcagcctccggtccaggggaagcgggactccacggaagggctgggaagagggtaggaagagggggcgggggcgggaactgttccgccccctccccctctgtctactttcattggccaagggcttcctggccccaacccacctcccgcctccagggcgccgcttaaagtgtgcggagcaggtgccttgggtggagccacaactttgcgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcggtaaggacctccacccggccctccgcggcctcccctccgccctgcccgggctctgcctgcgcggcctcccggctcctaccctgagctctgctgcgctccgcgtggtccccgcaccctgggtcccgggccgtggcgtggaagcaaattcgtgcctttggtcctcgt

SEQ ID NO: 5709 - DNA, 1494 bp, Homo sapiens
  source 1..1494: mol_type = unassigned DNA
cgagcggcccaggagcgagtttaaaaccccgcacaggcctgctcggccgcgtcccctgattggccaaggcgcgcccgccgccccgccggtcgcaggcgtcacggcagccccagcagcctgggccccgccaccgcctccgcggcagccccggtcggcgcaagtgcggcgcgcgctgggggagggggcgcggcggagcgctaggctggcgtcgggccaccgcgggattaagtttctcagtcacgcgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccgggtaagcggcgcttgagccccggcccagaggccgaggcgcgcccccgcgccctgcgcgcgcgccggcggggaaggtgcgcgggcgccctgggctcggcgcttgggggtgggggtgggggcggggatgggggtgggggtgggggtgggggtaggggtggcggcgggccgtggggcggtggggcggtgcgcttgccccaccccgcgcggcccggcgcttcgcggaagccgctgctgtggcttttttaaaaggatggggtctagaagtttcctttgctactcgcaagtctccactccccccagccccgcggtggataatcctagacctttcagcacccccgccacccctttcttttgctctcgctgactaagaggtttaaaagtttttccttttccttgacccagaggggcacagtcttggtgtcggggggctgggggtggggtgttagcctgggggcccggagcgcagaccaggcctccagggcgcgggagcctgttgctctcccctgcaggggccgctcccggacgccccatccgccgttacgtggtcccgggatgtgcgggttgcggtagagagtgggcagcaatgctcctggtcctgcgttctcgccttagccgcggggaccccgaggcgagccgctaattggtaccggtgccccgtccctcacccctggcaccggcgcccttttaaccgccgctcccgttggtgggagcacgttggtcttgtctctcccttagtctcctcaccccccgcgctgatgggcgtctttgtctgcgatttggcagccccaggatgccggatgttaccagggaagcgatgtttgggagacgctttgtgtcttgcggagttgcgcgtttgttgggtggtgatggtgtacatttttgtttgcgttctttgcagaggcacaaaggctgggctattcttgcctgcagtcacatggaaatcaagcggagactgcgggggaggagaagtggccaggcgccggcgggaggtagaggccgctccgtagtcactgggggcgagtgggggcccctggagacctctactgcgcggtgcggcttttgaggtgctccgcttgggaagaccccgg

SEQ ID NO: 5710 - DNA, 828 bp, Homo sapiens
  source 1..828: mol_type = unassigned DNA
cggaggccacgagtcatcagcccggacggtgaaacctacccctcccctgcgtcccacgtccggatgggagaatcccagcttcctacggcgcatcggggaacaacttcagagcagcacgcgagcagagcccccagcgctcccacgctcacgctcacgaccctcctcccaaccgcgcggcacaaggaggcacttacgcggagccaacctgacagctcccgccggggtggaaacccgcggtctcctcgcaccggcatttcggacacaggtcccgcgtaggcgcgcagctccggaccccgcttctgcttctgctcctgctcctactcctcctgggcaccaccggacagtgctctgacccgcagcccaaccgccggggtgccgacccgcggggacccacccctttgtccctcctcccgcggcggcggcggcgtcagcccgcccccgacccgagcgtggcgcctccgcgctggccgcccggcccgggaaactgtcaaattggccgctaccacccacgcgcctgccggggaagggctcgccggcgccgcgccttcgaggctcctgcggcgaaccgcgtcacgcgcgactcctggccgggggcgggaggcggcggcggcggcaggagaagcccaaggcccgagcggcccgcagcccccacgcctgcacccctccacccccgccagcccgatggttcgctccgcggcgtgcactggagcaagcaggtcccgctccgagcgcgcgcgctctgggaagtgctgcaagtttggagacctggagtgagctccgggcgctgctggcccgactgtccgcggtgtttccccggtgaggtcgcgg

SEQ ID NO: 5711 - DNA, 2705 bp, Homo sapiens
  source 1..2705: mol_type = unassigned DNA
cggggttgttcgtctatttaaataccttccgttccagcaaaggctgagactcgccagctctgcccggcctgaccagggcgccctctccccgtcgggtggtttgggcggttccgggcccggcgtctctcaccccgctggtctccccacgcccgccgggtcccctaggagtgcactagcaccgagtgcaaggagccgcccttgctttcggccgaggtaggggctgtgggctccagcagagaggcaacgggcgaggccgcggccgcggagcacacggtggatggcgccggaggctgctgcgaagccgcggggacagtgagccccggctgcagcgcggacacgggcggcagcgcaggcgtgggcttgatgggcaccggcatggcaggcaggctctggcttgccgagtggcacagggacttgaccgggaccccgaaggccccatactccgggcctacagggactccggctgcggctgcggcggccgcggcggcggccaccgaatccatgacgccaacgtgcggccacacggagctgacgacgttgccaagctggccgggcacggggtagcccaggtggtgcatgacggacgccaagggcagccctccagcctgcagcacgcccttgtagtcccggccaataatgttctcaatggcaaaggggtgcttgaagcctgacgtggacgccgcggccgcggcggcagcggcggcggccgagcccagcccgtagggtgggaactgagacaggcgtcccacgctgcccaccgcggctgccgcggccgccgccgccgccgccgccacggccgccgcctcctgcatcttgccggggtgagacggctgctgaggctgcgactgctggggcggttgctgcgggggctgtgacgggaggtgcggaggcggctgcggagcagtaggcggttgctgatggaaatagtgtaccatgtgcggcggcggcgggggcggcggcggcggcggctggggtgggtggtggtgatggtggtggtgtgcggcagcgtggtgatgatggtggtggtgggggtggtggtggtgatgggggtgaaggtgccctcccggaccggcgcccggcgcgctcttggtgcttcccgcgtgcaagtgagtatggtcggcgcgcagcaccttgaagcgcttgcgacgccgcaggaagctgccgttctcgaacatgtccccgcagtcggggtgcagcgcccagaagctacccttgccaggctggtcgggcctccgcggaatcttgatgaagcagtcgttgaaggagaggttgtggcgcaggctgttctgccagcgctgtgtgtgctcgcggtagtaggggaagcgctccatgatgaacttgtagatgtcgctcagcggcagcatcttctcggccgagtgctggattgccatggcggtcagcgagatgtaagagtagggcggtttttggtcgctgtacgagctcttccccggccgcggcatcgcccccggctcctccaccgccctccggcccgcactggaccacagaatctctccgcactccgttcctggggcctggctgcccccactaattcccactcggcccctccagtcccgccactttgccctctcgccctccaggccctctctgcttctctctcctgccttctccgaattgcctggtgtctccgaccttggcctttcgggcctactcagctctcggaagctggcaacttctggccccgacggttgccgactggcgcgcacagtcgcgggcggagtgcaccaggtttaccgccgccttctctgcgtcttcccccgggtggccaaagactgagtgctggagctggctgcagaggagagtggcaaggggccgtgtttcctcccggcctctttgctttttctaggtccgagggaaacccagaccaagatggctgggaggaaggtctgggcagtagagactctggccctttaaatctgagtttgcgcctgctgtcctggaggccagtgacagcaggacttccagtgccctggacgcaggcccctggccaggcacttagccagaccgcgctggagttctccttttcctggagtgaaaaatcagggtaaggagagagaagattggcttctagggcgcctctcttttctccgaggctcgcagcgtcgccggggttagaagagacgcgcagccctaggctgtcgctgaggagaaaaaactttggtggtttctgaagcggcagcgcccgcaggttctgctgaggagtgtggggcgcaggactctgggagcgagcggcgggctggagagggcgtctgcgaatgctgggtgagtgctggccggggaggctcagccgtccgcgccgcagctgccgcctttctcccgggcttgtcttgaggaggagaggcgacggcagtggcagcgacgcgctctcctggctgcgttttgtaatggtccccgagacgccgagacccccgcagctagcgcttcgagactatcacatgaccgaggctgagggactcagccgccgccgccgcgtctgtagctgaagaaggggcaagaaggcgccgtgcctcgcccccgcccccttttccacctcgtttcgggcgctctccacccatcgcgttcaccactcgctcggcagcccccagccacctcccggtgcggcgggtggcgcaggctgttcgccgggagggggcacagctccgggtgcatttcccgcagctgcgccccacccgggccaccaagcacgg

SEQ ID NO: 5712 - DNA, 704 bp, Homo sapiens
  source 1..704: mol_type = unassigned DNA
cggtaggggtcgtggaagggcagcgccagccaggcgccatgcagctcgcgcatgaagtccagcatctcctgggagctgccgtcggctgacacgaagaccacttcgaagggcgcgggccgccgcgcctcggccaccagcgccgtatagaagtcgcagagcagcggcgtgaagtcgcggctcggcgcgcaccgggccgccgcgaagtacagtgccaccaccttgttctgcagcgccgcctcggcctccaccgtcgcgcccttacaggtcaccaggtgccgctcgcccagaatgtcaaccatggcgcagacacgcagccacctgagacccgaggacacctgcaggaggatgatcacctgcggggaggcggcggcgagcgccgcggtgccccgcctctgtccgcaccaccgggcgctggacctctcaagacctgccccagatgcgcccacaccttggccaggcctcgcctgtggctggagcaattgtgttcgcgccgacaatgagacactcagacaccagagaccccagatacctgggcgacagcgcggcacccgcctctgggagcggggccagccaggcaacctcaagccctcaggtctctgcaccctcccccaactgcgccccgcccacactcctgcgccctcccaccactgcgccccgcccacattccccgcaagctccccaactgcgccccgcccacattccgc

SEQ ID NO: 5713 - DNA, 950 bp, Homo sapiens
  source 1..950: mol_type = unassigned DNA
cgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaaggtgggtgcgggcgcgggccgccctgggggctgggggttctggggccagttcggggcagactccttcattccctgaagcccggggtgcggggcgctcccgcgactgtcacgttagaggcaagcaaatgcgcactccttagcaatcagctcgcttgacagcggtgaggagggaactacaaatgcgcttttcccgcatccattgggaaaaggtttaccactcgggtggcccgctccgtcccgg

SEQ ID NO: 5714 - DNA, 4861 bp, Homo sapiens
  source 1..4861: mol_type = unassigned DNA
cgcggcctttgcccctcctcctcccgacctttccggggctacctaaaagccgatcaagccgccggttttctagctgttcccatttctttaccgcccccttcctctgccccgcctgcctctgtgccctccgtcacgtcacagcccgctggctctcacgcctcttttggtctctctgcgcacatctcggtggcgtctctggtgccctcacatcactgtctggaatcttgtttggcccacgccgtctgcctctgccccttctctcacctgtgtcgtttgatccctccgactctcgtctctgggggtcttgcctcccgaactctccggctctctccttccagggcgtgcgctccgctcagtctccctcggtctcggtcggccggcctctttcacgtggccccctcctttttggcctcccttccgcctccctcccttctgggtccctccctccggctcagcctaggggttgggggcggcggcgcggggcggggcggggcggggcggtgacgcggggctggccgggcaagaggcgcggcggcgtggggagggggcgcagtcccgggttcgaccggccgagccccgcgcgccccgcccgcgccctgcgcctccgcccggccggccggcgggggagggggcatgagccggcgcccgcgcgccgccccgagctgcgggccggcctagagccccgcgcgggccccgcgccggagccaagccgtcgccgccgccgccgccaaaccgcgggcgcagcagtgggcgccgcgatgcagcggccgggggagccgggcgccgcgcgcttcggcccgcccgagggctgcgcggaccaccggccgcaccgctatcgcagcttcatgattgaggagatcctcacggagccacccgggcccaagggcgccgcgcccgcagccgccgctgccgcggcgggcgagctgctgaagttcggcgtgcaggcgctgctggcggcgcggcccttccacagccacctgggtacgtgtggcggccgcggggtcgcgggccgggcttggcgggagacagcgagctgaaccgcgggggcgccccgagcctcctccggcatcgaagcagccccgggaagctgctctgggagcgcaggttctgggaccgtctctcggagccctccaggcgggaggcggagggtgcaagctccaggcctcacagaaaccaggcctcgtgcccgcgggccgcccggggagggtgttcgctctttccttcactgcttcccttcggcctccagcccggggaccccgagtgagcatccccagtgcaggcgcactgccaggctacggactctcgtgggtggaagcgacctcaggccacgggcgcctgggcttcgccgcagagggatggccgggagtggccgcggctgcccaacccagggaagtcggacctctggggaggaggcctgcgctcccgagggctgggtgctgacgcgggcccaagccggcccggagtccccgggagctccagcgggcgaggaacgcggccttggccgcagtgcggacctgcttcggccttgccttggggccagaggcctgactgtgagcagctgcctggctgtcccttctggtttcaggtcggctgggcctctgcagggcttgaacggcctgcgcagaccttttcagcttctgccctttcttctaatttggcggggcctgctctgccctgatggtgctgtctccatcgcactccaccctcgtcttgtctttccctatctcgctttccaaccgtctgccggtcggcctccctcgcttctctcattggggtcggcctgcctcccatctcccaccttttccctacgggtcctctgccccacatttacctgcgccttgccctgccctttccgactccagccaggctaggactcgcacctcagtgacaggcctgtcggggaagggaggctcctacgctgtagccgggaccccagcccttcaagtcgccttccctgcacccccccacctcctagtcggtgctccctagcctggagacggcagggccagcgcgctccttctaagtccagctgggactcggccattcggctacctttcgtctccatctgctctgttgctactaattcgtttgaagcgggcacacaatcattttaggactgaagaaaatggaaacatctgcatggggaagcgtctgaaaatagaaaacgtgaacaataatttccaggttctcagggtactttggaatttccgggaagcacccaactccggcccagatgactcctggccaccgcatggctgttgtgccacgcacggaagagcaaatgtgcacgctccgtgcatgttctttttctaacgcagcaaggctgatttggttggagcaaacgccatcttcttaggaccagctgccgttttctttttggtttctactttccccgaaagacaagacacactccgagtttctcgcagctgcaaacatgttcatcaggaaccccgagatctcagaggcagctgaggcctggggaactccaggacagaacacggacagggtcgaggagatactccctcccaaatctggggaacggcaacgttgaggagggtctccatctgcgccaccggcgccgaccggcagggcgtggaggttttgcgctgggaggcactggccaagcgcgagcacccccgcggcacgtggtgcggcagtccctggggcagaggagcgcggccgtagctcacccgggtcctcattctctttcttcgcagccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacaggtagggcggtacaaggctggggccagcgggctgtgggagtgtggtcacttgccttgctgagggtgcgccctgctctttccagaatagatcttgctgagtccctgggcctgagccagttgcaggtgaagacgtggtaccagaatcggaggatgaagtggaagaaaatagtgagtgtgcctggtggcttcccacccctcagcttcctgggccatgccccggtgcatgcagagctgctctcctctttctccccactgagactctgcccaaccccccgattccctcggtgcctggtacgcaccggaatcctctcagttttttctgccccttgggtaagccaacatttcgtcctttcccgcggcaccttcaggcctcctggcagtcttatgctccccaggccgggccgctccccaggcggcatttggacaaatggccgccatttcccgggacatttccccaccatttcctcatatggaccctgcactccttagtcctacctgggttcaagtctcctcgggggtccccagtccacgtgctggctcacccaggtgctggcggtcccccgtgcaggtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaatcgggctcggtggagcagcttctgaatccgcagggggtgagggtgggggtgggggtgggctcggcaagataagcggaacgcgggcagttgcttcttaaacttcctttcctccggctctgtcgaaggcagctgtgctcttcaccatcaagcccgggctaggcacggcgggcggctcggtggctgcaggatcctaggaatcgcttccactctgggcgtgaggggccagtctgaactccacctcctctcccttgccagccagagagtcgctggcaggagcggtctggccgcaccgcgggtgcccaaaggagcgggagccagaggtccgccgcagagctcgctccggaagtggcccggacagagagccgcctcggttgttgtttcggtttcctgggacttgaaggaccagttcgtgcggtccttgagatggtcttcaccaaccctttatgaggcggatgggaagtcgaggacgcaaggtttggacagagcccccccaccagcgcggtagcccgcccgcgggtccttgcagcagcaatggctccccagagttctcacattttccgcaggatactcagggcggcggcgc

SEQ ID NO: 5715 - DNA, 999 bp, Homo sapiens
  source 1..999: mol_type = unassigned DNA
cgctgggagccggggcgcgcccctgcctttcgcgtcaggagaaccacctccgcctccggagggagtccgtccccgtgagggccgctcccagccccggctcgccgtctgaagacagcagttccgggaaccgcgacgacagcatcgaactggagatcaggaagttttggtggaaaaggccaaggagtggtgtgcacgcggagcccgggacccgggcggggacagagcgggagcgcgggcgcagcccgttagcgccggcggcagagtctcagccagaggctgcgaggggcccaacaggccgccaaaggtgcttctggccagagatgccacagcgcgcacctaggcaggaggcacaggggacctttcacaggggctgcgggagctggcgcttccccgccctaggccgggagctgagaggggctctagcgcccaggccgactgcgccctgaccgggagccactgcgcccagcgcagcccgagggcgctgagctcggaggatgcggcgcggggcgggggtctcgggagcaacagagactgggatccgagggcccggcccgcgctgctgcccacgcagcgcttccactttggaaagagtgtctcccgcgcggcgggccggcctctccagcgcgcacctggggctgcctctgcagggccacccccgcctccagggaggcccacgctcgccggcgaggaaggatggtgagccctggcccagcgggaaggctggaggaacgcaggctcggaggaaaaagccttttagacctgggccatcaacgaaggtctctatagggactaccaggaccgggacgccgtgggcagaggcgccatgccttctgcgccacctccctggggaccgcgcgttagctcgtggtgcagggccgagccctggggctgtgagcgcgcgtcccgtcttcgtgcgctggtggaaagcggggtgtccgtgcgtgcgtctgcgagcgtgtgtcggctgtaaccgcagggagcgcaaacaggccgttacgc

SEQ ID NO: 5716 - DNA, 1750 bp, Homo sapiens
  source 1..1750: mol_type = unassigned DNA
cgcgcacgcattccagaggccacccagaccatgctccgccgcctgggcgcccaagctgcagtcgccctctgtgtgcaggcagcagctgcctggcaacctccgagcccgctcgcgctcccagcatcgcagaaccagggccaggtgtcccagtggctgcagccaagccaggcattctgcccagcggcggctgcacaggagcagaaccgagaacccgccgctcaaccccacacggggtgactgccgagtgcccatgccagcggccccaatccccctcaggtggaggagtgggcgggaggcacgacctgggggccctcaggctgggcgcgctggcgatcccgaggccgaccaggccatgcacctccagcccgcctgggcacccaagctgcagccgccttctgtgtgcaggcagcagcctccaggcaactctcgagcccgcccgcactccccacatctcagaaccagggccagatgtccctgtggctgcggccaagccaggcggtctgtcctgcagcagctgcacaggggcgggaaccggccctcagccccatccccggtggttgcagagggcccctggctagaggtctcgagctctggcagaggaggagccgggtgggggcagggtctggcgggctctcaggccaggggcactcgcgatccagaggccgcccaggccatgctccaccacctgggcgcccagctacaggcgccaggcaactcccaagctggctggcgcgcccagcctcgcagaaccggggctagatgtcgctgtggctgcggccaagccaggcggtctgcccgcggcggctgcaccggggcaggaaccgaccctcagccccatccccggtggctgcggagagcccctgccagcggccccatctctcttcggaggaggagaggagcgggagtcacggccaggcgggccctcaggcgggaagggatgcgcgcctgcgattccgggatgtcctgcgcgagcccaggagaacccgcaagccagcggcgcctgcgcccgagctgcagccgccctctgccgtccacgcgagctcgagagcggctcccggagtccgggctagcgccgagctgcaggcgcgcgcctaaccgctttgctgggctcacgcggtctgagaggtcggagcgcccaactgctggcacgcgagtaacggcttagttaagctcactcggtctgagaggtcggaggctgcgagtgtcgctgctgaaggctgtggtggaccgggctggatcgcggattctgagctacatcgcggggttgggggtggatcttgggtttgggggtggattgctggtttggtggtggatcttggatttaggggtggatagcggggtggggagggggatcgcggatttggaacttggtcggggtggaaaggccacgaggagccgcggcggctcagtagcgggtggttggcgtctgagaagtcgccaccatgaggaaactcttcagtttcgggagacgcctgggccaggcgctcctgagctccatggaccaagagtacgcgggtcgggggtaccacatcggggactgggaactgcggaagatccacagggtggccatcaagggcgacgccgcggaggtggagcgctgcctgactcgcaggttccgggacttggatgcccgcgacagaaaggacaggtagcgggggctcagcccgcggtgggagggggcccccaggccctgtttgcccgcagcgcctgaggcgggggccttggaggtcgccgggccctggagccgcga

SEQ ID NO: 5717 - DNA, 391 bp, Homo sapiens
  source 1..391: mol_type = unassigned DNA
cggtgctggagcgaggatgcgcagaccgaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcacggatggcgcggccgccccggcagcacccgggggtctgggcgtcgctgctcctgctgctactgacggggcccgccgcctgcgcagccagccccgcggacgacggtgcgggcccggggggccggggaccccggggacgcgcgcggggggacacgggcgccgacgaggcggtgccgcgccacgactcctcctacggcaccttcgcgggggagttctacgacctgcgc

SEQ ID NO: 5718 - DNA, 817 bp, Homo sapiens
  source 1..817: mol_type = unassigned DNA
cgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcggtaaggcgcccgcccctcccgacccgggccctagtccccgggcccttcgacccaccgctgcctgcccgtctctatcccgg

SEQ ID NO: 5719 - DNA, 814 bp, Homo sapiens
  source 1..814: mol_type = unassigned DNA
cggagcacgggttacgtgccctaggctccgggaaccagccctcactggccgagggtccgcggggccgccaggagggctccccaggttcctcccagggatggagcagctacgccttccgagtgtgcccattccaccgatggagcaaagtgaggctctcagctcgcccggatgtctctgcgccgctcgcggggcagctctcgcacagacacgcccgcaagcccccgacccgcccgccacccgcgcccagacacccgcgagcctctggggccgcagggacggtgcagcgcccgccgaggcgccctcacctacctgtgatcactgccggagacctctggcccccctccgctcgcagccacacttgcagcgtgaacgcgtcccggggcagctcgaggtcggcccggaggcgcagctgctcgcctcgcccgctgaaatagagcgcccggctcggcgggctcggctcctcggtggcgcccctcgcctcccgctgctgccgccgccgggggacgcgcacggcttcccaggcaccgcccggcggcggcggcggcggcggcgaggcgcggcggccgcgggccgcccgggtggcgcaggtggccgggccggcggcggggcgcgggggtcggccggcccgcgggtctctccgggcccggcggggacgctcggccagcccgcagcccagcgcggcgctcagcagccccaggtgcagcacccaactccagagccgcatgtccgacggttccccccgcccccccttcgcccctgcaccgccacccggagctgccagctttgggagcctcggcgcctcgactttcttcgc

SEQ ID NO: 5720 - DNA, 1429 bp, Homo sapiens
  source 1..1429: mol_type = unassigned DNA
cgcgagggaaggaccactaaacccaaagacgcgcgtgcccgtgtgttcacacagacgtgtgcttcggcgcctgcacacggccggcgcgcaggcatgcggacgcctacacgaatacataggcatgttttattgacgcatctggggcactttctttcaaagaaagtaaggaatgaaaatccaatctgagagtcaccagggttcatctggaggtcgcccaaggggcagaaaaaatttgtaatgacgctagagtgtttgtccttggtgcaactccactctcgggagggctggatacaatacgtttggaaagctcgaggggctgccttaggatctgggggcggggggtggggtactcagcaactcttgccgcgggctgctcaagaaacgtggaaacacaccctgcgactttccactcccccatacatataggcacgcgattccgtcgccacctctcggaccagcagcccacgtccaacgctgggccgaccccagatacacaggcagtcgggattcccgcccggtgcgcttgtctattcatccctctgcgtcaggctgggacgcgctccgtctgtaaaaggctcaaacgcatctcccgccgcggggcgggatctaggggcccaggccccggggtccagaggcgggtaactttgctaatctcccccagcggcggggaacgtcgcgcaaccgctgagccctgtccgccgagactaaacaagcagaggaacaggctgtaaacacacatcctgacacgtgagtgacatttacgcggtgcgagaagctgcagccaagggaaaggcaaggggtggggggagcgggcaccgacaggtacggaaccttcgcaggcgccggaaacggcggcccctcgacctccccctcccccagaaagtggcaacgaatgcctaagtcccccgaacctgccttttgtgggaggtgacaggtgaacggaattcaggtctggccactctcgccgctgcctacctccccaccatctgcttcctcgcagacaagcagacccggcgcataatgaggtagcagcctccagccggccaccgtgactaactcagaacaaaagcgctccctccacgcctcctccaacaaaggggccaccagccccggcgctccccgaaggctgcggggctcccggctgccggctgcggagctgccgcgcgcaaacttcccggggctcccggggctgccggcgccacggagccggggccgcggagggaggaagcgcaagccgcccggagaaagtgaggccagacccggcgggggagaggggagggagccgggcggccgcggaaggagggtgattgatcagtgcgcggtgcccggcgctctgtcccgttattagaggcggccaaagcagggccacgcaataacctcagaatcgccaactaattgacgctgcaggcaactacttcattgtgcgcgc

SEQ ID NO: 5721 - DNA, 7708 bp, Homo sapiens
  source 1..7708: mol_type = unassigned DNA
cggaggggaaagcgagtcccggaaacaggcgcagcttgtggcgagggtccggtggccgagctgaatcccggggctccgggagacccggtccctgcgggggaggccttttccgaagccgttattggcgggggagtagagaaaaggggaaagaaggggagtggagaaaaagggaaaggagccggccctaagtagcgaggccgaggccggccagaggcaagggcagggggcggcggcgggggaggcagccgtggggcccaggtttggccggcgccccgaaccccctcactcccgcccccagtgcccgggggcgggtcgagattccccaggatcggatccggggaggagcgaggggccgaggggagggggaggacccgggctttctctctccttttttttttttttcctctcaattaggccgattcaatggagctaaagagctcgtaaaatcatgaataatttactcgtgatctgttattaacccatcgggtttcgagctcttgtcgctgggactgaacctgtaatcaaatctgacttcgcctcattttactaaagacgagattgtaggttcaattgtctaaataatggattggaatcaaatcagtaattacgccgccaggcacacacacacaaaaagctggggctgggggaggccgggcgtccggccggtccgcgcgggactcccgcggccgcggcgcgcaaacccaggcgcaaagtgcgcggcccgggcccctcgcccgctcctgccgccgttttcgcacccccagcccgctggcagcccctcccggggtagggggaggtttccgttccaccggggcccgggcccgaggggctgcgggaagaggccgctgcggccccgccccggaaggactttccgaccccgcggcccgcggctctgctgtaagcccagcgcccggcgccccgacggcgccccctccccactcggcccccagctcgccgcccttcagtaaggtgccgccgcgcctcggagggactgtccccagagcaagaggctttgcaaggggtcgtcgtggctgggccacaggatgtgggacactgccacaaacaagctcgtgtccccgtggtcggaaccctgcacgcacacgcacacgacccgcgcccgcacaccccgtccgcgatcgcaccctccagggtccccgctttccagtcctagctgccccgcggcccacactgcggccatttctctcctgccagtgcgggaggggagggaagggcggacgccagatctaggaagactgggctgggccccgagaggccggggagatgccctctttccccaacctagtcccgggagccccgaaagagccagccgcatagccaccgccggcgcaccgaacgccgtttctctcaggactaggagccccggccaaggtcggagaggagggcacgggaacaaacacgacacacacagagacagagatagagagaaaggacggagagaacggaaaggaaaaaaagagagagggaggccagagagaaagtgagatggctgaatggagggtgtctcttgtagaggttaaacaaggcttgaaattcagcctccagcccacctcgctggggcaaacggcggctgaacagcaaaaagcagaaataaatctctgtaccttctactctctttttgcacaatcctaaaaccggcgccgaacctccgtgcccaggaaaacaatacagctccccagccaccaggtgccctggagccgagccccgcgaggtgcttccgagtggaagttgacccacttgataaatagaagcggcttggtgttgggggagccggtctgaactcggttttgtctttttttggggggtggtaggagaggagggatggaagttccagagagctacatctgtggtagtgccttcagcaaatcttaaatccgcgccaccgaccggcctaccgctgcttcaccatttaccaaactgggggctgcgttttcctcccagttccgcacacagggacacacgccccatgatcctccaagcgatttcgttggagcgaacacccgcccctcatttccctctctattcaactcagattctttaagatgaaaataactgacttcttcccgccgtagcaccctctgcacagtcttgggtttgtttttgtttttgcttttttctgcttgtgcattagactaaagggaaaaggaagaagaacacaaaatctccaaatctaattctgttgcaaacgaaagaaagaaaataattgcacataaactctagttcggaagcccggagagtcataaacctttccgggccttgcagacttcgggcagatgttgacggctcatttgccggaactcagaacctctgcagctgtcctgagcagggaggggcgcgggagggggcagagcttctccgggaatggcctggggttcaaagatgccggaaatccgaaccaagccccccacctcaccccaccccaccccaccccggcgcgaggccaggcctgctccggtctcgtccccgcccggggggctcgcttccgagggtcacggccctcaccccagcaggcgccaggaaactcggaggaaaaagtccgggaaaactgagacctgtctttaaaggaggatcgggccgagcaaaaggaaccgcagcctttgctttcctgagttccccaagcccgagttccccaagcctgccgcccttgggacatttcacgaggtcaggccgcactccaggccgagctcggcgccccgggccacagccagccctttctcttgggaccctcgccgccctgcctcgttccttcgctgccccagttcccggccctcagccgcgccaacccaaaacctgtttggcgtcagcgccgccttgctttctccatccctgccacttcctgcctagcaaagtggggcaaaggcccaaaccaaaaagccatctccaaaaaaacaatttatcagagacaaggccctgcacccggagcagcaagggaccactgcaccctctcctcccgctccagccgaggacgcacagtctggaagcccagggggctaatgtcccttctgcgaggccgtccggtgcttaaggctcgctatttgcccagcacacagagattcaatccagctcccggccgtcgaggccgcacactttcccccaaccctatgggggcgcttcgtgcgccgcgcactcaccagcgttgtaggccgccagatccgcaccggggcccgggctcttacgtttcctcggccgccccttctgcacagtgcccacgccattgtagtagggaagacccagagggttggcccctgctgcgcccagccccgcgctcttggccgccgcggctgcagcggccgccgctgccacgtcggcatggttgaagtgtgcggggtactcgccctgcagcagcgcctcgaagtgcaagcggcagtagaccaggctgtccttcatgccgaagtggtcgcccgtggtcagcatcttgttacacgtggtgcacgtgaagcagttgaggtgataaaccaagtcccgagcgcgcatcaccatctccgaggccgagatgcccaggtggcagcgggcgcagcgctgcacagagaagcgcctgtagggaccatggagggaggggctgtgggaacacacggttgggtaccccccttttcctcctccaggtgccgctgctgctgcggggggcaatcccctcctcaagacgaacaacccggcctttatttggaggatgggggggagagagaactagattttgacccaggcctggtcctgtcctaaaatagtttcccttaacacacttatgcctacagagacttctacttcacccagagtctccgcaagccctaggaaagcctttacctgggagtggagggagacacttaccacttaccccctcctcaacctttactcctccctccaaaccagcgcctgggaatcctactgacttttataatttggaagaaacacagagacagggaaagagagagagacacagacgtagagacagagacagagagaatatacatagaccctaatcctaaaactggggagaaggagaaacagagaacttggagtctactagtgattctggttctttgatcttggccacctttcattcccattttctcaaaagacctggaaatgcacccactcccacagctctctttccagctgtgtttcactccagcttgggctgcctaggtttgggggtgcctgtttctataacctcggattaactcaagaaacttcaaagagagaggggagcaaggatcccaactcaagcttttttgtggtctaagctccgagcaggagggcagcttctgctttttttctggttctcctacttcgtagacctttccaagagctccccaaattgctgctttaaaaggttatcacccaacttgtggtggcttggagaacttggggggggagcgggggagtcctgagtagtgaaccctctcctgggactaaacggaaaggagagggccaaactgtaagactgtgcctgagattggggggaggggtcctgaggggcagttgggtgggggggctacctgtagtagtcttccttgcagtagatgctaccgtccttgctgaaacaggtgagctccgactccaggttgagcttgcactcgcagcacttgaggcagcgcatgtgccactgcttgtccaccgccagcaggtagtagcggtccgagatcttgcccccgcagccggcgcacagcgcggcgcggtcactgctgatggacggcatggtctgcgaagggagggaggcggaagacagcagcgcctgcgtcagccagcggcccctccgccgccgggaaaccggcacccacaactccctctgtggccttggctaccctgaacgcggagggggctgccaggacatgcggcgcgcttccccccaccccaaaaggcccatttccatttctgggcggttcagaacccaggcctgcctgcgcagccctcgccagccacgggcccaggccgggctcctggcctaaatggctctggtgcttacctctcttccttccagtcctccctgtcctttcccccaaaatgctcgggctgtgtttagggaccaggacagctactccagtcaagccctccaagagctttccctaaactgcttcttaaatgagccacccgggggataaggtgaccattaagtcaccctccacacagaatcctctttggagagacagcggagttcctgggccccagctccagtgatccctggatccttagaccagaggttaaggccaggacaagtcagccaacttctggctcctctgccacacgggctggggccctcttgggtccggggatgaggtaagtggggtgcagggacaccctcaaagtccgtgggtgaaggacaggttcaacccaaatacttccctatccaaactgaccagcagagaaggtctaaccgaagaagcgctcagaggccgggaggacactggcgccgctgctcctgctcccggagcagagaagcttctcccgtgctccccacctccgcggcctcctaaaggtcacttctgggcccgctggtcgggcagtgtctgctcgtctggcccccagggaggcctgaggcgaggaactggctatttggggctgggcccgcggagccaggtgtagagatccaaatggagtctccttcggcgagggccaggccggagcctgaactcccagccctggcctggctaagtctgaccagtcaagggtctggggacgcgatcaacgacaaatgttggccccgaagacttcggcctctgaaactgcgctgggggttgaggaggatccccgattgccggaaagctgggagcggcccaagccggctggagccccaatgctcccagctggttcgcccttccctggcgccgctcgcggcgccgccagcaaccggagccgagaggtggaggagagcgcggggctgtcgaccccggcaccgggcaaggtgagaagggagccgccccgggccgcggatgggacttcgcttccagttcggaagaaacgctctcctctacccccagggccgagatttcggtttcaaccttgtttcccttctgcgtcccagcagccgggtttcccccgaaccgggagccaccggccttgcattctgaccgaggatccccagcacccagtcccgtgcggcacgaaggacgctccccaaacttcggggagcagaggcgctgactggcccggccccatcccagctctcagccccgaccccacagccgcgcgcctaccgtctcggtgtcgccgcggtcgatggcggagctgatggcgggagcctcgctcttggccctgcggtccatctcgtcgatgaccccgtgcacctcggggcccgacagactgtggaacagcatcgcggcgggaccggcggggccgggggcgcggctcctccgagggagggcttgccccccgcctcagctgcctggcgctcctggcgctaacgggcccggtgcatcgccaccgcggccccggccccgcccgagctcggctgagcccccaggccgggctccgggccccgggcgctcgcggggcaggacgcctcccgccgaggcgcaggggcagctacattgcggggcgcctgggcgacggcgccaaagccagggtcacaagggcacgggacaagcggggcggggggagcaggagactaggacagaggtcggcgcccgccgcgggcgctttcacgccgcgggcatcgcccgcccggcttcagcgcccggggcgcaaagcaagggcgcaaactctgcccgaggcggcgacggctgcggtcggggttcaccctgaagccgctaggtgtccgcggcggcccagctgcctggacccctcccctccctggggtgcgcccccagcccaaggcgaccctcttgggcgctgagtcggcgactggagtaggggtttctccgaagcctgcgagccgagtcgagccaccgggagaattgaagaggaggaggaagaggaggaggaggaggcggaggaggaggtggaggaggagaaaaaagaggaggagcagagtgggaggaggagccgccggccgcgggcccagccgcgcgcaatgctctccaagcgcgcgcctagcccagccccggctctgcagtccgcgccagcgcaagcctccgcgccttttctacagccgcgcctgacatcacgtcctgccgccgtgccattggccgctcggcgccccaggccctggcagcgcgtgctccgggaaggcgggagacccaagagggaggggagaggcaagaggagcagaggagagtcgagatggtgggagctggtgggcgaggctggagggcgggggtgggggggaggcagggaggagggagagcgcggggtttggagtttttaagatacgaacagcttcctgcgatatcttcagaaaggaaaattaaaccctctatcctaagaaggcgcagcaaggggatgctcgtctcactgcggtctcccctcggcctggagccgcggcctcaggcacccgcctgggaggcccgggaaggcaggcctgtggcagagttgcaagagccttcggccggccgtttcccatcgagctccgccttcggcccgggctctgcacagcgggctgcaggcggccgtgcaagcctcctgggtacccggcagagcctgagtggcgagaccggcgagagctgtgactcccggggaggggggccagccagcatatccacgctccaagcccgctagggcccaatctgcagcccagcgtgtagcttctcgctcttcccgg

SEQ ID NO: 5722 - DNA, 3969 bp, Homo sapiens
  source 1..3969: mol_type = unassigned DNA
cgtcccttctgcgagccgcgcgcgtctgcgatgcgcaggctgccctggacccttcggggactggggggactcccttgggaagttaagggggacaccctaagtgtgctttgcaaatcgtattttctgatgtgaaaaccggcatgcgcggtgcggccgcacggggagagcgcgtgcctgggggtggggggcatcgcccaggaaagcggagtcaccccgggcggaaagcgacccccgcagaaagcgccgcgcgggcgccgctgcgtgttcgccgcccacagccgcagccaaagagacgcaggcggccccacgcggcctggttcaccgccgcctgcagtgtccgcggcgcggggcgccccgaggctgggctcaccgtcctctccgcgtccttgaagatctcccgggcctcctcgaaggagcactgctcctccttgcactccctctccagggagcccggccgcagctcctccaggaacgcgttggcgcgccggcgccggtgcaggacgccgtgggcttcctcctgggttacgaagactgggaaatgcgagttccgtgaagcgcccaccgcgtgccccgcccagtgcctcggagaccgccccacggcccacgcggcgggggcatcgcaggttcccgcccgtcctggaggaggggagcggcgctgctcgcgggcctggctgggtgtcctccctgccgtgctcccgggtcagccacccccgtcgcccatccttcccggcctggcctctctgcttccgggggctgatcccgagggcgcgctcgggggcacgcgcggaagccgggccgaagggggctgcgggcgccgccgcgtaaacgtgaggctgcgggtcgatgccggcgaggagaaggcggcgcggccccgggtgccgggcaaccccctggggcccacgtgaaccgcgcgtggaaatccgtacagccgcccgcggaaatccaaatccctcgtctccacccgcaccgcgtctccggcggccagatccgccttccccaggcctccgtcctggtccgaggcgcggcccctgcccggctcccccgacagcgagccccgggcttcctcgccagctcttggcggtcctgggcttctgccgccttccccgcctccgcttggggcccctctgtcccccgcgacccctgagagctccagacctcgcgcggatcctcctggggccggtcctgagagcacagccccccgccgcagctcctggcccctccgtaaccccgacggttacttgtggacaaacaggaccgccgttttgcccatgggaagacggggctggtgagggccagagacgcccagggcgaggcaaccccgtgcgctcagctccgagcaggccgctcttcaggacgccctacagccgaggggaccgtcacccgggagcgccgtgagctgtgggcaccacgcggtggtggagagtgacccccgccccggggcggccgtgctgcccgaacctgcctcagcccgcgaggggagacgggcctgggggcaggcgggagagggaggccccgggaggaggcgagcggggctgagaggacgcgcgggaggggctctggagaggccgcaggaggcgcgttccggagggacgacctttgctgggaggacgaggcctcaggtggacgctgtgggccggtgggcaggagcccgagttctgcaggagcggcctaaattggttactgagcgcggaagaagggacggaaggtgagcgctactgggccacgtggggccgagagaaaggccactgcctgttttctttaaaatcagtttcacacgtcgacgcccctagagaactggtctggtttggaaggaggctgaggatgcaggcggggacaccaaagaatcgggctcaaggaggtgggaactcacggactccgagtcctcacaggaggtgccctgggcggcaggagtgggaggggaggcccatgtccctgcagtccccgacacccacgctcccgggacacccacgacccccgggacacccacacccccgggacacccacgccccccggacacccacgcccctgggacactcacacttctgggatacccacgcccccgggacacccacactcccgggacacccacgcccccgggacacccacactcccgggacaccctcgcctccggaacacccacactcccgggacaccctcgcctccggaacacccacactcccgggacatccactcccccgggacacccacactcccgggacacccacgcccccgggacacccacacccctgggacacccacgctcccgggacacccacgcccccgggacacccacgctcccgggacaccctcgcctccggaacacccacactcccgggacaccctcgcctccggaacacccacactcccgggacacccactcccccgggacacccacactcccgggacacccacgcccccgggacacccacacccctgggacacccacactcccgggacaccctcgcctctggaacacccacactcccgggacacccacgacccccgggacacccacacccccgggacactcacacttctgggataccctcgcctctggaacacccacactcccgggacacccacgcccccgggacacccacactcctgggacaccctcgcctccgggacacccacactcccgggacacccactcccccgggacacccacactcccgggacacccacgcccccgggacacccacgctcccgggacaccctcgcctccgggacacccacgctcctgggacaccctcgcctccggaacacccacactcccgggacacccactcccccgggacacccacactcccgggacacccacacccccgggacacccacacccccgggacacccacactcccgggacaccctcgcctccggaacacccacactcccgggacaccctcgcctccggaacacccacactcccgggacacccacaacccccgggacacccacgcccccgggacacccacactcccgggacaccctcgcctccggaacacccacactcccgggacaccctcgcctccggaacacccacactcccgggacacccacgcccctgggacacccacactcccgggacaccctcgcctccggaacacccacactcccgggacaccctcacctccggaacacccacactcccgggacacccacgcccccgggacacccacactcccgggacaccctcgcctccggaacacccacactcccgggacaccctcacctccggaacacccacactcccgggacacccacgcccccgggacacccacacccccgggacacccacgcccctgggacactcacacttctgggataccctcgcctccggaacacccacgcccccgggacacccacgcccccgggacacccacgcccccgggacacgcacactcccgggacaccctcgcctccggaacacccacactcccgggacacccacactcccgggacacccacgcccccgggacacccacactcccgggacacccacgcccccgggacacccacactcccgggacacccacgcccccgggacacccacgctcccgggacacccacgcccccgggacacccacactcccgggacaccctcgcctccgggacacccacactcccgggacacccactcccccgggacacccacactcccgggacaccctcgcctccgggacacccacactcccgggacacccactcccccgggacacccacactcccgggacacccacgcccccgggacacccacactcccgggacaccctcgcctccgggacacccacactcccgggacacccactcccccgggacacccacactcccgggacaccctcgcctccgggacacccacactcccgggacacccacgcccccgggacacccacactcccgggacacccacgcccccgggacacccacactcctgggacacccacgcccccgggacacccacactcccgg

SEQ ID NO: 5723 - DNA, 2490 bp, Homo sapiens
  source 1..2490: mol_type = unassigned DNA
cgtgaatccgagcctcggccacggtcgccactcgcccttacccacttccacgctgtagtgcgaccagccacccgcgtggcattcgccacgacccagctgggttcacagacaggagctgcctcctcccactgcaggcgggtgacccaaggcccccactgccctatacctgcccagatcgcggggcactcgggctccgcagctctctggccgcgctcggggtccggggagccgggctgcggctggggggcctggaggatgagggcgaagactcgagctggactgcggagagggtgccggcgcgggccgggcttggggggaggacacgaccgggcctccgcccccggataccgcacgcgccgatatagaggggccggcccccggccccggcgcggcgggttggcgcagggcggggtggcggctgaggggcccgggtcccaggtgcgcctcggagcggccccggcggcggtgcgggggggaacagggaggcaggatggggggcggggaggcgggaggggggagccgaggcccccgcgccgccagccccgcgcccccgcctccccgtccccggcccgagcggccgtcatcgcgggcgggcggcgctgcgcccgggtgcggctcctcgccggcggcggcggcgcggccgagaggtgcgggctccgcgcgggcgggacgcggggcgctgctcgcaggagcgaccaggtgggcgccgggccgaccgcagccgccgtcgcgccccctctcgcgtcccgggccctggctcttcgcgcttccctcctccggacttcgcctctccgcccgaggtcgctccctcgcctcgggctcggcttcccggagcccgccgacccccgcccgaggtctccccgcccgacgtcccggtggcagcggcggctcgggctgcgcctcccgttgccgtcgctgctgcggctttgtctcccccggggagggggtcccggcggctctgcgttttcgggctctcggtcccggcgccgtcgttttccgcctcctgcggcccgggcccccgtctgggtccgaccctgcggggcctcgccttggcgcttgggctcctgcccggcaggtttccgcgcgtcccctgtccccgaccctcgggctgggcgcttccgcctccaggttttctctccgtgtttctgtagctccccggcctcgtctctccggggctcctctcgtctcggcgtctctgtctgtcgtctatcgttgtgtctctggctctgcgtcagtctctcttgggttttctcttcgggcctccgctgtctctccgagtctctgatccaatcccccacccctcgtttctctctctctctctctctctcgtctctctctctctctctctctctctctgtctccctgtctctctccatccctccctgtgtctcgtccccgccgggttctctctagctgggcgtctcagtgtctgtgtctctggcactctcggactggcctcgtgtctgcgcccggtggcgtcggtcgttgtctctcgccagagtttcttcccatctctggctcccccggactctgtctctgcctccttcgtctctgtcgggttcccagaacacccgggccgggcgccccagcgctcctgggtcccctggcgtcttccccgcggctgagcccatctctttttctcagaatcggggttttgttctcagacaaacgaatcccaatcgaagcgcatcgaacccgagggccccagatcgggcgcgacggggtccgcgcgggaggagccccccggacggggcgggagcgtggggcctggcaggggaaggccgggcgcggggactgcaccggacccaccccgggacgctgcgcggggcgctcggtgggtgccggcggcagcgcctgggcacagagaggggattacgcgacgggccggcgacagcggctggggcggcggccgcggggaccccaggctgccggtctccgccggccctccctgacccgctgtccctccgcaggcggacgccgcgggcatggactattcgtacgacgaggacctggacgagctgtgccccgtgtgcggggacaaggtgtccggctaccactacggactgctcacgtgtgagagctgcaaggtgagcggcgagcgcgcggcaggggtgcggcagacgggcgctgcggggcctcgctgactctcagctcccgcagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaaggtgcgcgccgcgcgggcctcgacccctgaccccccacagcctgagggggtagggggtgggggtgggagaggggctgaggggatagtaccattggccttcgcgaaggcccctcgtgcgacattagggcccagtcgctgcaagagaaccgggcgctggcgctgggtgggcctcgggcggggaagggacgc

SEQ ID NO: 5724 - DNA, 5370 bp, Homo sapiens
  source 1..5370: mol_type = unassigned DNA
cggccggcccagcgcaggattccgggacaacggatggcaactgggggccgtccggaggctcccaggaccccatcagtgcccgctgggctgggctggtccgccccagccccaagacgcgcagctctcggaacccttggagctgcccggcccagccgcgcacagagccggcggcagagcgggcgcgggccgggcccggcagggggctgaccgggctcgagtgccgggcggtggcggggaaggaggacgagaagcgcttactgttggtagtcttgtttgcagtacagtttccgatcccggaagtagcagctggtggtgagggcttgctgacacgccgcgcactgcaaacactcctcgtgccaggacgactcgttgactcgcatcaggaagcggtcggagatgggccgctggcagccctcgcagacggcgggatgcgggcagtcggagcctgtagcgcacagggcgaaagcccggccgtcagcgccgcccggcccagccccggcgtcccggtcgcaccgggcccacagccctcggccccgagggctcgggccgcccgggatcaccgcctgccgcctgcgctccccggaccgccgcgccaggggccgggcggccccggctagtccgtcccagtcctcgggctccggcgtggagaggccgcgggcctcgagccttggctcggcgctgtgctctccccttctccggagaatccgcgctccgtgttaagacaaatgacaacgagcacggcgcagggtggccggctgggaccaagacaggcgaggtgaggctggggcgctcgctggctgacacgccccacggtggcgttcgtggtcttctatccccgatctccccaaaatctgtggtttgagtgaccagggagacgtttttctcttagaatctcccccaccccaggtgaccttgcgcctctcccaagctcgccaaggtgattgctaggtcctccatcacccctgccacccgccacctaccacatcggagtggcagctctagaacctaagcctggaaaggatggtgggtggcgactggagctgtcctgtcccctcaggacgcctgccggaggcgtacttgcggccctctggcgatcactccaggagtcctgtctctgcctcctccccatgtcctgcaaacccatttcctttatccgttggccccaacgcccgtgtccacagccggacgacgccccatcccacgcccgagaccactcgggcgttccgaccccgcactcacccagcagcacccccagagtggcgggcccggggcgcagggcgtgctcctccatcttgatgccgtccaacatcttggcgcagtccgtctgcccgcgagggaagcacctctccagcgactcgggacctgttgctatatccatgggacgcggggcgcgctgcggaccccgccggccgggctgctcgcccgccggcccgtccacccgctctccgccgccgcggccctggaaccggggaggcgcggcccccgcagggcaggggttgcgccggcccccggcgatcgtggagcggcgacgcgctggccccgggccccggcgtcgtgcgggcgggccggggcggctgcagcccgcgccgcgctctcccggacacttgcagccacgcgcgccggctcctctgtcacctgcttgtcagtcccggaacccggcggcggcggctgctgcagacggagccgcggggaggaggcggcggcggcggtggcggtggcggcggcggcaggcgggggagggggtgggggtgcaggggcggccccgcgggccgcggggggggcgcgcggcgcagcggggtcccgggcggggcgcagcgggccgcggggctccgggcgcgctccccgcgctactccagtgccatggtgcgcccgctgagccgccgggtttagagctggggctggcggcggagggatacgggccgcctcacctcccgaaacttcctgacatttgaaccccgcggccggtatccctgcgccgggatgcgccgccggctccacgtcaaatagtgccgtcccgcccccccgcgcgccccggggctccgcgcccctggcccgcgccccgcgccgcgcctggccccgagctcaggccccggctccccggcccggccgccccgcgggcccctcgcagaagttttgatcgtcttcgaaacaaatccctctgctccacccccttgaaaaattgatttgggagttggggagcgaaggctttcttttttctcctctgccttctttattattaatattttgtaaagctccagcgctacgaggagtggccccgagcgaggccagactgcgcggacggcagggagcgcggcggctccgccaggggacggcgccggccgggagtggccgcttgggaacccccgactgtcggccgaggtaggtcgcgggggctgagtcggagtcccccgggcggcggcgcctgctcggggccgcttggtccgcggagagggccggctcccaggaacgaaggacgggggcgggcagaaggcgaggacggctggccctggactcgtgcaaggggggcccaggcccaggaacggggagtgagcctggagtgtgggtgaggggtctgggaaagctccgggcctggcagagattgggcgggggactgagccgatgggaggttggggccccgggatcgagaatgggggacactgggacgacaaggaaggtcaggcctgggttcaggcgaccgagagtttagaggacaactaaggctggaaaaggggtccccgggcaggggcaggagcagtgggcaagacccgggcctcctagggtttgcagtgaggggcgctaggagggagtggtggccccagggtagcggctctgaagaaattaggttggctgccaagatcggggtcctttggcgggtcgggtgcccggccaggggtcgctgggacgcgcggatcaaggacagtgctctagccagcctgggcaaagtggacctcggcaacgggacgcgaaagctggcgagatggagctgccgacttccgcgccagccgggcctggcacccgcgtccggtgcgagaggccacagcgtcggaccggctgtctgcggcccgtggtccccaccgacgcgcggctcaccggggagcaggggggcggttgcggcccggggtagcggcgggctgaccccccgcgatccgctgcggggcggccccggcccctcccggagcgaggcagcggcgcggagccgggcgggggcggagggcatggggggcgggtcccctgacctcgctggaggcgaaagggcggatcggatttggaacctgcgggaggcttggtcagaagtggccccctgcgccgcggggccccgcggaggggcccggctttgtggaggattagaggctcccgccctaccctacctgcgtgtgtgtcggtgggtatctgtgtgtgtctgtgcgtgtcgggcccccgcctctgcggctcttgcctccgtgtgctccttggctctgcacacacggtatgtgtgtccctgcaaccttccagactcccaggggtgaatctgtggatctgtgtctgagtcccctgcacccgtgtgtatgtgaatgtgtgggtccttcgtgcctgtgtctggggtgtgtgtccgcatcatttcatgcgggggcctaagtctttgtgcgtgtctcagcctctgtgttgtgtctgcgatccttttctgtatgggtgtctctgtcagctttgcgtatctgtgcttatctccggggttctgaatgcttctgtgtgctcgcgtgtctcctagcgtgtgtgtgtgtgtgtgtgtttgtgtgtggtggggggctttgtgccttcgtgtatttctaggcgcctttgtgtggctaggtcggggagagtggacagtcaatgtggagtttctctcccacatctcggtcccctctttgcttgacctggaaaccccaggcctggacccgcgaagttgggctgggcctgagccgccttctccgggcatctggggcgggggcgcggctgctgcagggagaagccgggcgggcaaggcttcggcgcacagagccagagtcccgaggcgcggagcgcggctcggggccggcgggcggaccaggcactttctgccctctgctggtcgcggtccatccctgcaaccggggctgggcgactgcctgcaggcgagagtcctcgttccaggcccagaccctctccctctccttcagggtgcacatggtaatactctctcgtcacaggccctgcacccccaactcctggcgcaaggctccatcccctccccaccttccctgtgcctggcctctcctaccctacagctctcctttccccctccttggctgaatgagggcccctgcgatccagtctcccaggcttctctaactcgggttggcgtccagtgccgatctggggccgctggctgtgcccagaggcgcattccccggaccactcgaaggcctggtctcaaggcaggaggacttgtgggaagtaccccctccgtgccgcgtctggtctgtccgggtgcgcatgcattctcagcgcctcttccgcgctcctgccagtcatatcccacgccaccaaggcggatatagggtggtctgccgccatgcggcccgcgcccagataggggcgctggctcggtggacgccagagcctggctgccttctctggtctggggtggggctgctgagtccacaccccttgggcccctctgcatgccttccccgctgtccattcattccccctacacacacacacacacacacacacacacacacacacacacacacacacacacacacacacaccctccctataggccccgttccttgccctttgtcctcactcctcgtgtcccgtgctcccagctgagttggccggtctcgggtccttcgcacgcagacgcgcaggggtcccagatctctccagcacaatcggggctcccgcgcctctccaccgcttcccttgccgaagaagcgaagaagcggccgactggacggcacagcaggggccgaggcccagagccggctcctgcccgcaggcggcgaacggcaccttgctccgccaggcccctgcgggtgtgatccgtgacccgcagattctcccgggcgcctctggcccatgacgcgggggctgctcgctccacgcaggcggcttcgggatgctctcccgctcagatttcagcggcagaaacagcctcggattctctctacctgggggaaagactgagtcgggggctcggaatcactggaagaagcgagaatggaaagggaggctctggagcgggggtcccggctccttccagtctgcggacgccccagctccattgagccccgccctagtccccccgctcctcttcttagggccttgcaccctctcctctgcgctacccgcctccctcgagcacgg

SEQ ID NO: 5725 - DNA, 3120 bp, Homo sapiens
  source 1..3120: mol_type = unassigned DNA
cggacggaccggcggacgctgcgggcccggccgggctgataggaaccatctgcgttgtcttaggccgcccttcggcccactgtccctctgaactcggccggttcccgcgggccgtttgatgcttgcagggtcacagacccccgcacacaaatcaccgccgcggggctgggggtggggcggaggcgctgaaacctaatccgcagagtttgctccgccgccgcctccttgctccttccctcgctcgctcgacgccccccacccacccctttccaaacaaggcttatttttcttgccaaaaaaacaaagttggtatcaagtgtttcgagggagaaagtctctcccccacccctgacctggaaggaagggccggttgccgactgagccgggattgcagagggggctccaggagaggacgggcgggaggtgagctcagggcttctggctccatcggtccccttccccgctctcgcctgcccgtcccatacttaatggcagcgaatcccatggtccccggccatgtcctgtccctctactcgtcctgcccggaaagggtttcctccatcggagctcccggtccctatgctgtcagagatggaagcatcacttcctgctccttctccctccccataaaacagtccttgcctgtcgcttttacgaggtgacaccctgctctcagcccgatcctccctgcgcccggagcctgggctcggcgcgcaggagactgcgtgcactctggcgtccccgacctctgccagggcgcacggggactccagagcggatcctctacgagttctaataggaggccagggagccgggacatcagagacaaattcctccgaagtccccctccggttccactgactggagcctttgggctgaaaccccacgagctccccacccccatgtccatgaggggagcaaaacggagcccccgggggcacgcaggcttcgtttctgggtgttggttttgcttttggttttttcagccggtgcagtgacccggaacagcgcggccgcttctccgacgcccgcggctccccactgcgccgaggcgagcgccacggctaaagcccaagcctcggcgcccgctgcgcctgccggagttctgcttgtccgagcaggcagcggggctcaggcacggcggcgacgtcgaagggccagtcggcagacagggctgggtctctgcggccagagcgccgcaggaaagccctgcaaacggtgggacgagggtggcggcggcggcggcggaggtggcgagaaaggcgccacgggcctggcggagaagagggtttccgtgggggtggaacaaaggaattcaccctcggaagaaaggggccgagcatgcagccgggaatggccaaccctggagacctgcaggagtgcgagcgctgcgacattagtcccagggatccaacgaaatctgccccgccgagggccccagcctggcatctccattcggcctctctcttctggtcaatcccgctttaatgggggtggtgggtgtgcacccggagtgccacctttcctgggaagaggggacagagcaggacccgtgctctcggtcagaggaggcaaacacatcccactaaccctccccccattcatcctctagtcgtggggtcactgtccccattttccagacgctgccaattaaggcacccgcaaaaccaccccttcccccgcccccacggcaacgctccggctcctgaggcccaagcgcgctcggaaacgaaaagcgtcagggggctacagggccggagccccctcttcccgccgtcctcggaaggggtggaggggacacggttgtaaggtgctcggcttcttttctgtgcttgacatgaataaggggattaggatggcaagtttccgtcgttcactccgtgggacaaagggccccgcggtttgagcggcacagcctctgattaaacgacagagccctgtcactcagcaccatcctaggtacttgtgttcgtgacataatcttattagaagataaaaccggcgaaatccttttcataatgaaaagttacatttaatggccggactctccccccacctccctccccggagcctgctcgcctttccccgttgctgttggatatggctcgcctataattggcatttaaagcaccaagtccgggagaaaaacggggtttagggtttttgtaatccccctaaactgtctttgttcgaaatctccacagatacaagtctgttaagagtaaatatttgtggattgatacaaccacatttcccccctgcaaaccaaatccaaaaaaaaaaaaacaagataaaaaaaaacctgccactcgccgccctcgggctggggcgcaggagggagggggctggggtcggccctagcatccgcgccgggaactcggctttcgggccgcctggttgcctccaggagctgagggacttcgcacgtttctcaggcgggaaaagggtcttagattctcccccgcaacccctaattttctgttctctcaataaacaaacctcccgaacttgctgcttttggccagcccgagggggtcggcaggagggcttggggaggggcgagggctgtgctcaacaaggaatgaaaatgccagctctccccgccagtcttactccctccagcgggagcctgcagtggctccaaggagaatcactggctctttctggaccgcgtaaggccccacctggcggggcaccccgaccccagcccaagagagcccccgagccaccaagggtccccgaaacgctgagaagcccgaaagctgctgcagggccctggactccgggcttcagcctagcgcgtcccaggatcgaattcctccataaatcagctgctgggtgaaagggctgcgctttagaaagggcaggaccgtgtgcgcgtattagagcgcgcggttcccaaatccgggctaaacccctggtgacaccgaaattcatcaaccgccgctggtgcccgcggctcggctgcggagcccaggagcctatgcatggtgtcatcccactcccagtaaagaacatgctgcacgaaccgccgagaggtgggcctggaggggtgcgcgggtggaggccgctgaaagccgccccatccgcgtgtccggacgtcgaaggaagctctcccgc

SEQ ID NO: 5726 - DNA, 3120 bp, Homo sapiens; identical to SEQ ID NO: 5725
  source 1..3120: mol_type = unassigned DNA

SEQ ID NO: 5727 - DNA, 7861 bp, Homo sapiens
  source 1..7861: mol_type = unassigned DNA
cggattttcggcacgggttgggaggagcctagaggcggggtgagctccaggctcgggcggcttagagtcccggctcagggggcgtccaggccaggagtgtccgccgctctcagcccgggtggaagcggcgacggccggacgcccgagtcctacccgcgaccagcgcccctcgccggcccttgcgcccctctgccccagcccgcgcgtacctcccacatgaggttgttgttcttgcagatgtccacgtgctccggggcgatcacgcggccggtgaaggggcccatctcggttcccgccttgatccacgtcttggagaagatgccgaggccctcgccagggatggagctctgagcgatgatcacctccgcaggcagcaccaggctggacagcttctgcacttctgcggcggcggggccaggaaaaccggtcagagcccgaggcagccgaggcccggcccttccttccccgccgggaccccggcttcggtcctgcccagaccagccaaacccaagtcggccccaaatccagagaagccacccgggtgtggaggaagtcggatgtgcggaggctcaacgacctctcctctgtttgcaacctggagaccctccgtgccctggaaagcgagtggtgcgttggggatcatttttagaagtgggtttttagtctctccgcgaattctcaaagcattcgcaacttcttccatcctctgccccggataagtttaagaattaatgagccaacggcagcgagcggttttatgcacagggaaactgaggccaggtcctgcaaggaggtgaaggccaaccggagactctttcgcctagtcggcttccgggagcccactgtgtgtccaggctctgggcactggcagaggagccgggccgtgatcagcgctggggacagacctcgggctggcaggtgttggaggtgccaaagaagcaccggcagcagctggccaggctctgcgctcgctgtgtgaccccgggcgcgcccgagtccctctctgctcccaggccctggggtgccagggagggcggcgcccgggctcagacaaaccccgatgtcatctctctgggcggggaggagccgcggcggcccccagctccccgagggttcccctgtcgggcatctgcggcagggctggaagcggcgaggcgcacaagggcggcctccatgtcttacaaggttcccctctaagctacctgggaaaatacccggcgagcgggccggctgaaaggggggggttaaacggtgtccattgcggcgcggcgggcaatttgtcacgctgttaaagtgatcgcattcattcggctccattcgaaagaaattgctaattctaaattcattagccctggaagaatgctgtagcagtaaattgtagctcaatgcggaggggacttgtttaaaaggggccgaggaattccccttacaaaaaagggggattagatggttgacatagcgtgaatggaagtggaattagtcttcacggtaaattaagagaggaacagaaatcgtaaagggggaaaagagggcgacgcgcagagatgccagagccagggaaagatattgtttgcgggttgatgaatgaggaataagaacttgagacatcttaaagaaaagaaacttttctcgctctctctttctctccctcgctctccccgcggctttttctccccgcccgccctccctccaccccctccccagccccggctgccttttaaagttcttggtttaagtgggaactttcgtgggtcaagcccaagttaactaaatgaatttaaaaccccttctttttgagtcaactgctattacacgcctagtaaggctgtaaatgccgggaacccgccagctcaagcgcaggaggggaagggaggggccggcgggggcgtcggggccgagcgacggggtcgccggggtcggtccttgagccgggtgggctgcggagctgcttggtggctcgcgtcctggtttggcccatggggaaactgaggtgcaccgagcgccgggagagcccaggttggcgcgagtagcagcgaggccgggtatcccagccgcgtctcgcgcatcgccaggacgggaatgggggtcgccgggaggagggattgcgccgggctccgacggctggactcaccgccggagaaggactgcgccagcacctcggcggtgaaggctgtcttggggctggcgtggtggctcttgtcctcgaagagctgctccccgagcacgttgcgccagcggccgtacaggaagctgtgcaggatgtcggaggtgataacctcggccagcgccagtcccggcgccttcagcccggtcttgagcaccagggcctcagccgggagcacggagcccatcatgggcggcccggagctccccggcgccgggggacggccgggccgacgggggaggtgggcgggcgagaggggagcccaaggggcgagaggagagcgctgcgatggagaaggaaccagagcagggggaggacggagaggaggaggacgcaggagggagcgggaggtgagggggcgactgggaggaaagcgaacgagggggagaggggaagagagatggtgaaatctgtagagatggcaaaggcggcgcggagggtggagagacgcgggtggaggcggaggcgggtgcggggggtgcagggtgggtgagaggcgggtggttgcagggaagcggcagcaaggggctcaggcgcgcgctagcctctcgcacactcggccggggccgtcttccccttggcaaaatctcagcgcctttataggagccgcagtgaccctcctaattggttattaatgaccccctgacgtcggaggacagacttgttgtacccggctgggctcgaggagccttcgtcgcgagagcgcgaggggcgggggcgcgcggaccgctccaaacagtacccctccactcctctctccccttcctggtccttcctcccccctcctgtttttccttctctccccgtgggaagcgcagggcagggagggaggctcagccggctctgaggagaggaggggacggagaaggggagggggtgcggcgaggctctctaggactccagggaccaggctagacaagaggggacgcctggcttcgggccccgcgctcccctcaggcctgatctatgttcaccggcctggcccagcccggcgttcacctttactttgctgccccggctggccggcccagccctgcaccgctctccctccccggccagagcccgcgtcctcttccctctccggccctgcactccccgggccgccacagtcgccccgagctcgcgcgcagccctagttgccacgcggatcccctgctcagactgcgctgctgaagccggcgcttcgcttcatacgggccgcgccaactcggtcgctgtgcacggtcgggtgcgaaactcctccgcgggctcacggggctgccgaggcggggccgcagcggccgtcggggctggggctggtcccggcctgagacagcttcatggaaggccaggctcccggcccttgcggggccaggtcgggggtcgagatgggcggacaggaatcgccctggcagcctgtctctgggaaaagaatttcctacgggatatagggggattgaaaggggtcccgagacccttcctaggtgggagcaggcgtgcctgagagcgaagtccctcagaaactgcaggcagctccgcgagaggcctcagtgcgggttcggcttgcggcccggctttccggctccttgctgagctgcaacctcgggaagccggtggcgttgcggcgccccttccttcttgcctcctagttctttctttctcctctgcctctctcttctttcccttcctctcctctattcctcctgcccatcatcccaggagcagacttgctttgcggcggtttcgaggcacctcggagcccagcgatcccctctcccgaagcaggtagctgctgagcccagcggaaggccccgcttcctgcaggcttcgcggctccccagtgtcagcctcaagcctcggaccccaggccctgacatgctgggtgagggagctcaccccacctgccgcacttctggctcccatcaccagcctacaatttcagatgccgctaacagaggtgcctggaccctctcggcgtgggtcaggctcacggattagtctccgctggactgtgtggactccctagaccttctcctcagcgcggaggacttgggtggaagaacagcgagctgacctcccatgagcgagaccctgtccaaacgcctgttggcatagacgcccctccaccacccggacgcgccttggctaagagggtctcacacctggcgtccagactccagacccctggtccccagttcctgccagtagtctccggcatcccccgtccccgttgggacgcaaagggaggaaggcggcggtagctggccttcagaccctgcgtccgggtccgcccgaggctggagcccaaggaagggcacacctggcagaaggcaggaccgttgggcagggcgccagcagagggcagcgctgctgaggagggaggtgggttagggtcgccgaaccctccactcatttttcgacgcagcttgtgggtcgcatcggctccctggccagagctcgagtctgagggggcgtatggagtccgatggctcctgcaggggagcctcaccggggcctacttcttggcttctgggaagacctaggtggagaggacaaagtgctaggagcgagggagacgacgtcggggagcgctgccaggagccaagcgctgcggcagctcccaagccccgaaagcgacctcagttcctccaggacaccaaagggggataaggactgctgtgtgtcctgtggactgcccctttcctctctgggcctcggtgtccctgtctgtgcaatggtttgagttggactttgtgaactgaggtttctttgcttggtctctctttgggtaagatcactttaccccacgacaaccccgaggattttgccctctccagggccacgtcccactgcgggaagccctcaggtctgtgcatcctccgtgctggggtgcagcgtttgggtcctgaaccccggcttagagttagaggcttggattccgctggcgcagtgaccacgggctcggactgcggccagggagtcccattcctctcctccggacccgcaagcccggagagcagtactgggagccgggcagaagcggagcgcagaacgtcctcccagctggtgcgcccaaatctccaccgcgctcacattttgtgcttctagtctagcggcaaaacccacctggacccccgcccggggaaaaaggagcccgtaggtagcgcccagtctcaaggtgcattgaaatagggagcaagaccctgtgctcacatctccccgggaggagatttcgaggggaaacattccgggctttcccagcggatgacccgtgttattttgtcattttccgcggggcccaggcgcggaatgtgctcgcgcaaaagccccctcccctcggccgggccggagctctcaggctccgtcgcccccctcgcccgctggccgccacttggcgatctctttaatattcatgggcgttaatagagaggccctcagtatatcggtccattgtgggcggctcgtaggacttgaataggcctcggccccctttcttcggcgcggcttcccgaggggccgggccaggagtgaatggccccgcttcccgctccgcgccccctccccctttcagggagaacatctttatcctcttctccgctgccgccgccgcccgggcccccattcacgcggccccggctccgggcggaacgaatcaatttgccgcggctcttcggaggtcatcctcgccgcccgggtgccctcttcccctgagcccacgggagtggagagagggccgccgcggcaggccgacggccccacggagggacattgaaggggaagtggaggagaagagcaggggcgacccggaggggtggctgggccggggcgggcaagacagtctcagggcccggcagccgcccggggttggctaatttctagttgttgccccgctcagggcggagcgccgaggggaaggaggccgcggcccaagcccggaggtccgttcgtcctccccttgaggcaccagcgcgcgtcccttcggcccggctgaggcacctatgagaacgggggcgtgtgggacagcccagggccccgcacgacgctttcgttctcgccggtgcgccggggcttagctccgggagagccaggtcccgacagtgcgcttcagggggacgctcggaagggcggccggcttcgcggctcctgcgccctcgctctggggcccgggcctgggtgcgggggaggggggtgcgagtcggtcaggcggggccaaagcgcacgggtccccgccctgcccgccccgccggccctcagaggcgcagaaagaagcccattgtccgccgagaaatacatttttgggggccgagtgaaagcccgtctttcttttgaactttagaagaaagtctcctgttctcgcccctcggagggagagatttgtcccccctcccgggagctccgcgcgcctcctcctcccgaaacatctgccgggggaaaatccaccctggagggcagatcgcgctcgctttaagcctggcgaactcattaaaaagatattagcggcgggggcaggtcccgcgcaggtatcgatcggccggaatgagcccgaggaagaaaaggcgaagaatgcgcccgcgccgcgctcagacgcccacccgccccgcccagcccctgcgccccagccccgcatagggagaggggcccccgcgccgcctcgcactgtctgtgagtcccgcggcccgcggtccagccgcccccacccgggctcctcggcacagcccctcggcaaccctcccctgccggtgctgcgctccgtcctggcttcccctgcgcgcaggttcccggccgctcccctcctccgcccgctgccgtcgcgcgcccagcatccgcgtctctcttctccccctctccttctcttcctccttccccagcgctcccctctttcgctggcgctccgactccctctccagcttcgcacaccctctccgcttcctcctcgcacgtctctctctggctttctgagcctcaatctttcgcagtggcccaggaaattccttcctcgcgtggggcccgcgccgctcccctccccccacccccgttccccgtaagacggttcagggttccagggcgcccccgccggcgcgtacaaaggcgcggctggctgccaaggcgggtgggggcgaggccgaaaaaaacggtttcaacagacgtgactcggggccaggcctgcgcggggctgccggcggagtggcggcctcggctcagtgaatggggacagcggccccctctcccaccccacccctgtcccctcccaatgtaattagctttcaaggctcgggagagacaaaggcgcgccccggggcgcccacgtggagtgcgtaggcgcgaagtcggcgccccgaccggcaggtgactggcacgcgagtctccccaggcgcccaggggcggaggaggggaagcccctcccctgcgcctctcgaacccccttccatcgcccacaccccggtccccaggccagcgatgccagcgccacagcccaggctgatcaaggcggcgggaacgacgggagagacgccggggacaccaggagaccgggcggtgggagagacagaggcgcaggcttctggaagcagagggggcgagacaggggtcgggggagactgaggcaaggcgatgccgaggtggagggagcagatgaaaggccgagtcggagacgcaggggtacaaagactcggagatgaaggaagcagagggggagaggcacggcttccgaaagagcgg

SEQ ID NO: 5728 - DNA, 1434 bp, Homo sapiens
  source 1..1434: mol_type = unassigned DNA
cggccccgcggcgaggggcccagacgaaggaaacgccgccccaggggcgcgcgggcggagatggagtggcccaggctgggggagcggggagcagggtcgccaccgctgcgccggcccgcgacgcctgcccttgcccgccctgctccccgccgcctccctgggcgactcgggtcccgcgcggcgcccgcccagcccggggctccggaccgaggagggggaggaggaggaggaggaggagccgcgccaaggcggccggcgggcgcacttacgccggtgctgcggtccagcgtcccgccgccggccgccgagagcttggtggtgttgaggcccaccagcgagggcagcgtctgggacatccagttagtgatcatggccatggtgctcagcacgaccccgatcttgagcagcggcaccgacatcgcgcctcgagctgcctccagcgcccgctccgagctggcaccggctcccgcgcccaggcggccttcaggcggcgggcaccgcggcgggcaggggcgcctggctgtgtccccgcgccccctcggcccgccgccgcccgcccgccgccgccgccgccccgcgcgccccggccatcgccgcgccttccccgggcgccagggaaggtggccaggtggcctctgcccgccgcgccctgcgcctcgcgccgcccgccctgcgccctgccttgcccggctgcgtccctccgggctcctccgccgccaccgggaagcgccgtccggctctgagcgctgcgcgggctgcgcgcgggggccgcggccgggaggcggggctcggccgggcgggaccgacgcaatccgcccaggaaatgggtggatttttcctctcgctcggctccccgccgccccctggctgctggcagcgaggtctgcaaactccagtccgcccaggagttgggatcagggtgacatgaggagacggacacaccaccacccccagatcataaaatacccggcggcggcgcggggactccagctgggggcacggcccgcggccctcccgtcccggggcttctcccatcctcacgccggggcatccctctccgatccccgcagagggtccgctttggggcaaaggttgccggcagagagacggcgccgtcctgcctactggagcccttttccgcggtgattcgagggtcccagccagcctgggccgtcgcctgaaacccagcaggcagggcaggctccgaaaagcagccagactcgcgagggcctccagcgccaggggggcgtcggggcatcggtggagagctaaaggcgcccctgcgatcccagggcagccgcggtgccctaaggccttgcttgggaggaagggagccaaccggcactcctgacacctgcacagcaaggcgggggctggggtggtctgccgtggcccgcggtgcgcagtgagggccctgggagggcgcacacccgg

SEQ ID NO: 5729 - DNA, 5053 bp, Homo sapiens
  source 1..5053: mol_type = unassigned DNA
cggtccggcaccttgcggttccggtacgcagccctcggcgccacactcaccccttctgcgtttcgggttgagctcccgccgaccatctgctgctcccgaggccaaacctcagcggcgggaggaccctgctgccttctcgacccctctcccgggaaccttagccctcctggcgtgtgctccagctcaggcctctgcctctgggccgctccggcgcaggaagctgcggggccgggacgaacgctggcgggaagccctgacctgggccctcccttaccggtgcccgccctcgggccgggcacgcggggcggcctctgggcaccgcaggtcccggcgcaaaggcgctcagagtccgcagtggcccgggctggtctccgcgacccccggccccgccccgccccgcggccccgccccccggccgctccgccctccgctcggccagaggctccgggccccagggcggcccgcgggcgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgaggtgggtgcccgggccgagtggctgcaccggggagaccaggagatcctcaggcctttccgggcctggccgcggaggctggcaggagctagaggatctgggcgggagtgggcgcgaggaccccggaacgtccgcgcctgggcgcctcagcctgtatttgttgcagggcccctggcctgggttgtcagggagtgagtgaggttgtggcactgcgctgctccggccagggagctctcgggggtccagggtgggcttaggagacctctgcagcccggagccagctccctgggctggaggaggcgcagggagcagtggcggggcagtgaccacgggacaggagggtccccaagaaggccgccccagccggactctttccacgttccagcggaacagagtcagatgcaggggccaaggtcgagctgaactccgaccgtcggtctccccgaagtcaggtttcagcgtctgcgcccacagacacccgctcggtttatccccgctcagggcccgtctgtaggaaaaagcctctcttctccaggccccccagcttcctggtggcaccactctagctcccagcactttggttcttagggaacctgggcagttctcctcgactcccgggccagctggagccgcaggatggggaaggaggccccggagccagtggggagtgagagggaccggccggcgggaagggggttacatccaggctgtgggggctcgcggttccctacttatttatttatttttcgacggttcctgggaggggttggccgcgggggctggggggcggagagagggagggaggaaggaggactgcgcgcccgcgctcgggagagctggccggagcgggcgggctggcgtccaggctccgccgaccccgccatccctgacacaggagcccccgccagggctggagtcgccatgcagcgtaaggctggggtcgcgggcgcggcgcggggtgggctggggcggcttttgcccgacgcgggcgccggcggcgagctgcggccgaggcgctgtccggtccgcggtgctgaatccgcgctgtgtcggcctgtcgggccgccccgctccgagccgggtcctcgcctgcgatcgctgcccacgatggggaccccgggcgcgcagcgggtcctcgacgctccgcacccggagctgcggttttgccggatgcggggcgcattcatcgccggtttcccgccactgcgtggggaggcgcagcccagttttttccgccggaggtcgagggagccccttcctggtgtctctcacccactgggagatgggctggagccggcggggtccacagccagggaggcgggtgcaatatgtcagtaaatcccggtcccttcagcgggcactcctctcttccagagactttttctaagtgaagagggagtcctcagcccttgacacctggaaaacccgctcacagactcgaggctcccacagggcacccttggacctccccagtgtggttcctccagggggcctgcagtaccgaagtggggtgtggggggcagaagcagcgggaagccagacgtttgagtaactctgacggtgttgggggcacccacgcctgacacaaaggcagtggatcggcttgtccagtccactcataagtaattttgcggctgcccaatgatggggaaggcattgatatttaccccggaggcctgcagacagggccaccaggcagggcagccacatttgcgaggagtccctagaaagagtggccatgacgcttaacatgaaggagacccgatggggtgccccagctccaggtgatggtgaagacccgtttccctatgtttcctgccgggcttcagagagcagatccccctggggtggggttttcatttgagctccacatgcacccttcttggcactggcaacattttgtaattgagtattcagcctcgtgaaatggcctgggctgctttcttgctcacacacatttttagaccgatgtcagtttccccttagctcctgacataggatgcggtgcctgcacactcccggaacttgcggggccacttaagctggctggggaagagggtgtgtagggaaaggaggacccctcggcagccctgagtcctgtgggccggaggggagactggctcgcgttggggtgggaaggtggcttcactgcctcctggtctacgaggtgacccagaacttcctcgtgcccacagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagtgagccccgaaacctcacctcagtgtgggagcggagggcacgcctgccccagggactcctcccctcacaatcaccaaggccaggccctcgaagcctgcgtctctcgcaatcccagcccactcctgtcacccaggcagggcaccctgtggcctggccaaattaagggtggggcctctccatgggtgctccctgggtggctgggcctggctgggacatcagcaagtattatttggaaaaaaaagcaatttattacctaaatcacagaagcagtcattagagaagatacacccctatttgtaggattctactggacttagttcctccgaaattggtgatgttttagttcctaatgctggcacccagcggctctggcccagtggccttcatggctccagctgtggggtgtgagggactggccccagatgggtcctctccctccggattcaccttcccagatccagcatgggtcctgcaggcaatggcggctgggctccccgaggtctttctgagattgaggttcccttctcagtgggagtgggcagctctgccccggcggccaggctggcgaccaccctgcagggccggacagagccttcctccggggccgccttcccaggcagccgcttgcctctctccaacccgctcggggcgaaatgagcctcgcgcttccgcgctgagcccggccctgtgcgtcccgcaggcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgaggtcagccgaggggacgacgctcccacctttcctggtctgaaaaaaatggggctgaggccacgcccaggggggcgtccggggaaattctctccccaagcgctcactaagggggcctgggctagggcggtgtaggcagcaggaagccgaggccgggaacggcggagtcacggacagacccgcgtcccgaaccgcttcgttcggtccgaagtgtgcggcttttcgcccctggtcggaattatcgccctaaattcttggccgcgaaggctgggccatacccacacccttagaataaaggggagcccgcggggaaatcagggtgcttggagaagggagccaaggctgaaggcgggggcgccgtggaggtgcgattttagggaaggcgccgcccccgcccccgcggcagaacccgccctccgccggcgccccctccaccccagcccgggtgctgcccgtttttgccaatcgctcccagcgcccgcgccttccgagaagcctgtggggcgggatgggggtgggcacctgaggccccgacgtccccgcgccggccggggtgggagggctgggggtccggccggggccggaggggctgccgcgcctcaccgctcgcccgccgcgcagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtcagcgctcgcccctgcttccctcccgcccgcggccttgggggcccccgcagagccgggcggccgctcaccccgccccgcccccaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccggtaggcggagggatcgcggagctcggggggggacgagcgcgcgtcggcggggtcgcaggggtcccagggagcccgcgg

SEQ ID NO: 5730 - DNA, 6343 bp, Homo sapiens
  source 1..6343: mol_type = unassigned DNA
cggcagggcgggacggggctgcggctcaccatggaatagccgtacacgtgaatcttcttgtcctgactctggtgggagatgcgcccgccgcccagacactcacagtcgcagccttgcttctgcatgtcgcccgacactttgtcgtagatgtccgctgggatgggagggcggcctcaggacgtgccctggccgcccttggaggccgcgggaggaactcccagccgaaggggtctgaaatcccagctctgaacagccccttccccaggagagacgaagccccttgaggctgggacagggatgaatgagcgaaggagggtggaaccggggagggcgcgggaactgggagactgctggggagggtgtcaggccgtgtcacgcccttcccgcccaggacctcagcctgggtcaaacctagcaggggcaggactcggagcagagcgcagtccgctacggcccgcagccccgcccccgccccgccagccccgcccctgcctcgtcagccccgtctccgtcccgccagccccgcccccgcctcgccaggcgtgcccctggcatgcccgcaggtcccgccctcaccatggtactcagcccacttgtagccgcgcacgatctccttgctctctgcagccggagccccggagcggggagccgagtggactcggatcagcacatacttgaagacgccgtcggagtcgatgtccacatcaggaatgagagcgaggtccgccaccgccatgttcctcctcccggagtcccctcctcccacccgacccgggggccgcttgtactgcgggaggcgggctctgcgagagcgacgaccaatcccgtcggggaatgcttcccaaggcccagcgcctcagccaattgtaccgccgaccgaggcacgtgctgaccaatcgcaatccagttccttgccgccttgcggctccgccagccccgcttaaaggaaacgtggaatcgggaatgggtggtgatgaaatccagccaacggagaagttcctctccagcggggtccggtggcacccttggaacggggcagttaggcggcccgcgaggctggggcaacgagggaggcctgagggacttgccagccctgacctcctgtcccgcacgtagtccgaagaccaccctccccgtggcccccaccgcccaaaggcctccctctctccccctcccaccgcccgaaggcctcccccctccccgctctccaccgcccgaaggcctcgctctccaccccctccaccgcccgaaggactccctctcttccccgtccaccgcccgaaggcctctccctttctcctctccaccgaccgaaggcttccgtccccaaccccgctaccggtacaaggaggcaacggcagccgctacattcaagttctattttacttggttcgaaagctcttgccccctggaaattattccggtccaggggcgttcccggccggccctcaggggtggggccgaatgcagaggccctggggtagggggcgcggggcgcggcggcgggtgggcaagcgggacgcctggccggtgcagacgcgcggggacgagatgggcgtgccgggtgcgaaagcaggagcggaggcgggggtgcccaatttctctcacttggtgccccctcccctggctccgaagtagggctggggactccaggagggcccttgcgtttggcctccacccctctcccgcataccccaccctccagagagctctgggcgcggaccagggtgcacttgggggacaggtggaggccgggccgccgggcttgcgcctccacgcccgcagtacggcgtgcggccagagcgggtgtgcggggacctctcgggacaggtcaagccccctcgggtgggcttccacgcttaccaactagctctctccctcacctgctcgcaccacgctttgccctccaggctcccacctgggaacgccccgtcccttggtccttcctctcctagccaggtgtcagctctggccaggcccaggtgctctgcttcccctgttcaggtcccctgccccttcggctgggagacttgcatatcggcctgaagacctccctgcggtttttcccagctcctgcagggcccagactgcagcggctggaggcgaagggacggcagggcgcgtggcgtggttagtgtgctggctccgaccagcgggaacgcactgcgcaccgtccgccctgcccaccgcctcggcgggacgcgctcgcgcacacggacgcacagaggtcgaccagggtgttctccagcgaggaggcaacacagccgcgggaggcggggcggggcgtgtttaaagtgacagactgggctttggttacgtcgggcttctggacgaggggaaaccggagtcggggaggctccagcgagagccccgcggaccgacggggaccggatctctacgggtggggtctgtgcagtagtgacccctccgagtgaaggcagagctcggcggtcctcaggcccaccccgcctcccagcggggagcaccgagggcgaggaccgacttcttctggggatcctcgagggcgagctgggagagggaggaggcccggaggagggagaggggttgctgggggtgggaaggcgaagggcctgtgaggaacactacggggacgaagggccggggggtgggggcctgggcggagctggaggccgaactgagcggagcttggaaggctggggaattagaggcggggcctagaagaagtcggggtggggccctggcggggctcgggggcggccctgggtgggccgggcggggcctgagtgggcagggcagggttcgggccagcgcctgggctaggcctggtgggcccggcgcctcacatgatgtcgtccagcaggttggcgctggccacccagtcgagcgcgcgcggctcggaggcggccatgatcatgcacatgaaggggcggccggtgcgccggtccgtggggtagatggtggtgggcgtgaagcgcctgttggcctcgacgaactcgcaaagctgctcgtagacgcgcgggaactcgtggcgcaggaagacgccgcgcagccgcagctcgcgctggatgtggatgaaggccacctcgcgcgcgcgccggcccgcctcgccgtcctgatccaggcccgccgtgcccggcggtggcgtcaggatcagcgtctccatgtcgggctcgcggctccgcgccgggggcggccgcgcggggctgccggccgccagcgctaccttggcgaacttgcgcactgttggcccgtggctgcgtggcgcgggcgcgggcagggccggtgtccccggtggcgcggtgccgggtcccacggccacggacacgctgagcaggaagcactctgccggttcgtagaggcgcccagcggccgccagctcgcgcgcgtagctgcccaggggcgccgcgtgtgtggccagctcacgcagcgataggtaggtgggggatagcagcagcccctccaggccaaagcgcaggaagttgtcggccgagcctggacttgggaagcccaggaagagcacgccgcggccgcgcgacaggaagccgacacgcgcgatgcgcgagaaagcgcggtgcaccgggccgctgtcgcggcaaaactgcagtacgtggcggcacacgctgcccacgcggccgtacacgcagcgcgccttgtgggcgtcccagtcctcgcggcggcacaggcgcgagcagtagtaggtgtagcagctgtggcaggacttgaagtagaggcaggcgttgaacatggtctcggtgcgccggcagcgcgcattggagcaggtcatcaggtcgtcctcgtcggcgctgggttcgggggacgcgtcggccgcctctcccggggccgcgggctcctcggcgctgccggccgaggcggggggcgagcgtggcggcgccagcgcgggggccccggagcccgcgggccgcgagtccagcagtcggcgcagttgggggcccaggcagtcggccgcgggctctgaggcctggccggcggtgggtcgcgagtcgatgaccaggtccgtgatgagctcgtccagctgctctaggctccgctggcggccagaggtggggccgtcgggggccgcgtggggaggtggccgcgtgcggcccccgggcaactcccaggccctggcgctcgggcgctcggtggcgcgcaggtcattgtcagtgatggtgatctcgggcgtcacgtaccagttgcggcccaggccctcgcccgcgcggcccttctccgtcagcgacgtctcggacagggacagtgcggcgtagcgtctgggagaggtggacaggttcacgacgacgggcgggcgccggccttcgggggacacgcctcgcggctcccgcacctcgcgccccagcaggttctcgtagctgcggccgcggcccaacgggtcttctcggcgcggccccggggccagaatgttgtcccaggagcgcgagtagtggcggctgtcggtggccagccggggcggactggtgccggtgccgccgtgccaggaggcgagcaacgggtcggggtcagagggcggcaccacttgcagggtgcggtacggtcgcgggccccagtccgcccaggccgggctgctgcgcgggtgcgggtacgtccgagccaggacgtcacgctcgcggtaccttccgaagtcctccgtgtaaaaggggcgggcggtggagtgggcccggggctcctcggggacatagcggggcccgtagggcaggccgtaggctcgtggagcctccccatagtaggagcgggagggcggttcctggattgggaaggtgcgcacctctcctgcgtagtagccgcccatgcgccttggactgggccccgagagctcctcggacggatagggcctggggtagtaggcgtcgaaggttgggccgggactggctgcaaagctgccccggaagccttggggctcctctgtatagaagaactgggtggggcccggcggggtggtgaagggcagactgcggcgctcggcgtagtcccggggcccaggcaggggcccgtcgcagtagaacgcccggggatccgcacagtatgagtcgctgggcgtcggggtgcgcgacagcgccatgtggcggggcccgggcaccgtgaggccgtggaactgcggggcggggcgggcccagtgcgcggcctcggtgggcccgcaggaccgcgagccccgggtggcgtgctggagcactgcgtcgtctggcttgatgtccaggcggcagcgcacgtggggggcgggacccgcgggtggctcgggcggtgcgcagcggcccgcggcggcgcacaggggcgcgacgcggccggggccgccccgctgcggctgcaacttgatgggatgcagctcgttggcaagggcgcggagcgccgggtacgcgggctcccggcgcggcgatgcctcggcccgcgccgcacgctgggcctcccgccctcggcggggcaacaccggcggcgaggcgggcgcgggcgtcaggcccgggggcgcgcggggcgcactcttggagcgggcgcggcggcgtggctcggcttcgcgggtccgggcgcgcggcacagcggactccggcggcggtggctccggcagggtctccatggccggcccgtccagcgcctccaggaagtcgaagctgcggcagtggcgcttgttgaaaggcgcgggctcagcaggccgggccacggatcgctcacatggcgagcacttggacgcgggtcccggggtcgccaccttgatgtcctggtacacggtcgacaccagcaggtccggagggtccgtacgggtcatcttaaaagaggtccccaggctggcggctccagctcacactgccttgcggggcttttgccctggggggagacgcgggtcagggcggccccctccgcagcccaggccccgctactcccccacgctggcccggcttacctggggcgcagcgggcggagcagccctggctgcgggcctgggccgagaacgcgggcgcttcctccatgccggggtcagaagcacctgcgggaggaacccagctgtccaggcgcccgtcctgcccgtccccccgtcctctccctgcgatggggcgggcgggccagaaaggcttagccgtggttgtggttcccgcggcgggagctcccgcgtgaagctccagggcctcccctcccccgactagtgacggcggggtcggctcgggtggacccctttccgggtggggtaggggagtgggggcgtggtcctggggctgcgccctctggtgtccgcagttggaaggacgggccgcatttgggccttatttataggtgttgccccaggagacgtcagtgactgcgcccccgtcacagcgcccactgcagagcgacccctccgatcgcgcacagtggaaggcga

SEQ ID NO: 5731 - DNA, 1089 bp, Homo sapiens
  source 1..1089: mol_type = unassigned DNA
cgctgaggggccgcactcacccgcgcaggtaccagcaggcagccctggcgtccgcgggaggcggccgggggcgggggtccctcggtgcccatcgccgcccctgcggctgggtccgcgctccgggccggccgagctcaacgccaggaccccgtccgagcctcccagggccccgccaggcgccgcgtccgcgcccgcgcccctctgccggctccggctcgggctccaccggggcgcagggctggggaaccggagctccgcccgccgacccggagcaccgcccacgcagacccgccccgggcgagggaggggccgggcgcgcacccgcggggagggcggcgagcggggatcagccgaagtcgggagaggggcgcttccacggggcgggaaactggcgcgcgactctgggggaagtgcaggatggggggacaggggcgctcccgcgggggtggatgggggaccatagcggggctggcggggcaggggccggcgcacgaggctggaggaggggagcgcgcgcttctacccgggctgggtcgccgaggtccgcggcgcatcgtggcggcggtgggcggaggggggcggggggcacctcttctcccttgtggcgcaggtgggcgcgctctggaccggcttgacgacccctccccgccgccccacctccctggccaaaggttctcagcttctaatcagggacatttctagtccacagcctcgaagccatgggttctccccggccctctgaagccgccacacctgtgccagccggccgcgtcctcagacctttccccgcggagtcttcccagcacttggagacgcagcgcagggccccgaggacggcctggcccggagaaaagataccgaagctccaactttccccaaccccgctcccctcctccttccaccctcccttcccgcccccaaagctcgggggtcctatccctcctccggtccgcggagtctcccgaaccctgcggggacccggcgctcggcggtgccctcctggggcgcacggggctggggcgggagcgaggagaccaggtggggaggggaccccagatctcagacgccaggggagacggcgtttcccgc

SEQ ID NO: 5732 - DNA, 1020 bp, Homo sapiens
  source 1..1020: mol_type = unassigned DNA
cgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggagtaagtgcccgagccccaggtggcgacgccatcctctcccagcacccccgcccccgcggagcgtctggcattttcctcctgcgcatccctcgcccctgactgccttcctagccctccctcccacctgccccctgcccttgctctgcggtttcctccgcttcacccttctcctgccaccccctgccccccaacagcaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccaggtgaggcggccaggcgggccgcgggtctgggggcgggcagagagcggcgagggcggggcctcacgcccgc

SEQ ID NO: 5733 - DNA, 6343 bp, Homo sapiens; identical to SEQ ID NO: 5730
  source 1..6343: mol_type = unassigned DNA

SEQ ID NO: 5734 - DNA, 1109 bp, Homo sapiens
  source 1..1109: mol_type = unassigned DNA
cgacatagggtggcgtgcagggagcgtgctttggcaccaggcgggcgcgagggggcagggcgcacgcccgggacacgccttagggaaaccgctcctgggcttggtagctgaacttagacgtcgagtgcagcccgcccggtgcgcgcggcgtcttactgccagatctcggaaatcagctgccagggtggggccgcgttttggcgacggccactcggccacccctgccgctcccgcctctcccaagagatttttctagcgggttaatttcctgtccgggtaaaccctttggtgagtccctcgcccctccctccccgcccctcccctctccatccctgctgtcccggctccccagtccgtccgcgccgcgctccatcgcccccgcacgcccgggcgcacgccctccccgcccgggccgccctctggctccccgcgcccggcagccagtgcctcaccgcgccgtcccgcgccagggctcgctccgagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgc

SEQ ID NO: 5735 - DNA, 1109 bp, Homo sapiens; identical to SEQ ID NO: 5734
  source 1..1109: mol_type = unassigned DNA

SEQ ID NO: 5736 - DNA, 1384 bp, Homo sapiens
  source 1..1384: mol_type = unassigned DNA
cggaagggacccgccggctgcgcctcgctcaggctggccggggccggtgtgaccgtgtgaccccgtgcacactgcgctcgggttttcgtgaatgacagcagcctgcaactcccagccggagagcagcggtggccaccgccgggcggaaagggttacaagccagaatgcaaagcgatttcgccccgggtgtgggggaccccgggtccccggccacctccgaggccgggcgtgctctgctcgccttcctccgccctgggcgccggggcgatcctaccttgcgctccaagctgggggttctccatgttcgtcgccgccgagtcccccgccgccgaggcgctggccgcggctcccgggcccgggccggggccgccgccgccgctcagttccgccagtctccggttggtggccgtgagttcggctcgcaggttggtcacctcctggctggccgactggaccgccccatcgatgcggagcgcgagctgcttattgtcttccatcatgctcaggattttggcctgggggcgagagaggtgacaaagagctgcatgatgcgcggggggcgcgcggccgggcacccccggctctacctgttgtgtcctccgcggcccggcttcgcccgcgccccgacccccaggcaccggcagcgccggttcctccggcacaggaatgacagcggcgcctccagccctagccgcggcggtggcgaggcggcggggggaggaggcggaggagaaaaaagaggaggagaaggaggaggaggagcagcgatcgccgagaccccggcgggcgggcgccgagagctgctccaagaaggacaccgcgcgccaccaggcactctttaaatggagcctaccattcgccgccggctcgggagggggtctcggtcggaggctgggggcacccttggcctcccgcgcccccgtacttcggagacacaccccccgggggggcggaggcggcggacggcagtcgggagggggccaaggtggcgcccctggcgaggggcaggggtcgcctggaccgaggccggccctctgtcccctcccttgagcggtggggcagcccccgccctggagaactggtgccccgagccgtgctaaggttggggaggtgctgggtgctcggaagagagggtgcttggaaagggggcctcagaggggagccggggtggatctccatggaagggagacgcttgcgccagctcaggagtggagttcgtgctccaccggttccttaaactgcgagtacgaaatccccagaggggagctgagctggtgccccgcgtgcctctcactctccaccccccacccgcaggccagacctgcgctgcccaccccaggagggagcgcctatcttcctcggcgtgggccgctggtgctcccgc

SEQ ID NO: 5737 - DNA, 1384 bp, Homo sapiens; identical to SEQ ID NO: 5736
  source 1..1384: mol_type = unassigned DNA

SEQ ID NO: 5738 - DNA, 835 bp, Homo sapiens
  source 1..835: mol_type = unassigned DNA
cgtgaagccggcgccactcagtccctcccgctaactgcccatcctctccggccattgcctcccgagtgcccatcgagtgcccgtgggtcagcgagcggggccgctggaggaaggggcgggtgtgcccagggctggcggcgggcccggggtccctgggaggaaagggccgctcgctcagccccctcccggagcccagagacggccccggcggcgcgggcacacaggggcacatagcgcggggcggagggagggggtggcggcaccgtccgtggagggcgcgggctcgcttagccttccgcaccggcgctccctcgcgcggtgccccttccgcacactcacacgcactcattcccacagctacacactccagcacctgcaggcacaaacgcttgcagggacacaccacgacacagacacccaagcacacacaggtatcggctcatagactcgtccctgagtcacacacaggtatcggctcaaaggcacaggcaggctcatagactggtccctgagtcacacatagcccagactcagatgcacacacacagatgggaacgctcgcctgcacgtgcacagacacacggacacacccgcacaccaccgcggggttccgagcacacacgcgccccggcagacgctcacagacacacgcagggccgggagcgcacacacacagacacaggctcatatagacagactcggtcctaaaaatacgcactcgcagaggcaaaggctagcgcacaagcacgcacagacacaccgacaggcggcccccggacaccgcgctccctgccgcactcacggcccacgcaagggctcacacacggcctcacgg

SEQ ID NO: 5739 - DNA, 2248 bp, Homo sapiens
  source 1..2248: mol_type = unassigned DNA
cggttcccgggtcagtctcccgctgccaccgccgtccagccagcgcccgccgcgtgggagccgcgaggccaggctccgcagacggcgggctcccggtctcgctgctcccggcgggcgcgtctcctccagctggtccggccgctgggctgccgccgtctcccagctcgcggtgccagctctcgcgctccacgcctggctcccgggctccgtgccctcgcagtagaagggactggggccggcggggcgggtggggacgtctgggaagcgaggagagtcctcgttctccgggcgtccccctacaatggggccagggtccccttccccgccccccgcgcaggtgtgagcgcgcgagtgtgcgcctcggcaagtgtgagtgtgaagtgtgtgtgcgcgggggagtgcgcggagggagcgcgggcggcgggcggcgcgggaggcgggaggcagggcgcaggggagggggctgggagggagagtgtgcgcgcgtgcaactccactccggggctttgtgcgagcccgggcgatagcatcggcggcggctggaggaggagcggccggagacgcgtgcagcccgcccgccagagcccggcagccggggcaggtgggagcccgcgcgggagccgagccgacgcgagtcggagccggagccgagtccgagcggagtccgggcggagcccaggagcctcgctcgcgggcagcccgtgggcggcagccaggcggggcgggcgccggcggggcggccccccagtaagatgtgcgcggcgccgcggggcgccccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgccttctggatcccggactcgcgcgggatgccccacgtcatccggatcggtaagcgctccctggagccgggggtctccgtgcgcccgggagggggcgggaatgagggggcctcccaacgcgttccggagagattttcctaacctctctccgagctgctgagccgatcggtgaccaccaggagctcctccctgtgaggacaaagttccagagtcggggtcacgggccttacttattggggaggaggccgccgggccgcagtgggcgaggggcccttggcgcgctcctgggaggtcagacctggcacagtgtggcgaaggtttccagtgcgatcccgagtcgagggcgcatttcgcggtgactgccagcatgaaccgcagccgaccgagttctgcgatcgggcttctccgcagagtggggaccctggggaaggcgccaacttctctcctctgcccacctcactccccgcgggcccttcgtccccacctctggcatagctcgagcagccgcagcgaggtcgcagggcacagattcgcatgacgagggcagccggtcttctctcctggtggtcgcccttggcctcggtggtaccggttcagccccgtgccatggggcgggggttgggggagcaggaccccgctgcccgctgcagctggtccctcggggccaaggcctctctcccgcctggggcagtgcaggtagagggaagggacgatggaggccgcccagtgcggcccgggcaggcggcccagggacgccagcggtttttaaagttagcccgaattcctccgcagctggcggcggctggcggggctgcgcgcggctttccggggctccggcttctccgcgtctcttctcgccggagactcttactccggtctttaactttgttgtggccgcccaaggcaccctgcaggcctgagcgccgcgcatgtcccgggccgacgaccggcagggctgggcctggccgggctaagacggagcctccatcaccgcaggccctgcgcccgccaccaggccggacacctgggccgcctgggttcactcggcgccagcaccagcgcctggcaccaggcgagccggactccgccgagccagggccaccttcctcctctacagctcttcttcagggcggaccttgggctgccagcggcgtgaaagaggtgccggaaccggtgtcgggcttggtttccgtacttgagattttcctaggaggcggtcagaaacccagcgggtgggtctcctcctgggcggccgcccgggagccgg

SEQ ID NO: 5740 - DNA, 3541 bp, Homo sapiens
  source 1..3541: mol_type = unassigned DNA
cgaggctggacagctcccggcctgcacgccggatttctggagagcccgagccccttccctgagcccatccttctcctctcccggggcgtgatcccaccacgaccacagccgatgagccgttcaagctgggagaaggagcgagaaggctgcagcggcgcaggtcagatacccctgggcccaacgtccacccccaactagcgcccttgccagcagcgttttccccggagccacagtctccacctcgagatcttctccttctggaaccccggagcgcggccgggtaccaggggctcgcgtaggactgtagaaccgctgccgcccgccgtcccagccccagctgcccgcgcggtactcacctgggcctcagtgcccgggagaaggtgtgcccgcgcgaggcgtgaagccagagtccgtccgactccgcccgcaccggacgcgctctcagggcagaggaggtcggcggagttgtgacgctgggactagaggaaggagaaggaaagccgagacgggccgggcagacgcgccgaggagcgcccagtgcacgctggcagccgcgggaggcgaggcgggcgcggtgagcagtcgcgccggaaccgagccgcgaatccgcgccgcctcgcgctcgcagccgccaggacccgcgggaatcctggtccgccggcagcggtactgaggagggaggggcgcggggctgagccgcttctcggagcccgagcgcctcccggagccggcaatccctgctgcccgggcgggatgcgggcgggaattcagctcgcgtggaatgtgggaccggccgggctcggagtctccagcgctgggggaaagcggggcccacacagccaggacgagagggggtgcggtcccagggccacccccgcgccactccccacgtggcggccgcgcccccggggcgtgagtgtgtacgcggacggtaggggggccgtgaatgaagccccagcggccaatcagcacggccggcgcgcgggaccccgggagcgacgcccaatggagagctctgggcggccgggcagggtggcgggcgggcgcgcggggcgggggccgggcaggggaggcgggaggcagctccgcgggcagccaatgggcggcgggcggggtggggctccggagcgccgagcgggtcggggctttaagccggcggagcgaggcggcggggcccgcagacggagcggagcggcggcggcggcgcggcgcagggcgcggggcggcatggccaccaccgcgcagtacctgccgcggggccccggtggcggagccgggggcaccgggccgcttatgcacccggacgccgcggcggcggcggcggcggcggcggccgcggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcggcccgcacctagaacacggcaaggcaggcggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaaactaacaaaaaaaattcgagtgttcatttttcgtttcgtttcatccgagccccggcttggttcccggccacgccggaggggtctgcgctcccacacacccagacgggaaggggcttctgccctgctgcagaccgaccgccgcatagcgcggcccctgctccccgcgg

SEQ ID NO: 5741 - DNA, 1513 bp, Homo sapiens
  source 1..1513: mol_type = unassigned DNA
cgcaagaacggcccagcgaaccctgtgtaggggaggcgccgaggattggagaggctctgctaagggccccgctgggcggaaggcgcgcgctccctcccatgggaaagacagatgtggggctaatgaaagggaggccgagaggcgcggggacggccggggagacgggggcgtggcggggagaggaaagctcccggagaaagccgatcggaccaccgcaagcgaggcatgcagcggagtccggaggaggaaggcgccggggactggggcagggccagggcgggacgggggtggggggtgtggggggtaccacaggcagttggacccgagggtcctgagctgaaactcaacacccgcctttggaaggatcgtccctctttctcctccgccccttcccttcccctcccctttcccctccctcctttctcttaatccccaggacggagccctgcgcgggagaggagagggcctgaggggaggagaaaggaacagcactgagaggggccaggagcccaggaaggggagggaagggcagccgcgggccaggggtgagcctgcgggccacgcgcgacccccggagccttcgcagccctctcagtgtccccactcccagcccaggcgagtccacaggacccgggcccctgctcctccctcgccttctctttgctccttcttttgctttgtggcctttctttcccttcccagagacacctgggagctgcccccaagctttggggcgccccgcggggccctgccaagggtgcgtgtgagagagggcggcggagccggcgccgggtgccaggggccgagggtgggagcgggagctcgtggccctgcgccctggagccgaggactggaagggggctgggcccctccgccgcctgggcgcaggccgcgcgtcgggaaggcagtcccgcctgttccaggggtgcctgcgtgctggttgctgctgcccggggcgaggcgccgtagcggcgacctcagacccccgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgc

SEQ ID NO: 5742 - DNA, 3541 bp, Homo sapiens; identical to SEQ ID NO: 5740
  source 1..3541: mol_type = unassigned DNA

SEQ ID NO: 5743 - DNA, 558 bp, Homo sapiens
  source 1..558: mol_type = unassigned DNA
cgtgcctggctctcggaaagtgcggacgagacggtgtgggtgggctaggagttatttgcaagggtgcttgcaaaccgtgaagcctagaggagaacgggagaaggatggaaccgagcggagaggggaggtgtatggtaagaaccccgctcgccccgggttgaaggggagctgtgggtcggcggtcaacgcttgaaggagaggggttccgggtggcgggaggcggctggggacccgcgcaggccagcgtgccggcccctcccagcccatcgctgccgccgccggggctgctccaagggagccaagcggagtgggagcgggtctgcgcgtctctgctctgcgcgcaggggcgggggggcccaggacggggcgccctttcccacccacatgctgatctaggatctccaagcggctcggcccaggacaccgcctggaaacccagccgcgtgggagagggcgaccccacctccaacccccttgctgtgcgccggcccagcccctagaagtcagcggacggcggaggaggtggcccggcctctcttggtggtcctgcgctctcgg

SEQ ID NO: 5744 - DNA, 7244 bp, Homo sapiens
  source 1..7244: mol_type = unassigned DNA
cgcatctgctgggccgcctcgggttcccgagtcctcgtggctacacccttggcttctgcgggatccccggtccggagtggggaaatctcacggtgacctggcctcaagcgagaaggatacctgggccaccgccccctcaaaagctaggcagatttgtatagtttatttcgttttcggtttaatagaatttcccgaaaactttgtccaaaggagctctgggagcaggcgcctggcggcccctgcgcggaatccggcggttgtcggcgctcttcccccgaccccatggctcacctacccaggtgcagccggggctagacatacttggcctcggaacctccaggtgttggaaggtggggtctgggtcctgcgctcctagaggacatattatccctgaagcactcccttatcctcacttcacgcgggagaccctcgcgggggctgacacccttctctctcctaaacccattcacagactccagcaagtggcattttctgggagcgagtaaccagctttttatcgctatcatagaccttgtccgtgtcggagcgccctcgcgccggggcctggtgaactttctggaagctctccgcccggtcctccagcgaatcacccccacccactcctccctccagcctcagcctcccggtgggcatcttccagggctcttccggggcgccaggttctgcggtcttcgggtgggggcccgttagtcgcaccgtccttcccccacccccattcctgggctcagaagctgatagactgacaagacgcggcccagtagtcgtgccaggcggaatgggctgcgtcctgaggccgcgacgacccgggccgagtctgcgcgcccagattcccgccggcctggaggttcgaaagagcaacgcagagacgcacggtcaagagtggagggagaacgacaggaacgctcattttcctcattatttaaacgaattttctttattctgaaggagagagagaaaagtagagaacaaaaacgagagtgacagaacattagaaattagagggaaaaacagaattagagggaaaaacagaactttagaaattagaggggaaaagacacagagataaaatcagagctacagaaaccgagggcgactcgcccgagggccgcggcattaattccagatgtttgaaaggcaacagcctttcaaaaaggaaacaaaatctgaaacctgttacctcttctgcagaacgagctgttcctcagggccgtgacatcaagacaagacgagaataaggcgaaagttaaaactgaaaactgtccgagggggcctcccagcagtgactttgtctcttgccgggaaggtcggacagaccgatgcgcgtcctgagtttaagagaatctgcggagacacagaggccactttttactttcgtttagaaaagaaaaaaaaaggggggggggctatttgttcatttgcaataacgacaaaaagaatcccaccaccacggaaaagaaatcgagatgctgaaaagtgaggaaaagagagctcaaaaggggctgagggacgcgaaaagaggggcggggagaggaaaggctcagggcgcgagggacgtggcgggcaccgacaggaagtgcaatctcatttctcttcgctgagcttctctttaaacacgaaaatcttcataaaccacacttaccctccaggatgactatcgtatcaggacttttaaaataaagtaactgagctttaaggagacaggaggaaaaaaccaaagcagcccccaactaccccaaactcgtcggatttgggagcgcgccgaaacatagcaggaagaaggcaggaaaaatcgtcctggcatttatgccttgaacaccctcccttccccacccccgcacccttgtcccgcccctaccccgaccgcagtaattgaattgtcacctgccccccatcccgcctcagggctccagagccacttgggaagctcggctttgccaagcgccccaggccagtaagagcggtgcagccgagccggcgccccagaagccgagaggttacacaagtctacgcagagaggcgcaccggacacggtaattaggagcaattcacacgctctcgggcgcacggaaactacttgtcaggaaattttcaacgctcctcctcgcccacttttttccactcctttcctggcgcgccccctcccctcccagaggcacgcagtggagcttttggagtttcgaatctttcggacactgcagaatgcggggctccccgggcgcgggcccggccaatcagagcgccgtctgcctcccctggccaatggcaggcgccacattgttgtccaattctgtctaatggagccctaaggaccaacaatagagcgggcgagcggctcattgagagtctggcagcgccgggcaactgggccccggctgcgcgcagcgtccggcgcgcaccgcgaggggacccggcacggcgagagtcaggtcgcgggttccaaccacgcggcccgcagacgagcctccgacccggatttctgaagggagggttggactgcgctgcgttctgaggggtccggaagttcggacatggtgactgaaggagggtgacgtggtcagataaggggccgggggcaaagggaagcggccaagagctccagcgtcgccagtggagccgggaggcgcgtgcagcgccagcggaggaggaggatcccggagcccaaggcaggtagttgagggccgcagggagagcagtgggtggagacctggtctgcggcccctgttgaggaggcctgggccccgtgggccttagggacgcccgaagggtctgggagaggaggcaacgctcatagagaggaggtctgggactctcggacggagacacaaggactctgtcgcgggctctggcagggacggggaacgcgggaagcagaggagaccgcggcagaagcggggagctgggcctgcttgggccttatggggctgcggcgtgggagggactctggtgtccgtttatggccagttgcgaaggcgactcccctggcttggtgcggcctgctgggccatccgtgtcctaggaccccaactctgagatcagaacgcaggagcctgcgctcgagaggggtcccctgggaccccaagacggggagggcgtgtctgacgactctgtccctaaacccggaggggaggggagggcagtgtgaggtggtcttcgagaaagatccccctcccgaaatgcctaacttttcgcaggatacgtcttccgccccgactactactccagactgcgaagctaaaaaactgcaccacaggttttacccaatcccctcccccagcatttgcctgtggggttttttcttacacattcccctctcccaggcgcggcccctggatcccggacacccagatcagctgcttttcactgttttccttgcccatgaagctcatctttgggctgggtttgcctatacagaaagtttctttggccgaatttttctctttaatacttcccagtcctaagctaaattccacatacattttgtctctcactctctggaggccctcaccgtggaacttttggcgctcacatttttacgggtcccagagccactgggcctaactttgcccaagttgtttcctcgtcctcactctgcttcctaaagctattctttctgttgttgatttttctctccaaagcttctgccccaaactgcattaaaaataaacaaacaaaaagaaacaaaactccggcccaaccggccttcacatctgcgccttcacatctctctcctcttcacccttccaccaaactgaccgttttgctccgggttttcctgttttgcccttggcatcagcctaacttctgggccaaaactgtcgctctaatcccagtcccgtcaaacgagcatttctctcacccgtctcaccccaattaggctaagctttggggtatcatcttaacttttccaaattctcattacagccatctgaatcagtgactttcacactttacatgtctctttattttttccagcggaatcactaattcagacaaaatcttacccctagcgtgtatatcaggtctaagagcagccatggccagactggggtgaaggtgctagggctcacaaggaggttccgactgcacctcctcccagcaattctggcccctctagcccagcctccgcggcccaaatttccctctccagcttgggttcctcaaggcggcgctttggcctagcgcgcggtgtgctcctcaccaggtctctcccctctcccaccttctttcccgtcaggtcctgtcatggagctgcgctcggagctgcccagcgtgcccggcgcggcgacggcggcggcggcaacagcgacggggccgcctgtggcgtcggtggcgtcggtggcggcagccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcgggggacctggagcgggagcgcccgcggggaccggaggcggagcagctggcgcagggggctcaggtgagagcgcggccaggccgcaggtaggggcagcaggatcgtagctctggggcacggggcccaggggcttgtctcggttcagaaagagtagaacccccgtgtccagtcgccgcgactgctagggttcaccgctcgcccagcctcgggtatggagcgtgggtacagaaactctcctttctcccgcttctggagcatttgcactttacccctttctcctgcatcgggccgaaatgtacacgctttaatttttttactcgcctctacccaaacgcaggcaggtccctgcttctttgcttcgtcttctccccaggtggaaacctgcgcatcttcgttcgctctgcgcttctccacaggccctttccctctgctccttcccaactcccttaaggaatccccccccctttaactgacaccctaggttttgagacgccctaggttctgagacgccctagtttcttttccccttctcgcgttcctaacgccctctggacaaccgcttgctgcgccctccctccttctagtttcttccgcaccctccctggtttctcaggtctgctttcctatgtcttttcctcttcgcttcctactgcctgcctagcaccaccctctttttctggacccccgtggctttttgtggggagggaagaaattaggccagagccgttgagggaaaggagggatccgctctaaacttgggagggaagaacttctcaggtctcaattttggaaagggtggattagaaacaggggctgtacttctgcctgtagagaagcttgggacctcctagataaccaaggcgcctttccttacaggctgcactgccagggcaggcattttctatacagtgggctcttctgtacagcgtggttaggcagaagttatgttgtctcttgtttgaaccctggacctggccacttctccacggcagggcaggactggaagggcagttaagggtggaggtgttggggcacagacgtggggaaagcagcactgaacatcgagtttacagggcacaggtagttggggttctgaggagtacagaaagagagggagccctggggtcagggctgtaggggctcagagcggaaggaatgctagagcaaaaagaaagaggggcactggagcctagtgaataagggctgtggggctgagggagaggaaactgagatccaaagggccgaggtgctgtgactgctgtcttctagctaaccgctcctcacgacacgttttctcccctcccagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgccgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgt

SEQ ID NO: 5745 - DNA, 824 bp, Homo sapiens
  source 1..824: mol_type = unassigned DNA
cggagccgctaggagtgagcatcccctctccgggatacccagctccgcggcgtctcccgcgcgccctggccccacacggacctgccagccccagggaacaaaagcggagcccgctcgccctctactgcagccggaggatgagtcgagagggctgagcggagagtgtggtcctcggcggctggaggtaggagaatatgttgcgcccgcccgccgcggcgtgagaggctcgaggtgggcgcgccggggtaggggcggccgcgggcgcctgtccgtctagtgggcgctgcccggacctggcgaggtggtggtctgcaacactgtgcccgcactgcctactgtgggtcgggcgccgagctctcgcggccgcgagggagcctcctgggtgggaactggaggcagtgggggaaaagtctggagccagaagccaggcagcggctgccgcggcggctgtggagggctgcctgcggcacttggcggcgcgcgtctcaccgcgaagagcgggaaggcggcggctgcagtgtgcgcaaagttttgggtggcgcgcaaaggcgcaggcgagggccgccgcacagagccgcccaagttgtggccggagcgccagggcgacccctgggaaccccccaagcggaatcccccgagacaagcggctcttgctccctgacaccccagtcgaggccgagttgacgcgcagccatttaacccttcctgtcccggggaaacaacttcatccgcgtcgacgactggactctggctggctgggcagcgtcgagacttccggggggttcagtcctgtggtcttgagcatttcctcgctcagtccgcgt

SEQ ID NO: 5746 - DNA, 824 bp, Homo sapiens; identical to SEQ ID NO: 5745
  source 1..824: mol_type = unassigned DNA

SEQ ID NO: 5747 - DNA, 1415 bp, Homo sapiens
  source 1..1415: mol_type = unassigned DNA
cgtccaaaatgacttcgggcgccccacttaaagagacgccttggttcaggtagcccgctggggtcgaaggccccattttcccccgatctatcgggcttcgcggcggaagtcttcgttcaggcaggggatgccctaggagggaaggaggcgacggtgcccaaggacgtcggaagccggggatctccgcttccctcgggccccggctaggttaccagtgctggcccgcggcgcgggtgcccagttgcgcctgggacactgcgggcacggctgtggcggcaacggcagcggccgccgcgtcgccgacgcccggcaggactgagcgcacggagcggcggaactcctcgttcctccacgtgtagagcagcggattgagcgcggacagggcgcagcacaggagccagctggccgcctgcactccccagggcaccggcagcgagaagccgctggccaggctcacccacaccagtggctgcgtggccagcaggaagacgcagcagagcagcagcaccgacaggccgctgagacgccgctgtgcccgccgcgggtgcagcgcgggcggcaggggctgggcctgcgccgggtgcgcggcgccaccggggcccggcgcgtgctgggcgcccgggaaggcggcggcggcggcggcgcagccgggcaactggtgcagcaggtggaagttgagcacgctgacccgcttgacgctgacacgcacgcggcgcacgatgcccaggtagcagtgcagcagcagagctgtctgcgccagcagcgccgcggcggccagcagcgccgggtagtggactcgcggtggcgcggcgccgggccgcggtgcccagggcgggagcagcagcacgaggcccagggcgagcgcccaggacagcgccagcatgcccgccgtgtggcgcctctggtacagcgcctggtaggtggcgggcgcccgggtgatgagcaggtagcggttcagggccacgaggcagtgggagaggagggacaccgtgagtccgaggcccagcagcccaccccgtagcaggcggtagctgcccccagcgccgtcccagtctgcggggggctccgcagagccggtgggcaggagcccgagcaccgcctcctgcggcatccagagggcgcagacgctgaggtcggcggcgcagccgttcacgatgaaggcgttgctggtggtctgcagctttcggaaggacgacacgagatagatgaccatgccgttggccagcgtgcccccgatggccaggcccgaatacaggagtgacaccgggatgcgccggcccgcccacgactcctcttcctcgcagagcagcagcagcgagccaccggtggtggaggaggtggatgtggaggaggagttggtcattctggccaactcttcacacctccctcgctagcgtcggcttctggcagcgcgg

SEQ ID NO: 5748 - DNA, 1415 bp, Homo sapiens; identical to SEQ ID NO: 5747
  source 1..1415: mol_type = unassigned DNA

SEQ ID NO: 5749 - DNA, 3039 bp, Homo sapiens
  source 1..3039: mol_type = unassigned DNA
cgggcgctcacaggcggcgcgggcagcgcgagccccggagccccggaggcctgtgcgccctgagccggcatggaccccgagcactgcgcgcctttccgcgtggggcctgcacccggcccctatgtggcctcgggggacgagcctccgggcccgcagggaacccccgccgctgcgcctcacctgcaccccgcgccgccccgcggcccgcggctgacccgctttccggcctgcgggcccctggagccctacctcccagagccggccaagccgcccgccaagtacctgcaggacctcgggcccggcccggccctcaacggcggccacttctacgagggccccgcggaaggtaacgcgcggcgcggggcgtagcgcgcagcccgaccctctcttcttcttccttacccgggcccacccgggccttcctgcttatctctcccgctcgcctatttctcaactttttgcccctctcgcctttcgccacggcttccacggaagccgggttggcgctggcccgggccaggcaaaggccagtgtggggcgggagggtgaaccaccgttcctcggcggcgggaatggaaggcgggaggtcgagggaaggtgcagtggcgacggcccggagtccagtcggggcccgaaagcagttggacctgggaaggagagagcatgctctgccgaagttggactggaactgccacctaccctgaagcccagacccggccgagggctgtggagccacactgagacctgacgaagaagcgcggcttttgtgtctggcgccctttgagggccctgaggctgggcctcaacctagagtggtcaaatcggggtcggctggggactgcggcctggtcttggcccgtctctcctccccgggcctagccttcacaggaagggtgctgcctgtgcggcagactggcacagtctggccgcgactggtcgtgcaatgccagggctgtcctcaagacggaataactgtattcttatttctcatactaagctggcctccctgccgttatgcactatgatagccgcccttctggcagtcttggcttccccgcgctggatcatcaccgctgggcagtcaggagcagccctgggcagcctaaccccctggcgccgcgggctcacgggccggtgccctgtgctaaggccggctggaccgcgccggcatccgagaatgcgcctgaaggcaggggcctggcaggctgatcggcagctctgcggccgtccgccgcaccctatgacctgtaaggcgtctcggcttccgcactgcacccaccttatctgcgctgccatatcccgcagcctaggcccagaactggatcctccaagatccgcctcaaccccctgccgccgcccggctggcgcctcgcgggcctccacggagtggccgggcatctccggctttcgcccagccggggcggtgggaatgtgtaggggagggcggggaggtgtgtgtgggtcaacggaggaaatgaacgagtccgcggagcttcgtgtctgtgccctttgaaagaggctttcctgataaaaaccacagttgggacttaatgagaagcagttggcctggctcctctgatcccagccagacggcagaggccgcgcagtgcggtgagcaccgccagagacaggtacccggcctggctcagcgctccgcgtcgggcaggagccacccccccaggcccgcgtccctgctaggcgcgccgcatccggcaccgacagctcgggcccccggaccacaccggtgccgcgcgaactgcagagagcgctggtgcggaacgagcggccgggagaaacccagcaccccgggatccgacggcaagggtggccttgacaacgaaataccgagaaagaaaaccaaagaaagcgagcgacaaccaagaaaaggggaagggaaattgaacaaaacaacggagagcgcggcgagaacgagagggtaaatggcagtcggcgagctgggatgaactaaaatgaataaatgaggaacgaacgaataaaaaaagcaggagcaagatcgaacgaaacggataactagagaagggggaaaggacaaagagggagggagcagactaaacaaaagaaaacggagcatgtttaaagcgtagaatatatcaaaatgagaacaagggggtaagaaaattaacgatttcagttgaacggaggacaggccaaacgaaagggaggcaggcgggtgcgagcagagcctggtagagatcctggcggccgctagcctctggcgctcttgccggtgttcaacgggctgccagcgtccctgcggcagagcggacctcggcgcagcgcggcgcgcggtggagcctggctgcttgaggacagtcagcccccagggccgcacagcctacttggtgggaagtggcgggcgaagagggaacccgccttatttcccggtttttaaaataaccggctcggagcgtttccagtccacacgagtgagcgcgcagctgcgccccatctgcggcgcgatctttcacgaggctgggcagttgcgcgccccagagcctggcgcacctcgctcttctcccgcctgcagtccgccgcccgcgcagccccaggccgccctttgctgagagcgcccagccttgctctgaacccaggctgcgtgctggcgctgccagccactctcgcgccgtccgcgcttggctagtctgtcccgagtttggctctgacgtcgaaacacgccctcggcaagagactcctactagagttttgcccgctgccgctgaggccctgagccggatgacccggccgatcgccaaagtcgaggagagtcccaagttcttagacccgggctgaggcttctgggccaacgctgagaacccccaagaagggcaccgaggcctcaccggggtcctgcccacggcgtttatgtccactctggctttgagtcttcggcgggagctgcaggagcctgggcctcagcgagttctgcaggtcgcttagtgaccccacagtggccggaggaaacagtgcggcgcgggacaaggctgcagcgaaatgtgaaagccaaggctggtcccgcgg

SEQ ID NO: 5750 - DNA, 1277 bp, Homo sapiens
  source 1..1277: mol_type = unassigned DNA
cgcgcccctggggagcggcccacccatagtactgcgagcatccagcatcgcttcagagcacggcgcacacaggcataaatgcagcagaggcctctcgacccgccaggacggcgccccctccagatgggcaccacacgcacgtcccctgtctcagccattccgttccccagatgcgcttcccacgagggaggaagggctctctgctagctccgaatccagcgaggaccagccccaggactgagaattaaatattcatctcgggcgtgacagttctgcttcgcttgccaatgttactgtcaaggtcacaggcctgaggccgagcggctggggctggggtctccagctgcgtaagaggctcccagtggaactgcgccctgggcgcgcagtttcaagccgcggatgggccggacaggccccctccggttctccgcgggcgcttgcctccgcagctaagcccaatttcctccggagttcttgggcccttctgagcaccagaagctgaagcccggtgtccaacccgtgcgtacgccgctggggaccccgatgcgcgaaggagagcgggccccggggctccgtcgccaggcaacggcggctggagcggcgagaggagcccgggacgagcgcagggtcgggcggatgcgggggcagcgccgcctcacaccttggtcctcagccctccctggctggggcggggccagaacagggaaagttgcagtggccggcccggtaaagccaggcggggcgcggccagcgactcacctgtcacgcgtgggtagtcgcgcagactcggcccgtgcactccggccgagcagctgcgatccccgacgggtcgcggacgcacagctcctcccccgggccacaggcccccggctggggctggggcgacccggagctgcgcgccggcgcacgcgactccgctcgctcctcactccctgcctcaccaccagtcccaacctggctcccgcccgccgcgcgctcggggctcaggggagcggcgcggggacccaggtcccacggcggagagagcgcgcgggattgcgaagactggggccgagtgccgccctccctgcgccctggcagcgccggctctgcggagcagaacggagctgggcggagcgctgcgcgcactgttccctcgctttccgaaaggccaccctggcggcggggcgccgtgacgcaggcttgactcacgcgcgggccggcgtcaatgcgaggctctcgggcagcgagcgaggctctgatggccgacgtaggcggagagggtgggcgtggggcgg

SEQ ID NO: 5751 - DNA, 2394 bp, Homo sapiens
  source 1..2394: mol_type = unassigned DNA
cgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttgtaagtgcgtggtggattgcggtgcggggtgggaggtaggaggcgtggggcagcagaatcaagggcccagcccacgaggggccggaaagccgaaatcccagcccagagtctagatttcctcagtcttggaaacgggagccctgtcctcgaacccctaacgcattcatcccggtcggcacatcctaagagcagatccctgcctggcactggtgctccgagatttggggtttctgtgtctgacgatttctagaggtcggaataattgaaatttaaaacgcgccgccacctgccgcccccaccccaccccccgccccctctccatgcctgaaaacacggccacgatctccaggcctccgtctgggatggccagtgttggcgagtttacccccaccccgttcccactcagggctccgcaaacctcggcacactgcagtgcagtcgacctggaggaggccggcgctggtgacccagcttgtgataaactggtcggccagcgcaactaccggtgcggacatgttaagagggccccggggtgggttttttcggggcacgatctcaggcccgctgatgaccgctgtggtatgaatgaggtcaccgcattcggagaggtggatgtccagatgtggactcaggaaatggcctcatcccgaaagtctcgggctagtgggcgtgccctctggccagtgcctccacgcccgcgccagaagggcagcaggccctcgtagggtccggcgtctcacccacccgtgtctcctttgctgtccctagcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgc

SEQ ID NO: 5752 - DNA, 1627 bp, Homo sapiens
  source 1..1627: mol_type = unassigned DNA
cgctccgggtctggagggaggggaggctctccggaaaggggtggcgagagacccccgccacgactcccaagcttcttcgcgcgcgctggaggggacacggtgggcgcctaattctcggcgtagcagtaggtcccataggctgcctgttggggcctggggaagccgaaactgcgcactccgggatccgggagccccccgcagcgcggcctcggcgtggtgattgggaagcgcacactgccgtcagccagccagccgccgtcgcactggtctagccccgaaaacttccaggcggcgtagaggtgcccaaccttggccaccacggcgccgcgtcgccggcacgccgcgtgggcttcagacagcgtcagccgcccgggcacgaagaacacttggcctggggaccacagcgggtcaccgaccgagggcagggtgggcggagaggggcggctgacacccaggaggcggagttggggtgcgggaccgcagaggtgctggatcgagcttgggtaagaggagttgggggatcgaggcaaaagtgcagggagggtttggagaggtgagctggagcctgggcgggcgggcgggctgatgggggggcggtgccttggagggacccggagaccctgccctgatctcaagctgaggtccactcctcgtcccccacatttttcagacccctccccaagaccctgccttcgtcccgcgcctcacccgccagcgcggaggtgaagcagaaggcgtcgtagcggtcgcgcatccggtcgcggggtccgtagctgcggatcccgggccggcctcggccgccgcacggggcgcgtgcggtgagcacagggtagcgcacggagccctcgagcagccagcccgcgttacaccagtccagaccctcggtccaagctggcgggagacggcggaggtcggggataagaggcgtcataggcaggagccagactgagctcgcctggcgccctctctcgggcccctgagacagctccgcggggcttgggaagtgctgggttcggccgctcaccctggtagagctgggagtaggtggccaggcgtccgtcctgctcctcgcacgcctgcttcgcctcgtagtaattgaactggtaccggccccggctgggttggtacggaaacaccacacctagggggtggcggggatcctggggagggccagcggatgggagcggagggggaggaagggcggcgcggcctgggagagggagctggggtccccaggggtgcggaggagatactgggaaggagccctgggagacccaggcgaggcggacccgctgctacacaggaatggggcgggagcggaagggcctcaccctccaagctcaaggtcagcgccacgctctcgtcctcgatgccgttgatgagctcgcagcggtaccggccctcgtcctccaggcgcacgcccgcgatgaccagggaggcgtctagtcgatgccccctccgcatcctggcgcgccctcccaggggcccatacccccgggcgtgcagtccgttggtgatgaggatcagcgtttcccggagctccccaggctccaccttgctccagcgcaccttgtagctgggaggcgtggtgcccaggacgcagggcagcgtggccgtggccccacga

SEQ ID NO: 5753 - DNA, 271 bp, Homo sapiens
  source 1..271: mol_type = unassigned DNA
cggcccgcggagtcagcgctcctcccgcgccgacctcgggctccgggcggccgccggggggcgccgggcgcatccttcgctgccaactccccgcccgtgcccccgctcgcgcctgggccccgccgcactccagcagaagccattacagagaacaaactaccttcttgtctccgagatgggtccccggggaggaaggcaaattgcctgcctcgtgcataataagccaggcgtggagagcagcgcggaggaggccgcggcagccaccgagcgg

SEQ ID NO: 5754 - DNA, 884 bp, Homo sapiens
  source 1..884: mol_type = unassigned DNA
cgtagcattttggcgaattccttcacgtccctggtgaagctgcttcgataaacccgaaatatatgctgcagcgtctcccactgctggtcgctgaacgtgccctgggaccaaggcttcagagagcggacggtgtccgagtcgttgctccagctgtgcgtctgcagctcccccagccacgccaagccgtcggtgcgcgtccagctgctattggcgaaggacgagatctggaggcagcggagggggaaaagcctttgcgggactgggagagaatgaagattggaggcgtgtagcaagtggccgggagagcagccagcataaagagaaggaagaaagaaacaagaggagatgagcttcaggaggcggctgatgccagcgaactctgtgccgcgctgcctctccccggagccagggagcagcgagttttctacctagatcgcgccagtgcgtcccgggtctcaccagtccccatcaggcgttgccctccccgtccctacccagctccctctctccgccctcccgcgagtgcactcaagcgccctcgttccacccaccttcagcgcttccccaagcctggaggagcgcccagagcagcagaaacagcaggcaccccatatcgcccggcgtggggacctcgcggagcgccgctgcgcgccgccctctgacctgcgcactcttctcccccgccgctcagctcacgtccctttccgctgggtgccagccaattcccaagcccagaccccggcagccctcctcgctgggcttgccggcggtttgctgcttctgccgaagggcgccctcgcccttagctgtgcgagctgcaaagaggtcggggtcccaggaatcctggcgccgccgctcacttcagtaggtttcacaaccggcgt

SEQ ID NO: 5755 - DNA, 1007 bp, Homo sapiens
  source 1..1007: mol_type = unassigned DNA
cgcgggcttggccctaacccagcacgcggaggcttccctctccccagccttagcgaaagggcggcgggtgggaatcacccgttaccttggcaactccctcctgccgtctgctcacaacagtttgaattacacccctgccaggcagtcaccagtccgatttctttcctttctagctctcgttttccctctcagcgctcaggctgggggcggcgtcggtgccagtctagtccagggcgaagcttccagggccggctcgggccgggctgcgggacccgccgtggagcgcaaagtgcctgaagcccccgcgcgcattcggccctgtcttcaaaggccccttagaaatgcaagaggccaggcgcagaaacacacacggacggcagttttatgagaaaatgcagataaagagcccggcggtagggccatatgttccccataatctccaaagccgtcacttcaattagagcctcccctgagttctaatgcccaatcctgagtaaacaagccgctctgaaagaagaactcggtttccaattaaaagtgtactaacatttctccttcctttaattcccgcggagcaaagccccgcgcgggcggaggcgaggccaggtcgcggcgaggtcgtcccgggtccgcgccgccccgcgccgccgcgcgttcccaggtgacgtcaggcgggcccgggattagggcccaccctgcgctccccgcgccgcgccgcagagttaattaaaagtaatgccacggtaaatccaaaggctctccgctggcggagccgcgccttcgggccagcctgcgagagagggctttccgaggcaggtgctggggatttatttgtgtgtgagtgtgagtgtgtgtgtgtgtgtccgcgcgagcgcacgtgtgagcgcttgtgctgaaagggagagtcccctggattttttggagaccgagattgccttccctctttcgctcatgcctccagccctcctcgcacatgcactagtgaagaaacgcacggacaccgtcgc

SEQ ID NO: 5756 - DNA, 2191 bp, Homo sapiens
  source 1..2191: mol_type = unassigned DNA
cgccgcgccctgctcggcctcacccacccggtggcgcttgggcccgccctagtcccccacccccaccccagggcaccacctaccagggccccgccccgcctcagccccacgtgcggggccccaccccggcgctagcggccctttaaacacccccacccttacacattaccccccccccacccggacggcagccgaatagggacaaaactcatggcgtacagccagtttcctccgcggagcacgtcctgtgctgctccagccgttggggctctccaccccgggccacagcctcctggcgccccccgggccgaggcagccgggccgaggagtgtcggtgtggtccggctacggggcggggccggcgggagctccggtcgccgccgccgccgctgctgcctccgcctgcctcttgggccgcccgctcgcccgccgctgggtgcgctgcacgcggggggcagccgtggtgcagaggttcatgcagcggcggcggcggcggcggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccctgccggagcgagggggcgggcgtgggcggacgtcggggcagcggggaccccgcgcggctgcaagaggagggggcttccccaaggatgcccggcggctccccgctcctaggtgcgagctgagtctgaccgggagcgagcggcgcgtcgccatgccggcgtgacgggcgcccccggctgcccgcgcgggcccccgcgctgccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtaagcgactcgccgcgcggcacgggagcggactctgggcccccagctctgcttgccaccttgacccccctccccagctccttcctactgctgtccccatcgtctttctaaaccttcctcccgcctcctctcccacctccctcctccctacgcttttgtttcagtgacagggcgggtgtagggaggctccttgcgaaggcattttctcgtggtttgcttctgacttcccagaaacgcgaggagaaaggtgcggggcgggaagaacgcgacaaggagggttcgagaggcggaggtggggatggctggcgagtgcctggcgagtttcagggcgccgtctgtgctttgtggggctccccgggaagagtttgggggaaaccatagaggagtggagtggagtgccgggggcgcatgggctgtgccgcgcgtcctttggagaaaccggagcgggcttggaagagcaggtcccgggcatccgagcgggagttggtagttctgtccttgccctcgcgactgttgaagtttcgaacccttgtcccccgggccagggagcccggaggcgtttccgtctggaaccacaagccggacacagttgcctctctgtttccgcgccccctggaccagttctggtggggagctggaaggcaccgagtgcgtcccggccaagaagggcggatagccttgtgcgagcagcgttcggctggcgcggcgcggggtgtttcttatgctaaaggaaaggatggatctcttgtctgtctagggtccttactttttaaaactttcctaattgcggcactggaagggattcccctggcgcccaccgccgaattctatcggcgagctgggagctctccaactttcagcagcgccggttggtgcgcgccgggcttggctgctgcggtgaagaccaaggatcgccgcggctcctcaaccgccaggggccgcaggctacgggcggtcgcgtccgg

SEQ ID NO: 5757 - DNA, 859 bp, Homo sapiens
  source 1..859: mol_type = unassigned DNA
cggcgcgctacgcagggaggctgcccggggctggcgcgcaccgagggggtgggggtcgagcccggggcggacccctcccccgactccccgactggaggacagggaggaaatggctttgtatcgcacgatgaaaggcaggcaggagggccaccaggcggggggtggcaggggacggaggatgcccagagctggaggaccccgcccgccccacggacaccgccactctgccccccattccactctgccccccattccaccgcagcgcctggtccatccaccctctggctcccgctgcccgtccacgttccaacggcccgcagcggggtcgccccactgccgcatccttactccgcgccctgcgcgcttacctgcccacgaagttctcgagcaccgagctcttgccggcgctctggccgcccaccacggcgatctgcggcagctccagcaggcagctctgtcccagcgccgaaaacgcgtcctgcagacggttcaccagcgggatcagctcctccatctcccggttccccatcttgcccgaggggccggcgaccagctggtccctgctcgcctctacgacctgacagggagtaggggccgcgctgccctggctgctgctgctgcgccgggctcagccagccaggtcctggcgcagacgtcggagcccgccgccagcccgccgcttggctctgacagctaacgacccgcagcgcgcctgcgcgggcgggcaggggcgtggcctatctccgcgacgccccgcccccgccccgcggctgccccgccccgggcttcccatcggaccaccaggccaggcgcgcacgcactgcagcccagctgcggccagatgccacggcctctgcgt

SEQ ID NO: 5758 - DNA, 791 bp, Homo sapiens
  source 1..791: mol_type = unassigned DNA
cgcgcgactgcagccctggggggcgcgcccggaaccgaaatggctcaagagacttgaggaccggcgcgtctcctttctccggccccagtccccaactcccgccacagcgcagagggggcagtgcggtgggagggggggagttgtggggctggggctccggcctggccggtgaagccccaggacccgtccgcttggggttaaggcaaggggtgcggcacgaggagcgcagggagccccgagtcccaggcgcagacccagctgcggacccgccgtacagccctggtgttgcaagcgtggaccgtgggcgtaaggccccggcgggaggcactcggcccggccgcggccgggtctgcagggtcctggcgcagcggatcccggcgcgccctggcccgcggcccgcagggttcagacggggccgagacagccaagcccggttcgctcgcgccaggcgctggagccaaggctgacgggcggttctgaatcatgtttggaggagcggcgcggcccccagggctccgctgagacgcgctgcagggctgtccgggccctccctcggcgacgcggccagcagcccgcgccgcgtcctcagcggcggcaaaaactaggagtcccggggctctgccgggcgccggcactggagggcaagagatgctggcttcccccggggctcatcaccccggggttccacagcacttacgtgggatggggaccccggagtagaccacggacggaaaggaacggtggtttcattctctgcaaaagaaatcctcgcgcgcacacgggtgccccgg

SEQ ID NO: 5759 - DNA, 586 bp, Homo sapiens
  source 1..586: mol_type = unassigned DNA
cgggctgcgcgctccgagctgcacgggcaggcattttccccggctttgttttacaaggtggggagagcggggctggacgcgggagggggcgggggggggagcgtgagaagaaacgaaatcgcgggaaggaggggacaccggcgggctgggcagagggcgaggcggaggccaagttgggcttgggcgccgccgcccccgcgcgcgcctgctgccgggcccgggtcacccggagagcgcgggcgacccgggtcccgcgcctgcccgccgccgccgccgccgccgccgccgccacgcgctcagccccgggctgctcgctggcccggccccggcacggcgcggcgcgggggcggtgggtgcagccccagctgccgtgcgccccggcgtctttgtgcgcgagcctcgttcagcccctcttcgcatgtctttgtgtgtctccccccgcaatgccctccgtgccccgcggggggtgtgtggcacggtccgggcgcccgcagctctgcagccctccgctgctctcccttcccggctcgctcctgtcgccccttgccggctcgtttccctcctttcggaactccctcctcttcgc

SEQ ID NO: 5760 - DNA, 1678 bp, Homo sapiens
  source 1..1678: mol_type = unassigned DNA
cgggaccgacggcggcgcttctccttcgcctcccgccggcaggagaggacggggcgggagaggaaggggttagttgtggttgtagccgccactccccggcgcccgggacccgggacgcccagtcgggccctgcagagggtgtcctacctgggcaccagcggcccctcgcctccagccagggcaccgaaggcgcgcccggcgggatgcagcgaactgcctcctgccccgggacagtggagcggcagaaggtccaaccttccggttcgcccacgcccgcaaggtggaaaaagtggggtgaaatcggggaaatttagcgaaattggggcgaaagaagagagaccaaagcgtgttactcacgtgccagatggcgaagaagatgagcgcagcgcacagcaccagagacagcatgtagcagaacgcagcgaaagtgaaggccatggccggcggaccccaatcccaccacacacgccaagaagcccctaggagcccgatgcctccctagaggaccgcactccctccaaggagccgcgtctgcacgctcctctccaggctagtgcccaggagggcgcacagctagcgaagcgactcgagggtcagcgaataagcgctggattcccgcaggctccggcgaccccagacccggccctccggcgaagacaggaaaacgtgtgtcgagagtcgctggagggaaccgtccgcaaatcgaagaagaaaccaaatcagcagcgaacacctgcaaattagtgccaagctgtgagcccctcgagaccaacacgacaagcgatgcgacgactccacggaggaccgagggaggaggtcccattcgccccaggaagagctctctgcttttctccactaaaccgctgaggagagacgagcgctccgctccggaccctcccgcgccaccggggcgcaaacggatagtgtccagcgaggtgcccgagcggcctccgagctcctcccaaatcccagagccgggcagcgctctttcccgagagaaggagtctttaggtagccgggaggaggtaggtcccgttggtcctgcgccccagacgcggcttccagcgcagccgtgcgctccgaggcgcgcccgtccccaaccgtgactccggccagccggcctccgcaacccaagtgtcccggaaaccgggggtcggaccggggcgagcactggctccacccaacgggccaactccagcccgggtggctgcagcagtgggtttcaggccaaacgctgtagctcgctccacctgctgctgccgctgccgccgccgccgccgccgcctttgccactgcgagaactgtagcggtgcgacccgggattccctcctctcggcgccccaccctcgactcctgttccgctgagcgcgccctccccggcgggcggagactgcagcgccgggggctgaggaaaggtgggtggcgaagcgccgccgggcgcttggtggccgctgccgccgccactgcagctgtgcacgcccgcctctcggaggaaacttgaagccagcagtacaagcagggctggaggccgagcggaggtggggcgggaccggttggagcagggactctttaaacacgtgcgtctggaggaggtgggaagctgcggaagggtatggtgtgtgcctcgcgcctaaacgccgcagccgcccctcccggttcttgcagtttcgcctatcgg

SEQ ID NO: 5761 - DNA, 1600 bp, Homo sapiens
  source 1..1600: mol_type = unassigned DNA
cgagacggagttagcatctgaccagcgaccaacagtggaccggcgaggcgggctcctaattagagcgagattcccagaagctggacagcccctgtatttatgggagcatgcggcgcagctggcagtgacccccaggaaacctcggcagcagccgccgccgcgggtgtggtgacctcgggcccgccgcctacctggagcgtttcggcggcgcctggttcagaaccaccggggcggacagctccctggagctgcacgcggactgcggaaggggacagtgagcgggatcggcccgcactccgtccgcgggcccggaccgctggaagcacccgggtccccctcccctcctgttccccggtcccgccctccccctcccgcgctgcgcgtggcggtcccgggctgcgcgtccctgtaggaggagaccggcactgccgccggcggccctccccctaaccgccagccccggccgcgcgccccgccccgccccgcggaggagggtgggggcgttccccgcgccgggcccgcccagctcccccgcggctgtccgggccgggctccccattggccggcgggcgggaggtgaggggcggcagggcccgcctctggcggctcgcgcccgggaaggtcggcagccgagcgccggaggccgtggagagggcgggcagggaggcggcgggcgccgaggagacgcagcggcggcggtggtggcggtggtggcggcggtggcggcggcggcgcctggtctcggccgcagcctctgcgtcccgcccgctctgggtcgcccctgccagccccgcgcgcggctcgcctcccgccgcggcccgcagcctgcggcgcccgagctccgagggcgcttccccgggcgctgggcccgaggcggccaagacggcgggccggccgggcacggggcggcgggcgctgtgctgcgggctgcgctggtggggggcggcgggccgcggcgcgggcccagggcccggcgtgtgcggctgggaggcactgtgggggcgggcgcgcgggcggcggccggggccatggccgagggcggcgggggcgcgcggaggagggcgccggcgctgctcgaggctgcccgcgcgcgctacgagagcctgcacatctcggacgacgtgttcggcgagtccggcccggacagcggcgggaaccccttctacagcacctcggccgcctcgcgctcctcctcggccgcctcctcggacgacgagcgcgagcccccgggacccccaggggccgccccgccaccgccccgcgccccggacgcacaggagccggaggaggacgaggccggcgcgggctggagcgcagcgctgcgggaccgcccgcccccgcgcttcgaggataccggcggtaaggggctgcccgcgggtggatgtcgggggcggcgctggaaccgggcgcgggggaggcgtgggtgctggggcgggcgagtccagactctccgtgggctggcttgtgggtgtctctccggaaacaaatgaggctgcaggagcggtgatcggtctgactgctcctgggggctccgaacccgtgggtggagagggtaaggcggaggccgtggccagcacttttccagtgacaatgtcgtcgg

SEQ ID NO: 5762 - DNA, 2394 bp, Homo sapiens; identical to SEQ ID NO: 5751
  source 1..2394: mol_type = unassigned DNA

SEQ ID NO: 5763 - DNA, 1160 bp, Homo sapiens
  source 1..1160: mol_type = unassigned DNA
cgcaggatccgctcctcgatggacgtgagccccaccggcccgctggtgagatcctccacggagcgcgaccatttcagatcctccttaatcgcctcgtccaccaccaagtacttgagctgccggagctgggggctgatgtcggacagtctccgggggctgacgtccggtgacctcctcatgccactgcggtcgcaggcgccacgggcaggtgggtgggcagggggagcatggacagagaggaggggattcgtgaggagcagatcccagggcgagagcaagagcgcggccggggccctccgggggcgagcgccgcggcagagcccgcgctcctcccttcccgccgccactcacccacttccccgggcagctgtccccagtgccctatcctgggcgtctcggggcagtgcgggttggggcgagtggcgagggaaagaatgactgaaacttcccgagcagctccaccgcgcgcgccgcccttccccgagcctcagactgcccagtgtcccagctgcaaagggctaccccggcgctccggcctcccgcccgccggctcgctcacccacgcccggggcgctactcacacggcaatgctcttgcccctgggtgcgccgctgggaaactctcgaatccccataggcaaagacagagtgggaccggcagctcccagacttgaggcggaggggccgcgggccggagctccctgcagccgctagcctgggaagactggagtgcgctgcccaccgagggtctgcgccgcgccggccgccccgggccgctttgtgcgcgcccgcgcggtctgtacccgagcgcctccgcggcgtgcggcacgatgcaggcgcggcggttcagcccggtgactccaggccggcccgcgcgctcgccgcaacgacccggcagccgaggcagcgccgcgccccacgcccgtcaccgtcgccgccgccctagcacaccgcaggcgtgagtctcgccgcgaccgggagagccctcccagctgtgcgctctcgaggcacctggtcgggcggggaggcgtcgggtcggggcgcacaggggccaggcgggggcgctgctgcccacttcccgcctcccgggcgtgcgctccgccccggagcccgcacctcgcgcccgcgctccgcctggaagccttggggcaccggacgcgc

SEQ ID NO: 5764 - DNA, 588 bp, Homo sapiens
  source 1..588: mol_type = unassigned DNA
cgcaggcggcggcgctctgcactgcggagccgcgtcctgggggagcagtacccccagccccggcgccccgcagccagacagcccccctcagggtggcagcattccccggctagggtgcagggacccccggggcgaggcggccgcgcattaccttccactttggtaagggtcaggaccggactgttgcaggcgctgagcggggccacccgggccgagtgcttcttcatgatgagccggccgcctgcaggagcgctgccgccgatcgcctacatcctggggccggctggagcgcgtctctcccgggcccgtggccgacgcggccctctgccgccggggagcaccagcggctcgcccctctcagtcccggcctccccggctgcccgccgggctccggttgccgcgttgctcactgcggcggccgccctgcagcgcacatcctccccggccgcgcagccactccacacacacgcgcgcacagcctcctacttggaggttgctgcaaactccaacgtcacgtacaagtgcactccctgctcccaccccgcagctcacctgctccgccctcctccccgggacgcccagccccgc

SEQ ID NO: 5765 - DNA, 878 bp, Homo sapiens
  source 1..878: mol_type = unassigned DNA
cgggaggcgaaaacgaaatccacccccttgcgcccatttctgccagaggtttgcaggacgtgtctcaacctggcatcccgagtccagaacaaaagccacgggggctgcggcatgggcagggggaaggcgcgcggtggctgacgcggggcaggggccctggcgagcgcgggaggggcggtcagcagccgctcgcggggctggactgggagccccgtgcgactccgggtctggcgcctgggtcgggggtggttcccgggcctccctcgggggtcgccgaggcccggcctcgatagccctgcggctgctgcgagcgcctcccgagctcccgccccgcggtgctcgctccaggagcgggcgcggcgctgtgtccctttacctgcgcgcagagggtcgtccggtgaagccatggcggcgggttaggggcaaacgagcgtccgagcggggctggcaggcctccggggcgcgggaggaccgtgggaccacggggatgaaaagtcctgcggttccgacgcgcctggagcaaaccgtggctctgcgcgcccctgccctcctccgccttcccctcccttcttcttctcctccttcgcttcttccacgagctcacttcctgctttggcaattagcaaagccccttcgctgcgcgtccctcggtacctccctccagaggcgcggggcgggagccggggtgccgcgacccggggctgggacgcaaggcggggccccgagtgtcccgggcgtccccagcgcccagagcgcgcgtcctgcccggtacccacgtccccctgggcgggtcctagcggggggctgacacgactgccgcccgggacagactgcgagcgaaggactggccttaagaaacggctgcagtcgcgggtcgc

SEQ ID NO: 5766 - DNA, 561 bp, Homo sapiens
  source 1..561: mol_type = unassigned DNA
cgagtgggcgcgaacttctacagcagcgtcaagcagcaggactacagcgccagcgtctggcttcggaggaaagacaagctggagcacgtaagggcgactcgctcccgggggcctcggccaggcacctgccgcatgcaccctccccgtggtggtggcatgagcgcgcgcggggcgcggggggcaggcgaggggatcctggcaggcgccgacgtcctaggtcggattcgggggcttctctgcctgcagtttcttgccttaatgaccgggctgcggggaggggagggcaggttccctttcaggctcttggtccctgccgacccgacctgcccacctgcgtctcccggtagggttcatttgcacggggttctggaggtgcctgtgcagagtgagcacgaaggggaagtgccaccagcgtggctccgagcaacctggcgttgcatggtagtgggctttagagcggcgtttgcccgcgtctttgggggctgttttactcagtccaaaaactagcaaattaacgaatgagtaaagttggcgccgctagcgaccagcgtggacccgcgc

SEQ ID NO: 5767 - DNA, 1235 bp, Homo sapiens
  source 1..1235: mol_type = unassigned DNA
cgagctgagctgtccgcgaggctgcggcaggaggcctcgtcctcccgggcagggtccctcctggaggctcccccggtctctcccagacgcacccgcgccgcgtccttgttccccgggagcagcctccctccagccgccggtcctgggagcttcaccgtccaaacgggagctgagtttgcaagcggccaggcggcggtgcggctggtgctgctgctgatgtcagagccagaaagcagttgtgattggatctaattagacgctgctgcagcaaatagacaagctccctgcgtgattggcttcaaagtggctggtgccaaacaactagcagaggcgcaaaagtagcctccctgcgctgggagcccagagcaggaggcagagcccgcgggaagctcggagcactcaggacgccgcgcgcccttccccgccctccctgaccagggagcagctcgctccaggcgcccagccgaggcccccagcccagtgggagcaagtcatagagaacaattcgagagacagagagacggagcgcgctttcctgctcagtcctgaaaagtgagccgctcccgggtttgcaacctcaagcttcgcagcagcggcggcggcggctgccgggaaggaggcaggtgcaggtgcaggagggaggcggctctgggctccgcgcctgggtctcggccatggcctcggtcctggggagcggcagagggtctggagggctgagcagtcaactcaaatgcaagtccaagaggaggaggaggcggaggtccaagcggaaaggtaaggaccgcgtggcgcgccggcccctgccccccttcacccccggcttctccaccccggcctctcatggggtctccgggcttgtccgttgtgagcagcttcactttggggtgctggcgggatggctgctccgtgcagggcgctcgggagttcagatcccgtggaaatgtctggggcctcctcttgcccagaggggacagtgagcagccacgctgcgacatgtttgagggacccggacgaagtggggcgagggcggcgaggagctccccggggaccccgcgcgtctccgggccccgcagtccccagtggccggccgggctggcactgccttccaccctccggaggccatctcgtctcccagtgccaaaggaattacccaaaaacgggggaacgagccctcgcgccagctactcccatccaaactgtcccggaggaagggataggcgaagccctgcgatcgc

SEQ ID NO: 5768 - DNA, 5964 bp, Homo sapiens
  source 1..5964: mol_type = unassigned DNA
cgcggtggctggttgcagctcacgtctccacgactcctgcagaaggaaattacgttctccccttcccccccgcacccctacccctaccccaagcccccgggaagccctgcgctggcaccagggcaagcgcctgtcggctcccgggagctaagcgaggccgcgcggtctgggacgcaaatgggagggagcagccgctgtcgccctgcggggccagggccactgggtaggcgcagcgcgggccaagagtgggaggctcagggcaggggatccgcactcggggccattcctgccgcggcgcgccctgcgcttcagcagtgcacagggtggggacccctcgaggacagtggtgcgccgacgggtctctcggcccctccctttccacaggccccgctgtgtggtgaaggagccagaagaggcgacttgggtgttgagacccggggccaaaccgtggagagtgtctggagcccacactccagatttctggacgccgcagtcagtccagcaggttctacctggagccgcctcggggctcaaccgggaggcagcggggtgcaggcgagagggttaatgcgcccggttcggttggtttgaggagtctctgctttcagcgacccacagggcagagagcccagggctccggcttgatgtccccaacagctggggactggagagctggaggggtcgcagactcaggctagagtttaaagtgcgccgcgcggcgagtcgctggactcttctgggtctcacgtggctcctgtgtcacatggagtgacaggccggcggaaggcgctttagtcgtcgcccagcgttctccaaggtgtaaggaggcaggatcttcccatactggcggcgcagggggcctcacggctgcggacgcccgccctggatctctcagctcggcagatcctttgggtggagaggcgctctccagggtcgcggcgaaggagagcggcttctcggcacgtccctccgtatttcttctagatcagctccggccccaccgtccaggagagggcccgcctgaggacctctgtctgtgccgcgcgtggtcagccccggtcccctcactccatggctggcccctagcccttcagagcggacacctctccttagggatgcagggcgaggaagggcgggtggagctgcgaacccacggggacctggaggacctcttggccccctggagaggggtactatgagagggattcatgggacacagatttgggggactgggtaattttaccccctttggcaaccataaaaaccctgagcaaacgtgtccattcgctatttcgcagaaatatacaatgcaggcccacacaggcatctctgcgaggccccctagttaagggcgcagcgttcttcggaagctcttggtcttgctaccagggcgtcaccggcttttccgcactggggacatttcgtttgggctctgcgcagccgttgcacctaaggccctgggagctccgcgttcctccccaggcgcccgggacaaagtgcccgagggctccgcagacgtccagccctgcccggggctcacggccgccggggctctccaacggaccgtcgagggccacgttttgctggggtgtgagcgacgattcttttcccgccctatgaggcccgccactagctaggtgccccatgagacgccgtggcgagcacggctacctggcagctcgcccgggcagccccaacttaatttcctgcccctcggggcacctttccctcgaatagctctcctcggcccctccagccctgcccaaggggcctggaaatgttcgcagcttcaagaaaggctctatttaagcacaggatggggtggggcgggcggggccaagattgccctggggattgaatttatctccgctcccagcgatccccggcggataaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtatggagggagctcacaaaaaggaggaaggggagcgcggtggggaggaggccgcgtgggcgtggaaggtcccagggtcctgggggtgcccgcctgcttaggcgcagggaatggcgcggagctggctggggaaggagccgatcacgtcccgcaggctaattggcttaagaaattttgcaagcgctggaaaaggtcgttgaaggagttcgctgcacgcgcacgcacacacatacacacacacacaaaatcttaaaaaaaaaaaaaaaaaaaaaaaaaaaagagcgccgagcatgcgcacagagaggatgccatattggaatgagctgtagtgggagccggaggaccggagcgggcgcgcgagggaggcggcgggcggggagcgagcgggcaagggcgggcgagcgagcaagcgagcgaggccggtgccctcccgggcggcgaccggggcctgggtccacgccgagggcaggacgaacttcaccaggtaggacgccgcgccggctgctgtccccggcgcccaggctggccggagagcagcccttcggcccgcaggttgagtgcgctggtcaggggctttttccagcctaggaaaaaaaaggaaaaaaaaaaaaaggaaggaagcctgagggagctggggttggaggtggcgggtgggggaaggctggggagggtgcaggggagcgaaagagaagggcaggagaagaaagcgactgcacttgagcgaagcttcaaactcctctgtgcgctccaggttgtcatttttgcttcccgggtccccttcgcctgcgtctccgggctcggaaaagccgagccgtgcgggagtccgtccggagttgcaaagtgtcctccttccccgggcgcagcctgtcccctcccgccgcccaccttcctcgtttctgcactcattttagcgacgcagccgccgctgctacctaccccgcgctcccgcgtctcctccgcgctggggtctcccctttcttttggtttgggtgggagaaaaagatggtgaggacggggaatcggagaccggcatgggggtaaaaatcgtgcagacattcggaatcgctcccttggaaacatttgcctgagcaactgaaataaaattggcagtagtagttttggagcgtgctccagcgaggatggtctttttgttcattattttctctttaaagtaatatcctgtcacttaggggctttccggttgtctcctcttattcgaccccctttcaaaattgctgacttgagctggttctggagtttattttttaatatgcgtgcgtgggtatgtgtatgtgtgtgtatgttttgcagaaatccgccaaaatgcaactgtaggaactgcgagatgtatttattgattttgaccaggggcggtgggaaggggctggagggagctgggggatcctggagggtgggaagtggctgattctcggtggccggacactcatccagagcctgatccgtactcgtgttttcttggaagcgccacaactgcggggaaggagtctttagaaaccgtgccagtttcaatatggcgggctaaggtggcttttaaaaactgaaaataaaggttttgaggtgggaaaaaacccagctgaagtttccaccccttagtttcgactctctttggctaccccaggaagcgctttagcgaattaagtggggaaaaaaagaaggaatgggctgtccggttttttttttccgtggttagagtctgtgtgtcaagtccattgctaggggggaaagggatggagaagtgcccctggcccggaccagggcaccgaaacgcaactgtcgtgtgtgcctgtggattagtgtgcaggcctgcgtgtgcgcagtttttttgggtgtgtgtgtcaaagagaaccaccccgaatgtgtgtgtgcgtcttggaaccagaccctgccatgatttgacgtgacaaactgcggacacgtggtgtaaagtacatgagggcagagggagtgatttattttgtctttctaggagacgagctagctctcgccttgtgtgtgctggatcctgcgcgggtagatccccgagtaggtggggcgaggaggtgcttattaaaaggactaactgtcccgggtattgggtgcaatcgggctgcagacgccagccggatttcgtgtgtgcagggggcgcgctgcacttaatagtgggctcctgctttcctccacgccgctctggggtgggaggtgggggaccgggaccgaagcttggagaagaccaaagtggtggtggtggtggtggggtggggcagaagggcgggagcgcgcggctctgggagacaagcacgtagggtcgaggcgaggggttgccttccttacttttgggtttcgcgctctagggaaggtgggggatggggacagcgtttggggaagaaattgtcccttgctcggcttaggaaccctctcggcgcatcggagaggggcatcttcttgtcttggcgggcatggaggccgggcagtcgccgggggatgtgagtgggcggcgaagtgcgggggaaaggtcggcgttccagggcggggaggatctgggagtggagttcggagacaaaatcggggtcaggcagaggagccagagggaaagccagcaaacgcgagctcgggtgagagccaccggaatgcgggaacgcagcttagccgggaacagggttcccgacaggggtcgcccgtggccaggacgcggccgctgaacagaggtcgcgcggcggttcctgcccgagggacctcgtgggcgggggccacacggaggccgcgcacggtccccggggctggcgggggcaggtgggaggacctcctccgggcccgcgaacctgatctggcagcggccaggtgcctggaagcgtttttaaatgatagggttacaaagacatgttggccaggtttgtagttagcgcagcaacgtggtttgcaggagcgcagaacgaggctagacagggtcactcggacgccgtgctgtcagtgggtgggggccgggagcaagcggcactggcttggagaccccgcggcaggtgacccctcccacctgggcagcgaggctgaacgatggcgacacgccggccaggacgcgtccgtggctcctccagcctgcgtttgggcgcgccctcccggggccggctttcccatgggccccgcgaggtggggagcagcctaaaatggctctgtgctgcgaagctgcagtttcagccgcgaacccctccccttgtcctcctgacgtcgccgctgacaagcgcaatttgctccaaggccccgaaacccgcgattttgcacgaggccgtgccgtggaagcggatgtacagttgattacaaagaacattccacagggttctcgaagggcccaagtttttccttctggtggggaggagggaggagccgagactgggcaggagcccggccgaccaccgctctggcacctaggggctcggggcgcaccagtagctggggctggggacctggatgcgcgaaaagccgagggagttcccggggacgcggatggggaccattcggggcaatagccacggacaccggtgctcgtggttgatggcgtttgtggtgtccgagaatcccgggacgacgctggaaagcctgggagaccgttctcaaacttctggagaccagctcgcagtttcgctttcggaattttcaggatctttgggcctttaaagttgggtgggattccaagaaggcaaggcgaggctcgtggccctgacgatcggccgcccgacttctcgctcaccccagccttctctaccttgtctccctgaaccttgccgaaccgagccgggtttggggttccggggccccgcgcaccaaccccagccgcgtcctgagggctcccgcagcacagccgcggctgatccgaggccattggtgggaaaccaatttagacgaggccgacccctcttggatctggctcggttgccgc

SEQ ID NO: 5769 - DNA, 5964 bp, Homo sapiens; identical to SEQ ID NO: 5768
  source 1..5964: mol_type = unassigned DNA

SEQ ID NO: 5770 - DNA, 5964 bp, Homo sapiens; identical to SEQ ID NO: 5768
  source 1..5964: mol_type = unassigned DNA

SEQ ID NO: 5771 - DNA, 703 bp, Homo sapiens
  source 1..703: mol_type = unassigned DNA
cgcttggggacctccgtgctgggcatcccgcacgctttggacgcgcgcagcctcaccgggagcgaactttgtctcgcctgcgggtgccacggagaggggctgggaagccgagccagctctggcggcgactgggggcgtccctggctttctgggggggcgggggcgcgcattgttgtccaggatcgggcggcgggcggtggcggcggcggtggcgcgcggtggccgcctagcacccgacctagcagcgcgccggggactggctcggggcgcgctgggcgcaccatgcggcgggccgggcgcgggcgaggggcgggccggcggcggggctcactggcgccgggccaggctcggcgcgagaggcgcgagcgggctatgggctgacgccgagggcccgcggcgggggcggcggcggggacggggcgggggctcgccagctgcgggcgccaaggccgcctagtaggccaagggccttcgcccgggcgaatgggacgcccgttccggggtaccagccgcttgcagccagaagttcctcggatcccttggaagcgcaaaaaataaaaggtaatgtgtctttgtttcccggtcgcggtggcagggaggcgactgacggcagcccttcgccttccgtgttttcacgctgggccggggaaaagggacgcgccgctgcttctttactgggggcctggagtcgtttatttcgcgt

SEQ ID NO: 5772 - DNA, 1315 bp, Homo sapiens
  source 1..1315: mol_type = unassigned DNA
cgtgggcgtccgggggattcgcgggcactcgggacgaggcgagggcgcagaaaacttggagcccaatcagcacggagttgagcttccgcgccccaaccttcaggtgaccccgcgcggcggcggcggcagcagcagtggcagcggcgaccggagcccgcagcagctccgagcgcctccgggaggacaggcggcgagctcggcgaatcgtcatctgccagccgatcgcggcgctccgcgggccggggccgggagcccggggcgagcccgaacgcggcttcttctccgcccgccgcggagactctgccgggtgggctgcgggcgcccctcgctgccgcctgtgaacgctgtgggtgcgcggggctgcggccacggcggcggtggcggcggcggcgggagccgcgagtcggggccgcccgggctgtgcttcgccccggcagcagcggtggcggcggcgcctgtggctcaggatgcggccggggggcgcactgctcgccctgctcgccagcctgctgctgctgctgctgctgcgcctgctctggtgcccggcagacgcgcccggccgcgccaggtaacccacccacccgccggccgcgccccgcgccgcgcgccccgcctggcgcccccggacccccaagccgcccatcgcttcccctcgggcgcggagacttttggccgcggcggggagcagcccacgggcggcgacggcctgagagtggagtgggggagggggtcgcagggaggcgaccctccgaccggtggacggcggctggggagcagagggaccggtcagggctgcgggggctctagcgcgcatcgctgtgggcgaggcagctgtggagcgggacctgccgtcgggttccgcatcaggatctcatgctccccattctggtccttgctgtctcttccttcccgccctaaggctcttccaactctggggctggggacctggcctgggagccggggagtgcgagatctccctgccaggcaaggagcgcgactcccagcctttcagccaacagctcccggcggggtgtagcaacttaagttttctccccggctgtgcaggattctggtggaggaaagcagggaggccacccacggcacccccgcagcgctgaggacgctccggagcccggcgaccgcggtaccgcgcgccactaacaggtacagcggcgcccagcgcgggcggactggggctcgggagctgcgagccgggcatggggcgcggctgcaccggcttggactcgttgggagtaggcaggctgggacggcgcgagtgagtgtaagagtgtgcgtgtgtttgaagagggcgcgg

SEQ ID NO: 5773 - DNA, 1316 bp, Homo sapiens
  source 1..1316: mol_type = unassigned DNA
cggggtctcccgaggtcgtttcgccgtccaggatggagcaggtctggcccctggaagggcgcgcgggctgcttggggacgggggcgccttttctcgcgcttcgcggtttcctctctcctactgcaggcagcgcgcgtttgcagcgttttgggaccgaactgatgcttctgggaaacgaaactaaacctctctgaagtttccagctcgggctttttttgtttcccgctatccggcgtggcccagtccgggcgcggaacgagggcggggccgtggccaccgcggcggaaacgacccgggccgggggcgggcggcgaggacaagggggctctgtgcggcacccgcccagcttgcgccctggggactgcggccgggcggcggggctggacgggagtggacggggctgggcgcgggctgggcgcgctgggccggccaggcggcgcgctgaccgcggtctccgtgcgtcccgcaggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcaggtgagttgggcgggcgggcgagcgagcgcgcggtggcgcagggcagggcgccccgggaacttggtgttgggcacagtgattggcaggggctgggtgcttagaaggcagctccactcagggtggagggcccggctgcgcgggacccggtgccgaccgaagccacagcgccgccaaggcctctctgtgcctccgccgcagctaaaggggcgccctggatgcggggacgcgtggggatcccctgtcactccgtgtcggggccagaatgatcccaaggctagaaaccgacggccgc

SEQ ID NO: 5774 - DNA, 1110 bp, Homo sapiens
  source 1..1110: mol_type = unassigned DNA
cgcccaccccggctcggagcgtggccaggagagtcggcatcgtagaaagcgctgcgggaagcgggccccctcccgcccacccggactcacgatcttcagcaggtccagtccactcccctgattcatgtctctccatgtgcctctcccgggaaggggcgaggagggccagctggagcaacccgggagaagtctgggaggactggcaggtctcccccgcccttccccactggcttttcggaagcagagaaaaatggaagccgaggcagagccaggaaaaggcgcaaaggggcagggtccccggcgccaggagaggagcagagggtgggcaggcgacgaggggaggaggtgcgaggctagagatccctgcagtggaggcgccgggagaacccgaggtcggtgccctgcccggcggctcacaaaggaaggagaaggcgccgcgctctcgctacctgtgcggcggctccgagcgcccccgcgggagccacgttctctagcagttccatctggatctcctgcgccaccgccgccgccgctgtgggaggcgacttggacatgtccctttggaccattggcgaaaagtcggctcggagcgaagcagccagcccccggcggcgggtcccctcctcctcgcccccgcctccccgcgctctgatcggctctgggggccgcccagggctcaggcccggccgttctcggcgcagcgccccgcagcgccccgggactcggcgccctgctgccaggcgctcagtgcgcgggacggggccggggcatcgggcgaagcgagccgctcgggaggcgggacgcgggggcgcggctgcggtgcctgggagaggggagccctcagcggggcagccggggccgggagagcgggcgcagcgcggcggggatcggagccgcgggcgccgggaaaggtcctcgccaggaggggagggaactccgggagcgcgagccagggggaggcgcgtcggaaagcgagagtgacaagcagcctacaagccgaaaagttcctcgcgggaggcgcgcgccgcgtgggctccgactcagccgctgcgcgtcgccgtggcacacaggctgaaaagtttgcgaagccacagaagccaggcccggcgc

SEQ ID NO: 5775 - DNA, 1655 bp, Homo sapiens
  source 1..1655: mol_type = unassigned DNA
cgggtttcccatcggcgaactgaaactggtccgtgaagaagtggcaaagtaacataactcctgcagcggccaggtcggccttcgggaacctcgccatgccgccgccgccacctccctaccccacccgccagtccttcgccggtgctcgggggctcccgatgcaataggcacgaccgggccaaacgctgcggatcggtctcggtaggacccggaggcctttgtaaatgtcgctgcgatttcacagtagggaaccgagaagaggaagaagcgaacgcgagtaggagcgcagcgctcttcggacctctgaggctctctttgcaacttgccacactcgcagccctcacccgacactgaacaacaaccgcggggaggagaggccacttgcagccgaggctcgcaaactgtcggttccactcgggcagcgccaacccggtgcccgcggacggtgacttccgagccccagcgatgcgctccactgggttcaaaacagatctaattccacagccagcgccgctgcctgccccagatccactagggctggtcggctctgcaggaactttcctctgtctagggatggccccggcaggaggtttaggtttgcgggaaggaggttgatgacgaaaccctcccgacaagttttgcttcttttcttcgcccgacgcagggcgcgcgtcctttctcgcagccggaggaatgggcagctccaaagagctgagccctgggaaggttagggctgcagcagtctgaggtccgaagccaggaaaaaaatgtgtttaaaaaaaaaaaaaaaaaagaggaagaagaaaggaaaagggtggagtgggagggagtcacgctggaacctatcgggagagggttcctccgggctcaggaggaggtggccccaagcccccgcggagccccaggagtttggtggcggaggaggcgctgccgtcgccacgctcccccgcgctccttctccacactttgaggagggaaggcagctcgcaatttgccagatctgccgccgcaccctcctccctcctccctccgccctccccttcgctcctccaggcttctcccaccttcctccctgaaaccggcagcccgcacagacctgtccaatggctgcactttcctcggggctggctgaggagtcgcggccaacagattaagccgggggagcctagcgaaggggagggagagggccactccagccccgtgcgccccaggcagccggctgccccagagcgcggggagaggggacaggccggggagctatcgggggagcgcggggcggtacctccgcgccgccggggcgccatcctcgcagcctgctcgcacgccctgggcagctccgccaactgcgccccacacccacctggctcccgggccgccttcgcgcccgactgcggggggcgatcgcgccccgccccgaccctggcggggtctccctgggcacgaaagggttaaccacagctcgccccttcgcggaggctggttctggtagtggctagggagtggagaaagcaaaccagagccggttcggttaccgactctgcgaagccccctcgaccccagcccagcgcgggagggtggcggaaggtggtgcaccgcagcgtggtccccgccgctgccgccgcggctttgcaaagtgtcagcgggggcgaaagcga

SEQ ID NO: 5776 - DNA, 1655 bp, Homo sapiens; identical to SEQ ID NO: 5775
  source 1..1655: mol_type = unassigned DNA

SEQ ID NO: 5777 - DNA, 304 bp, Homo sapiens
  source 1..304: mol_type = unassigned DNA
cgcggtgggcagggttccaggaggcagctcccgctcggcgatagcccccggggcgcaactccccgcaggacgcgcacctgccaggacagccactaagaggatgcggaggttgggggccctctcggggacaaaatcagggcactccaaggaactctctgcgcgttcaggcctgtctgtgaagctggcaggcggaggacaatgggagcaggggtaggtctccagaggcgagcccgcctccacctttcccacctgctccccacctctgcgccggccgcatttaccccgccccccttccagcgcccgc

SEQ ID NO: 5778 - DNA, 1666 bp, Homo sapiens
  source 1..1666: mol_type = unassigned DNA
cgaaaccgcgcgagtggcaggagcaggccaggccggaggcccctccccggcccccaatccggcggcctgccctccccctcccggggcgtttgtatagcagacacctgcagcacgggcggccgcccgggttcccgacacaaggcgctggtacctgagcccttgactggtaatgcaccataaaccgctcctttcaggccctttcagagcaggagcacggaggtcaccgtgcctacaaacccctctgtgtccgccacgtctcctgggccctgggcgctcgggcctccagccgcagagcacgcctgcccgtgggaatcccaacacttgtgctccgcgaggccggcggggcgggggcgggggattgggaccaccctgccctcccccagcccggcctcccccgccctgcccgccgctggttcacagagcgcagcgagtggaacgaattgggtgcgccgtcctcagacgctggcggaaatcaaatgatgaggcgaggtgggacacccgctctccgccccgcggccgacgcccagcccacggcaaaggtatcacacggtgtcccgcctcgcggcgacgcgagcggcgggatgactcggcctgggccctggcgcagccaaaggcccggctcgctggggcgcgatcccagctcggcgcgcacagccctccgagttccaggttggattgggtgcggttgtacctgtggagtgggtggcccggtgactgccacccgggccagtgctgccagcagatgtgcacatcctgggcgggggctggcggccgagtgtcactagtaggggcggcggctaggcagccattcgccgccttccaagcccggcgctgcgcgcagggcttggagcactcggtgctgagacgcgaatgcgcataaagagaaaagtgtttccagtgtttccccaaaatggggaacagggaagaaggacaagtatcatgcaagactgccactgccacctgtcttttgcggaccatgctgccttctttcccgctggcctggctctgagcactgaaagccggggagagggcgccggccttagagccagccgcactcggggaccgcaggcggcgctggcccgggccacccaagcccggcagatgagcctttggcctgcgggggaccgggccggaggccagggggacggcagtgtcgccggagggagcgcgcagcccaaggccggtgctccggccccgcgcgccccctcccgggtccgcagggaacccgggttacctggggagccgggctttgtcggccacgctggctctccgcggccccagaactaattaaacgcctcttttggccaagggaagtcttgcgccggacgggggtgggggcgtgtgggggcggcatgtgggcaccggaataatcagccccattcttgcgcttctacagaacccgcggcgcagcgagaagtgaacagcggccgcctgaatggcggtttcaaaaggcgacacctgcaagcgcggccggttgtgaattgaattgagtcaaatgcggcgcccgctcgtacctgagccgcgagctattagtgtcaggcgcgcccggtcgtccgggcggggaagcgcgcggccaggccgtccgcgctgaatgcggcaagctgcggcgcggccgctccatgggaatgtcgccacttgtgctgctagcggtcgggagggggtgcgc

SEQ ID NO: 5779 - DNA, 5030 bp, Homo sapiens
  source 1..5030: mol_type = unassigned DNA
cgcgtcacagtggcctctcccgcctagccacgcgcagtgaaatttccggcaatcgggccagctaagacacgggatttgcaccgcagcctctcagcttctggagccggagccgagcgctcccggcagcttctccaatttctctcctaaagtgcgaagggaaaagccccgtctgctccacgactgcaaggccggcggatctgggagccgcgcccggctccggaggactcggcgggcccggggctccccggcagcggctcctctgctaggggttaacagcagcccccgcggccgggcgggcgcggacgcttcctctccacccgcccgggaacgtggataccgcgcccgcaggatgttcgccggctgggaccggcagtcaggaaacatgagaaggcctcgctattcctgttcccgggcggcgcgcgccgggctgggtaaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacaggtacagcccccgcgtcgccgagtctcagccggctgcggcggaacgccaggctcgctctggcccctgcgccctgggcgccggtgctctcccgcccttcccccaacttccctccaaggtctggtggagaggcgctcgggtagcggccaaggctggcccaagggtctgcgcggagcttgggagcccacctggccgcgcctcctttgctttaaaattattcgccggcgttgggggagggggacacttctgcagggagtgacctccccggccacagtctggagtgaatcggggtaagtgatttgagaagaggcgcgggtggccgcgcgcgggagtcctgggagggtcagcaagtgtggttcacacgcccccggaccccttgcgacaggacagcgctcggacctttgccatcgcttgcctctgagcctgctgcctgcagacctacagcgcgccgggtgtctgtgtctgcgatctctgcgtgggcttggggctgccggggaagtgtccgaggtggctaacctcgtgatgacttcgctaggaaaaacacgtcgtcgcatctaggaggacgcgctggggtggctcggagaaggccgggccggggaagggtgtcttgtacaaataaagcagcatgaacacacatccctaagggcatgattttaaaagaaaacaccaacgcgagtcttgactgtagaacaggggctgcaagcacgaaaattctctttgacacttatcaccgaggctatgtgcacaccccaggcacgtacctgtctgcgcgggaggacgcagtcctaggggacacacgacatccagcagaggtctgacttcacttccctacgaacacagaccgtagccgtcgtttgatcgcggtggtcacgcgtggtcctaaatgtcacgcgtggcctctgctgcggtggccgaagggcggggcgggggcgttggcgagtgtgggcgcttggcgaggcaaagggtgtgtgtgtgtgtgtgtgtgtgtgtgtgtgtgtatgcgcgcgcgcgtgtgttagtggagtagcagcccatgccgcggctggacgggcaaagggggcgctggcagcgaagctgaggccgctcggaggaaacgggagctgtcccgaggcgcgaggcgaggagatggggcgggcgaagtccgccgcgcgccttggggctgtaactctgcggctccgcggccgcgcggacttgctcctgacgccggtgcgcggcaggcagaggctcagggcctccgcgaccccagaggtgagctgctggctctccccgacagtggcagcagtggcccgggaggtgcgccgaccaagctgcctcctgccttgggcttctgacacctttacagcctctgaaagggtccccggagaccccagagagaggcgggtgtcgaggggctacgagctcgcggctgacacccgcgctgcggaagagaatggcactgattgagggctctggggacctgggtcctggcgccttggaccttaggaccatgcacttcccggggcgcgttgggggatgataggaagattctgggagagaagggggagaagtggtgctttcgtcctgacgccacttaactttttcctgtccttgaacccaacctcaccccgggggaccttggcggacagaagatgcgggggtttcaaccaaaccatccacgatctagaaaacacgaaaatcccccaaatcccggtatggcctgggactcatgagctggggggtcttgtggatacggttggcacattaccccaaatcttcccttccatccaacccctcctgacgccccgagttggggttcctagaggctttagtcttctgctgtgattgaagaaccacgcgcggcctcacgccggtcgcgctccgcagtccggagtatgcctctcccagattcaaactgaaacccagaggctcgtttgggaattcgtttcctttgcctctgcgggtgaatgattcccggttgtagttctggggagtgaagggattggggggatcgatcgcccaggcaaggaagagggcaggtacctgtccggggaacctgcaggggcgggggcgtgtagccaactggggagagccgcagggtccctgccagttgcggcggcgccgctcctcccctcggctccgcagcccggcgacccggccaagttcaaggccctgaacctgcaggggtctgagcactctcagccagtaagtaacgagatgcaccttcctctcctagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccgggtatgcgcactcccctgggggccctgcccgcctgcggcccggaggggtgggggtggtgagctgtgacggggtcccgtggcaacgcgggcgggtggacgggaaagggcccggagttccctgggagtgcaggtctgcccctccagggctcgcgcattctcatgttaaggggctcctatcttaaaacatgagggatcaattcgtcggggcagctccaaagagcttggtggagactaagggcgccaggagctgcccctcggccctccgctgcctggacctcggagttgggggttatttgcccctctccggactgtgggtgccggtgcgcggctgagggcgaggaaaaaggactgagctcggtgcagagaaacaggcgaagccgagcagtcggggagtccaggctcaggctccgcggacttctcttcggtcactcgagcccctcgccagagccccgcggctcgcctggcccaaggagtcgggaaggtcgcctcccgccagggagtcccgggcgtgagcgcggctcggctgggcccgcggcgaacccggagggggaggccccgggcctgcggggccgggtttgagtttagcggggtgaggggtatgctggggggggcggtagcttgcgggtgggccagctgctcagactgccggtgagtggagggcaggctctgcctggcccgatccggcggctccccgggcgccccgccggggaggggcggccgtcctagccgcctccacctgaacgattgcatcagctgcttgttctgcggcgtcgctgcttagtaaaacagagattcggtttcgtcaaaatgttactaccagtcgtttcgggtggaattgcatttcaaagtgtttaaagaggcagaaacccaggaggctccggcgcaggcgcgcaagcctcggggagcggctgggctcgctggcggccgcgcgcgacacctcccggacccgtgagggagcgcagcgccccaggccacgctccaggctcctggctgcctctgcctcctccccctttgaatgtgcttttcctgaggtctttttaccttacatgatgggacagagcttgccgtacttttaaccctcccttagtcgggaaacggcccgacggtgtttttgggttctgcagctttcctccacaaaccaccaactcctttagaaagtttcccccttttcctaaaagatcaaaggaaatagcttaaagagagccggggcggcaatgctcctttgctttattccctatgtccagtcggcgacctttcccctgaccacaagcgacggaaagcctctgggagcagacaagagatccccgagggaagtttcgagagccagccgcataccctgccaggcctgccaggccagggccactcgagggtgcggcgccagcgggtgagggaagggtagcagttagccccgctgcccagatacgcgactggaatagcagtattcttcaaatcacttgaccttcgtcttctaaacctctaaccttggggtattgggttcaaggtatccccctattcaagataaacctatcgaaatgatctccccatccagaaactgtgtggctcccacttcctgcctctcccaaacactctgggcgcgcgcaaagcaggggcgcaaggcaggaatgcgcagtttggatgcggggcccgggcttggccggggcgtggagcgtccgggcgggcaaacgcgtcgctcaccagggccgcctcctctccccatgtcccagcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtaatcaggacccattaacaccctgatccgttttcccgcgaggggctgaagagcgggaacgcttagagttcgtgtggctctccacgtggcgc

SEQ ID NO: 5780 - DNA, 2868 bp, Homo sapiens
  source 1..2868: mol_type = unassigned DNA
cgcgtttcgcatcccagaggggagggagaaagggagcccaggcgcggggggtggggctgggggagcacgagagagttttctcctaaacacgtatttcctcgttttctcgacgctgcagcggtcccattatagacgcatttattgcccctctcttaaaagtcgttttaaaaataacgcaggaaccaaagcgagcccctcggtccgaaatgtacgtgtaattccttatatagcctgggctgcggccggcggcagggccgttgccgcccattattatacaaacaggtaccggggcggcgcaggcgggggctgctctccctgcgctcccgccgcccccgggcggacaagtctcgcccctctcgccacaggaactgtccagacaataacaatcagcagacatttcgctgctgcacgagagggagagaaagcatagcatcgccccgagataaccagaaatacaatcaacttacaacgtctctccaaactggaaaaggcgactgtgcaaccaccaccacatgttcaggtctcgatccctcgggctgtctctctttttttttaactctcacgccaggcagaggggtgtgtgtttcccttggcacagcagcacaaatcaataaacactgcagctgcggtgcaagtagcagccccgcgcgtccgtcggtccgtccgccccctcccccaccctccttccacccgagacccagagcgccatccaagccccattatccggcttcagcgctccgtgcgtccggcccaggtaacaacttccccaaaaaccgaaagagaaaagcgcgaggcgcacgcacaccggcccatcccggcgcagagacctcgtctgccccgggagggggatctgtctgtggtgcttcccggtctctaagcccaggtaacaactccgcaaacacacccgccgcccagctcgcccccatccgcgcggctcccggcggcgttaagtgggtacctttcctgccttgttccccgcgccgccccgccgcgccccgccaaacgtggaccccactcgcggggctcgccgcggagtccccaggccggggctctgggccgggcagcgggaggcgccagggaggaggggcgcttagggacccgcgcccccgcgcctctaatccccgttacgcgagcgcgcccggcccgcgggtcccaactttaccgccgccggccgaaccctgtccgcccgcggcgcgcacagccggcgcccgcgcacacgcgcgcacaaaccccacgcaacccgcggccgccccgtcccgccgccgccgcagcccgcctgccgcgcgcccacagcccggcccgagtcgcggggcccgagcgacagcgacggcgccggccggggccgcggcgcgcggaagccactttgcacggtcagcgccgggcacaagtttgttccgcggctcccgggggcctgggcgctgagggagaatcgcgctgagggggccaggaggagggggagagggaggcgccgaagggcacaagagtggggaaaagtgcggaaagaagcaacagccgctccacccgggaccagaaaagtggccagtgcgtcccggccgcccgccctgcgccggggatgcggcggcgtcggcgccggctaacggtccagggaggcggcaggggcggcgggagccgctaggcggagagagaccaggtaagagacataacggttcagggagagcgagcggccgcggcgcggctccggcagcggcggcagcggaggggggcagagagcactactttctactttcccactccactttgccgtccctgccccggctgcccccagcccggctcgcccccctcacccccgggggcgccccggctgcccagctccccctgactccgccgctccccggtcccctccgccactcaccgttattgcgccgcgggttcgcctgctttctgcgcttacacctggggccatccgccatgatcctctcgcttgtgtctaaatgctcgagtcacctcctccccctccctcccccttcccccccacccctccgcctccacccctcccccctccccaccgcacctggtttacgacactcccggctttacgacatcaccttccttacacctagaggctctcgctctacggccggaaccttgttgctagggaccgggcggtttgcggcaaccgtgggcactgctgaatttgaattgaggggcgagggaaaagttttcctcaggtgtggtggggagagggaggcggatgccgggaaaccgtagggacgcggtcagaaaggcgacgggctgtcggagttggaaaggtaaagttggaggctcggcggcgtcctgcctccgcgctggccacacccgccgcggctgcccggggcagggagggatctggctgattctccctgtaccctgtgccctcggagctgcccctccgagcgcccagaggtccccgcctgcctgcttcctggaggcagggctaccatcagtcccacgcctcgcgtgtccgccccccgcaccccggggccaaggaaagggatcgcggtctggactccccggggagttcccttgatgaggggaagggcaggtttggggacggcgaggacacgcggcgaccggagagaggctacctgacccgcgcagcccggactcccttcccttcccttccagggacgcctggtttccccccaagcgaaccgggatgggaagtgacttcaatgagattgaacttcagctggattgaaagagaggctagaagttccgcttgccagcagcctccttagtagagcggaatgagtaatacccacacggtgcttgtctcacttccccatccgcacccggccctcacctgctgtcacctcggcctcccacacccggtccgcgctccccgccctcttcctcgcgtagaaccgt

SEQ ID NO: 5781 - DNA, 2678 bp, Homo sapiens
  source 1..2678: mol_type = unassigned DNA
cgagaggcgatggcgtttgctttggccagatttaagggcaagcgaggctgcgcgcggctcccgcagggtcggatctccgagctccagggcgcccctccacccgggtgtagatttcccgcggaccccttcgccctcccgggtttcatcagctgcgcaggaatggagctggccagagctctgggagcggggagggaggcgccgccaccagagggcgccggagccccagcgctgcggccggtgagcggccaggctccccggcccagcccagcaaaggcctggggacgcccgacggctgccttcttcactggacctcactgccttcagttctttaagagcagggccaagtcagtggggttcccggctccaagcccagtgcccagggtgggtgggtgggtgggtgggtgggtggatggatggatggatggatggatggagtgccggcccacagccatctaacggccaaagtggttttggaaaaaaaatgcacagaagacacctactcccaccagcggagttccggagccctcgcagcctcctgttgaccgctcccgcctaatgcagccgctgaccgcccactccccgacggccaggactccccagggacagggacgtgtccccagggcaggcccctggatggacgcggcgactgaccccacttcgctggacgctgtgctgggaaggacacagagaggtggctggggcagcctgcggtcacaaagcgaggcccaaaggggcgctctcctcacccccacgtctcctgggtgccgacctgcaccctcccttcgccaccggactggggccatctgggatgtctcgggggtatccggagggctaagcaccgccgagggacggctccgtgggaagagttttctggacccagaaggcagacgccagtagtactgtcctaggagtcggaggtcggggtgggggagttctcagctctttgggtcgcacggagcttttcttgggtaaggcagtaagtacttaggtttaaaggacttacttacagctaccatttattgagtactgtctgcttgtcagacacgatgcagagaatttcgcggcgtggggcgggtctcattgaatctcccgtcccactccgcggggtgggcctgtgattagctcatttcaccattgagaggtcggaagtacaaaggctacattcgcttttactgagagccgccggcgccttctgctttgtttgtacaggcgaggaaactgaggctcggctggtggcgccgtgggcttggagtccgagccacgctgactgcaaagacgggtctcattcccgcagatcgagctctgccggcggctgcgccgcaagccgggcaggtggcgagcttgagcccccacgcacagaaagcaggaccccctcggctgccttgggccgccaccgccagcaggccctccgcccgggactaacttgtttgcttttcattggttctcattcagttcccgccatcgaaaggccccgtcccgcagctttccacgcgcgccccactttacgcctaaggtcctcagtctctccagtggggccctgtcacagggacaataagcggccctccagccggcgtcgctcaggctgcggacctcactgcagaccgggccagcggtgcggggcccagcggagcctgagaaggtcaaaggccggagcgcactgcgcctcgggagcacagagggagcggaggaggggcgaaggggatgggtggggggtgccgccgagggagtcgcgcgtcagagaccccggccacggccagcactcggctccgggcccgcccctcaccgcgcgccccgccccgccccgcctggctctcccctctaaagcgcccggcgcgcgcctcccaccgccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacggtaagtgcgctcggcggggaggccctggcgaggctctgggcttcggctcccgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggacaactgggcaggaacgccccaagagagcgttcgggactggcgcgggaaggcgcgagggtggggagccgcggaccccagacccctgcctgcccaccctccacccactgccttcccgctgcgggctcggtttccacaggcgaatgggctccgaggtcctgctgcgcacagtgctggaggtcgggcggtgcatggcgagagcgcgctttgcaaagttcgcctcatgccgcgacttgaggctgtgaggtccgatgcagccgcgcagcctccgctccctgcgaagccgatcctctccccacaccctcgcggggctcttggccaggcgcgggcgggctgcgcggcgcagctgtcgggcttgtgccacccgccaggccgcgcttctgcacagctccgcggtccgcagcgacgcggacctgggcgcgcgtccagccgc

SEQ ID NO: 5782 - DNA, 2756 bp, Homo sapiens
  source 1..2756: mol_type = unassigned DNA
cgtcctcgcacgcatcaaaagggccaggcgggctgcgaggctcgccgtcctggccagacacaggacgctcacgcaggcgcaccgcatcgtacagaccttgcggtggctcatcaagcagcacatcgcgctcggaacgggagcgcgtcaggaggcccacgttgcggagcagcagcaagacgggagcatagagcaggttggccagtcccatgccaaggctgagctgctcaaagcccagcgagtgcacaatgtggcctgccactatgggcccgagcgcgtaggccaccgaataggagatgtcggcgatggcgtagacgctgccatagactgagacatggcgcacgtccaccaggaaggcgagcgtgggcagcagtgctgtgtcgactagggctatgccaaaacagaggccgcatagtgagaccactagcggcgcgaaggagcggcaggcgggcacgatgcacgagctggcgccgatcacagccagcccaagcgcgccgtacagccactgcaggtgtgggtagcgcgccgccaggcgcacggtgaggtagacgcccagcacatgaggcacgaaggccggcagccaggccatgcccatctcccactcggaagccgccatcgtatgcttcatccacgtggcaatggtgggttcgaggaaggcgaggggaatgttacaggtggtgagcgcgccggccaccacggcaatgtaggggtctagcatgaggcggtggatgggagtgcccactggcaggttggcccgagcccgtgcagccgccgagaagggtttggccactgccagcagcaacagcgcgtcaaagagcgacacggcagctagcaccaagaagggcacgcgcttgccggcgaactcatagaggatgcccccgaagggcggggccactaggcttccgaagctaatgaaggccagcgccacgcccagtgcacgactgcgctccggctcctccgggtacttatcggcgatcatggctatgccagacgtgtcggcgaaggctgagcccaggccctgcaggctgcgcgccgcgaacagcgtggcgtagtcctcggcgaaggcgaacaggactgtagaggcgaacatgacgcccaggccgatcagcagcggcacgtcgtagctcatgcggtcgatgaagggcccgctcaaggggttcactagcagctgcaggatagccttggaagcaaacagcaccccgatcttcacgtcttcgctctccgtagggtagcggggccgaagggctgagcccgctggccacgcagctgtcggggacgccgaggtgttggccgtgtaggcgctggcattggccggagtgggcagcggcagggtgggctcccacacctcgggagtccgggtggggccctcgccgcccccgcgcatgtgggcgatgtagtcgggcactatgggcacgatgaccatgtacagcatgttgtccagtaacagcgccacgcacacgataacaagcaccaggcgcctctgccgccggggctcctgcagcgccgcgcccacagcctccgacagcttggtggccgccgcccgggcctggcccgcaggttccgcggattccatgcccccaccccgatgctcttccgaggacgcctccgccagggccgagcgctggcgtcccgcagtgcagaggcgagggcacgggacttcggggaggctgtcctggccgagcagactcccctgtgcctcaggtggccgcggagctcatggcccagcgtcccgggaaaggaaaggactccgtccggcgaggcgttgcagctactcttagccgatcccgggacccgcggctgctgggctcaggggcggccgggaagtcgggcgcgccgaggggccggggccggagactgggcgcacttcgcccggggcgcgcccagagcagcccccgccgcgctaagaggccgcccgcgctggccgagggacatgctgttgccgcccgcccgcttgcccgcccgttagccccgccgctgcgctcccctcccctcgcgtcggctcttgcctcctccgccgcctcctctttttttttcccttccactcggggctgtgacgcggcgagtcccagcccccgagtggtgcccgggccacttacgtcgctcatgctaatgcgacgtcggcggggcgggggccgggggcggggcgtggccgggcaggggtccgctctccagatgctccagggctggaggcccaggaagggctctcggtgtggaagtcttgaaccagcccctgggatgggcgttccgcgccggtagctggccctctgccccccgccccctgcctgccccccgcccgcggttctaggactcgcggggtcagcgcccgctcttctcctcttggggaagggggcgcggcagccggttcctcgaggccccttgggagaggcgggagccagaggcttgcgatctccgcttcagcctggacctcggcgcacagcgagcaggaagcccccgaggtgagccgccgctgcgtccatctgttctcgcagctggattgtggagccgcgtccggaggagcgctggacacggacacccccaaccctttctccgactccgccccctggccccttgcacacacactcccgccaggaggggaggggaaggctcagcaactgcctggcctggctctgacccaccggcccctccgcagaatttctcggccgcgaatcgcggccgggagcttgtggggactgagggcagaagttgccgcgccccagtcggggtcgcgaatattagcctggccgctgccgccctcccgc

SEQ ID NO: 5783 - DNA, 990 bp, Homo sapiens; identical to SEQ ID NO: 5553
  source 1..990: mol_type = unassigned DNA

SEQ ID NO: 5784 - DNA, 829 bp, Homo sapiens
  source 1..829: mol_type = unassigned DNA
cgcagcgatcccgcgcaggtgagggtactggggagcccgtggccttctccgcccgccggctcctccccatcagccgtcagccagggctctcggcgccggggaagcctcccacagggtcccaggccacccaagcgcggtcaaacgccggcggcccggcctcgcttacctgacgcagccgcgcgtccgcctcgacccatcaggcgcgcagggcccgctcccgaaactcgcgcgggctctcgcagtcggccgcgcggcccttagccgcgaagagagcgtcgcgcacggtggcgccgccacagccgtgggccgccgcgcccaggtagcgctccagctgcccgcaaagctcctgcagcgccgcctcgccggggcccacgcgcgccggccagagcagcgcccaccgcccgagccccagacctcaggccccgccgccgcccacgtccagctccggcggcagccgtgggaagcagtgttccagaggcggccacagcgccgctggctgccggcgcgcgccgcggaaccccgcggccgagagccggccggcccagctgggcggggacacggcggcctcgggcttgtgctccagccccagccgggccccctcgcgccgctgcggctgctgcgcggtgcggtcgtgacaagtcacagcaaacttgccctccgcgccgttccaagccaccaggaagcgcaaccggtgcctctggggatcggcgaagaggccctcccggagcggcgcccagccctccaggctgtcgggctgctcgtcctccatggccgtcggcggcagcggccctagggcttggcgggcgcgggcctgacctcgtcgcaccgc

SEQ ID NO: 5785 - DNA, 4119 bp, Homo sapiens
  source 1..4119: mol_type = unassigned DNA
cgggaaaggtggcagccgaagacctcgcggttttccctcgctcaggcaccccgccccgcccccagccccggtcctgccctccgcgccctgctggccgggcactcgggcgtccaggagctccccctcggggtggcgcgcggcgaccgccggcgggtttggcagcagcgccagtcgcggggcggcccgggcaactcgcccgcctgccggtccgcccacgtgcgcagagaggagcgaagcgcgagcagtcgcctcgcccgcgcttgctgccggtgggtgcctcacctaaggggccggcgggggccgtaacccgagccccatcgcagggatccgcatttgcataattcggctttcccccgttctttcggactcagggcccgagatgcgagtcggactcccttccgaggcgtcgtcttgcccatggtcagcgcgggggccgcgggacccgccagagcgcaggcggagtgggctggcgcacgtggtaagaacgcagctatcttttcttgcttttcttttctttctttctttcttgagaaataggactttgcacatttttgctggggtggggtatctactagggtgctaaccttgctgcgatttctttccatgtccttttcatccccaattggaaaaaagcgcacagcgcgagcgagaaactttcccaaatgtgctctgggtgacttaagtcagagagatggccggccgctggataccggctgttttggagggagggggagaagcagcgcttcagtggaagagcagagggagagaccgctcccggcagcctcagggccctgaccgcggtgcgctgggcccggcgagagctggcgcacggctgcagcggtcgaggcaggtgagcggctgaagacccgcctgcagcgccgcgcttcctccacggcgtggcgccgtggctcccgcccgccccggcccacactaagctagggccgctccgggcccggggtgaaaaagggacaggacaggcctgcgaggctgaccctgcgcgttatccctggcctccgcggctttggagcgggaaagggctctggggcagttcgcaacctgcacaaacgaccatgaatgagtcatgcaggcggcggtgcgctggacttgggcacccgggaccagcctcctgtggggccccggacaggcccggctatccattgcgggctggggcgcactgggaggtagaagctttgcgcccagcaagccagaacctgctgctatttggactttggaaaagtttttaaaaattgctttgggaacgaaacagaagggtttctaccggggtctcgcaaagtaaaacgagtgggttgggggatggggatggcgtcttgaaagtgattagagatgctttcggccgtcactgaggaccgcgctgggctcaccgaggtgttttttggggagggagagaaaatatttattctagtacgtgtattctggctcgggtgcgggcagggcgcggtcctggatcctgggctatgggggtcagggggattctgtggctgcagggaccggtagtgaaggttaggccagtgtcttcatagaacctcctgtccagcgagcccggagcccgctctgccgccgggacactgctggcaacgacggcgcgcggacgcagtcaacagggaggtgtgtagtgtaaggtgtgtgagcgggtgtgtgaagagggcagcgggggcgggagtgtgtagcggaagtggagcgagtgtgagtgtgtgtgtatgtgtgtctggaggggcagggtgagtgtccaagcttccatctggacgcccccacgcagccgaccgcccagacgcgccgggaagggcgcccgctccgcgcagcagctgaaggggggcggggagcgcgcgggcagaggaaggagggtgtctccggctgaggatttctctcgaagctccccacagtaattctgctcctcctagggtttaccctcccagtcccaaggtgcccaaaatacttaaacaaacaaacaacccaaacctgttccgttttcgctcctgtataaatagaacagactttccaaaaaagcaatacgcattcactcttatcaccagccacttctttccaccaagtaattcagaaaaaagcagtcagcttccgtgaatgcatgtagctttttttttcttcgctgcctccttttgcttgcggttttgagctgccaagaaagtgagtaggggtttgactgtagtgtctcggctccgctcggtttctttccgaagtttaattttccggaatggctcccaaacaagggctagggaggcggagccgccggcaccggatcttcgccttttttggaaagtcccagagaaccggaattcctccccgccccgggaggctgagccgcagcctggagcagctcgctctcctgctgtggctgtgactgggtccatggcgcgccctctcccccgcgatccctgcgccccggacccaggctgcagctagggccgcgcgcccgggaccccagcgatccccgccgcctgcgagctggaagtcgcgagcccggcggagtccgcgcggccgagcccgtgtatgcaaatcagccatgtgacggcaaaagccgcctggcccagccctgttcctcagtccatatatgggcagcgacgtcacgggtattgaagacctgcccataaatacttagagcaacactttccgtctaactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggaggtaagccgcgtgtcttcgcaggcccggacctgcgcggcccggaggtggtggatggggtgcagtgggtgtgcgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaaccggcgtgcgtgcgccccggcgcgcccagccccgggcgagcgcagggatgggggtggaagaggcgtccccccgggtttcgaggcttgcgtaggccctctggccggcagcacttcgacctcccctctcccggggcaggggcaaagtgacggtaaagttcggggctctcggggagagctgcgcgcctggagagccgagcggcggagaagcgccaggggaaagcgtcggtagctccctcctgggcagagccgaccccgggaaaatctcggagcgctcccttcttgcggcctggaggcgcgcccccacctgcccgccgcccgcgaagttgagggggttagtaaggcgggggctccggccggcggaggcagcgagtgggtggtggaggagggcgcgcaacggcgggaagcagcccccggactgccgagggaggcccgcgggggcaccggcgacgccggtttccttggcgatgctgtggaaagtcgtctctcgcggcccccgcgccttcctcgaggccgggccactggccttgggctgaggcggggacgcgcggctgtcgggaaaggcggagaagattgggagggcacggaaacctacggactccttcctctacatcccccattcgctccagcagccctcggctgaagcgcagcgggagagggagggagaaaaaggcacaaggcgccggggatggggagcagccgggaaatcacccacccccttctcgggctctcctctcggtttggcaccatcacgg

SEQ ID NO: 5786 - DNA, 1575 bp, Homo sapiens
  source 1..1575: mol_type = unassigned DNA
cggcctgggcctctgggcgcgcttgccgctgcgcgggcgcggggcggctgtcacaccaccctggccgggtcccgaaagggaggagtggagcttgcccgcctccgcgagcctccgcgcgcccagccttcctccacctgcccggcgtgcccagggcgctcccagcgctggaagccgggggcgcttgcccgaggcgggagtcgctgggtcatgctcttgcccaccaggtcctccgaatccctggtagggcagcgtctgtccgtgtccccgacccctcccgcaggcaactcgcgcgaacctggggctcgcagagagcgagcgcccgcggacaccggctgaacagtctggaggctgcgcgagggggcgccgcggggagggataaaagccagcaacaaagagcacagacctcgtccagcagttgattgactcgtcccaaaatagccgtctccatttgctgctccccgcgctccgcttccaggcgcagcacccgggcctgcagctcggccgtccgaaagtgggcgagcaggctgagtgccagcgagcagagggccagcgtcagcagcccgcacgaccctggactcggcagccgtgcgccgcgctccgcccgcgccgccaccagagccaccgtcccgggcgcgcccaactccccagggccgcgggcaccggtggctgccgctttgtgggtgcgctccgctaccatcctctcgcgtcttgagaaccaataaataaataaatagaataaataaaggcgacagccgctgccaaaaggctctatccaaactgcggggcagggggaaagggcttgtatcgctggaaaacgtccctttccgctgctcccggcaaagaggacggaaaaattagcagtaggagaggaagtgccgaaaaagcacaaccagcggtaattggggtacacctaggtgagaaaaaagttatttcgaagaacgttccaagtccaggaaagttaggggaatctgaccggctctccttctctccgcccagtctttcccttcaagtgtctgcagagcagttggtgccgcgctgtcagtccttctgggcgcctcgtgtctcccgggccagtcagtttcagtccccgggcgaaggggcgcacacggagggccccatgggcagaggtgggtcgtggcggctggcgaggagcgcaggggccgattccggcgcctctgtaacttgacacactccctgcggcggcacggatcggatgagcaatccgtgctacttcccaaactaatctctccctcccccctccctcctcctcctcctcctcgtcactcctcctccacctcccgcggggccgacggcttggatttgtttatttatgcaaactcgcccagggtggggggcgtggtgagcaggtccggcggccccagcccgccggcccgggagcccctctgccgcgctccccgtcctctttgaagtgacacttggggttatttataggcaggaagggggtgtggagtggagctggcgctgcacttccctctctttctccggattcacaccgagggctcgtttggccttccacggaggcggtgaggcgggcaccaccttccatggacgcgt

SEQ ID NO: 5787 - DNA, 2401 bp, Homo sapiens; identical to SEQ ID NO: 5563
  source 1..2401: mol_type = unassigned DNA

SEQ ID NO: 5788 - DNA, 1579 bp, Homo sapiens
  source 1..1579: mol_type = unassigned DNA
cggcccggtgcacgccggtgccactctcgcggccaagcctggggctgacaccatgcagcacacggcgctacccacaatgcaccggccctcctctgtcacacacaggcacgcacactcacccccgcgcccggagggagcccagggcccggcccgtgggcgcccaggcgccgacccctccgaccccgcacttacctagaagttgcaccggtcgcgatcccgccctggcgccctcgggggcttggggcccggccggcggcggccgcggcgagcgactccgggtaggattcagccagcgccgaacaaaggctgcgcgcaggcagcgggcgccgcctgcatccccgctccgcgccccggcggcggcggcggcgcgggggcccgggcgggtccggcgcccgctcgctccgcgctgcccgctccgagggcgctccggctcccgcgctcccgctcgctgctgcccgccaccgccgccgccgtccggctaccgcaccgcacacatcaattattcatcgcccgtctccagcttcccgggcgaagccaatcataggcggaggctccgctaatggggccgccgccgccgccgccgaggaggcagccagccgcgcgcccgggcgcaagcgacagctctccagggacggggatgggccgggggcgcgcggggggcgggggcgcacggggcgcgccggagaaacttcccacggcccgcgctctgcgccgcgctcgcggaccctgcgggcgtgaccacccaccctgcgtgtgcccgcgtggggctgggggctccgggggaggccaggccagccgcggcggggggaggggagggaggaggaggaggagcgcgggaggaagatgaaaggcgagcagacctgccttggcgtctccagggagccccggctcgcgcgcgccctccccgccccgcgagcctcgccgtccgcaccccgccccccagcccgccgcccgcactcactcgcgcgcgcagaccgtcagcccagccacttcgctgcgagggagcgcgagcgagtatgaatcggaggcagctcacatttcaaacttgcacgcaggggtggtgctggtgcacgccgctgccgagcgaacgcacgacccgacgagcagcactccagcctccgggcgggggcggcgacgaggcccctttccttcccccgcccaggcaattaattggaagcaacacttgtgcgagtggggctcccggagcgctgtcgcccgaggaggccgccgggaaggcgctggcggtggatgacttcgggtgtctcccgccccccagcgaatcctcccaagtgggcatgctaatgagggtccacggcggggagggggtggaggagggagctgaactggagggggcctcggccggggggaggggaggggaggggaggggagggcggggctaggcatccagattaaatctcggtttaaaggattttcggaacgggctacggggtggagaaggtaggcggcccggcatcttacttccctgaccctgggtgccctggcacccccgggattccccgagcgaggggcccaggacagggtgaacacgcgcacgtacgctcccgctccccgacttcgg

SEQ ID NO: 5789 - DNA, 919 bp, Homo sapiens
  source 1..919: mol_type = unassigned DNA
cggctcacccaccccgcgcgcctccacatacgcctttcctcgacccctcacgagcacacgcccgtcccgcgtgcccgctcctctctgcctcccgccccgatcctacgctccccctcctccctggaccccgccccctggagcgcgcccgcttctctctgccacgctccccttctttcattccctctcctctctgcccgttgccccctcgtgcgcgctctccctcctgcacaccgcctcatctctgccgcaggcccgactcctgaacgccccctcctctctggccccctcccctggcgcgcgcccccttccgcacgaccccttctctctgccgggcgccccgcgcctgcacgccccctcctctctgccgcgccccctctactctgcggcgggctcctactcctgcacgccccctccactctgccgcgccccctctactctgccgcgccccctctactctgccgcctgctcctactcctgcacgccctctcctctctgctgcgcgttcccccttcgctgcccaccgcgtgccctctgctcacctatccgcgcgccccttccgctttgcggcgcctacactggctcctgaggcgcgagctctcgttgcctggcaacgggacgccgctcctgggtggcgagcaggcgcgtgtgtaggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgg

SEQ ID NO: 5790 - DNA, 944 bp, Homo sapiens
  source 1..944: mol_type = unassigned DNA
cgctgggcgaggccagggctgcggcaggggagccgagccgggagaggggcgcaagacctggcgctgggcgggacgctcgggcagggtgcgggaggggctgagggccgcccccactgcctccccgccttggagctggggccaggcggccggagattggctggggcgcacggcgaggcccgggctggagccccgaggtgggaggcgccaggatcagtcggggcgcccgcagcgcaggctgccacccacctgggcgacctccgcggcggcggcggcggcggctgggtagagtcagggccgggggcgcacgccggaacacctgggccgccgggcaccgagcgtcggggggctgcgcggcgcgcacctggagagggcgcagccatgcgggcggcggcggcgggggggggcgtgcggacggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccaggtagcgccgccgccgccgtccccgcgcgctccgacgg

SEQ ID NO: 5791 - DNA, 1096 bp, Homo sapiens
  source 1..1096: mol_type = unassigned DNA
cgagcatcaggaaagcgaagccacacaacgcggctcctcctagccccggcgcggcagcctggaggggatgtcttttttgcaaagcgagttctccaactttcccgggccttggcggagctccgggaccgcgcaggggtaagtggagtgccggggaaggggcgctggggctggggtgccggggcaggggtgccctgtccgcacgtacccacgacagtgagcagcatgttgtccagcagcagcgccaggaacacgatgaacaggatgagcttccgcgagcggcggctctcctgcagccagcggaccagcgccagctcgctcagggccatggctccggggctccgctgcgggcgcggtgcgcggtgaggacccaaggcggccgtggaccccccattctcccgtcccccaggccgcggaagggcgggtcagggagccgcgcgcaccggcatccggggacacccccgggcgccccagcctcggctcacctgcctcgagcgcgtccccacgagagcccgcgctccctggaaagagcgcccgcgagcgccgtcggggacccaatctggagacccaacctagaacccccaggacgctgccctgatccccgccgcccccaactgtgccacctcccaaactgcacgctcggccccgtgcaccttgcgccctgcgccctgcgccccggctgccccggggtccccgcagccccgcccgcgtagctctgggggcctccctgcctccctgcctcccccgggcccgctcccctccggcaccgcgccctgcgagcagggaaccggggccgtgttacctcggggtcgcttgcgatgcctgcccgggtcctccgtgcccgcgccaacgcccgcaccgcagtgggctccgtcagtccgggcggctccgggtcgcagtctccgccccagcgccccgccgccgccgctcagtttaccccgtccggctctgacgtcacggccggagggagcgggggcggggggctggggcgccccggcctccgcccgcccgcgccgtcgctgcgcaggaggggctgccgcctccctgtccccgcctcggccgcggccgcgcctcttccccggacccagcgcgtggccga

SEQ ID NO: 5792 - DNA, 4048 bp, Homo sapiens
  source 1..4048: mol_type = unassigned DNA
cgcacgcctagatgggttcctcgcgcccgggccgcagtcacctgagtttccgtgaggctgaggctgtgtgccagctgcttcctttcggcgcccaccacgtagtgattcttctcaaaggcgtgttccagccttagaagctgggacggggagaaggcggttcggatccgcttgggctttcgggccagcgcgttgtgcaaaaggaaactctcggggctagtgtcgttccctgcggggagcacagcagaaatcccattagggggggctgctctgaccggagccgcgcacttctcccgagccgggctggcccggcaccgtgctcagggccttcgcatagccgcgccgctcgacctgcgggggccggtggtcctcccaagggctcacgaagggaacgcctgctcagctgcccggcccggaacgccgggtctccaccggtgcggcacccaaccagccgctgtcgcagaggagccagtccccaggctcctgacctcggccggctccgcagccgccctggcgccgcgggcctcgccacctcctcgccgggcgctggaggcaggggagggagccgcagagcctggccaggggattggcgcccacaacccgaagaaactactttctcttctttctaacctctcggggaactttgacccacggtggaaaggcggcgggctgctctccagagttttcatggagatttatttttaaattatttgttttattgcccctccggaaaagtatagaggcggggcgagtcgttgaagcccgatcgggacagaaatctggccggcgggtgtgcttggctacagccgctgctgcctctcgcgaactgggctccggggctcccggctcccgagaactagaagagaaacgcgagcgaagggatcgaaacccggggggttaccgacttgcagacaccgccaggacagtctgtaacgcaggaagatcccagcggctccgggtctggtgaggggaccataagcatgactgatagcgaatgaggaagggcagccctaaacttttcaagcaaagcctcagagttttgggttcactcattagcataggaaatcgattcaccgaaaacccaaacaaagaaaaacaagccgacagtccaggcaggatgcaggcaaatccagttcgggattaagggtaaaaggctttttgggttttttttcctttggtttgattttttaaaatatggggaggggggtgacatctacccgattctaggctccggcaggaacgcaatgggttaatgaatggacaagccgcggagtattgatcggctgccgccggaggtaggtcttttactgactccaatccgtaaactaattactcctttttctgaagttttaactctcctcctcccaccccgtacccagagaaaaacaaacaaataaaaaatatcgcaagaaatgaaaacacacgaacagatatttccctctaagacagtttcctgaccaggttctttttttttttttttaaagaaagaaagaaaaacaaaaaccagaccgaacctgccttcccgctgtggctgctcggcgccccaattaagcaggtcgcggcgagagcgccaagccctggagctttcctcccgcacgggttcccgcccctccccaggcctccgaaaagcaggaaagaaaaaacaaatcccatacttttctcccggggcgcgaggatcctctcgcctccagaagagggtggaagactaagaagccgcgggtctggactgaaggggcgcaaagtgggtggtgaacagggtcgaacgcagtcgaaagcaagcctggcggccgagtcctgtccgcgcccctcggagccaggacggttgggggcattgccgagggtaccaggagcctggggatcccgcgggctctgggctccgcggcgccgggcacgcacagcccagcctgctctgattcgagcgcactgggggacaacttctccgttcgcaccccttcccaaagggtcaagcggcccgcaggccatcactccaaaccagtcgtagcttcggagactggggatcgacaccacgcccggccccgcgccgcctagtttcccaacagggcgcgctggcccgcgagccggaggaacctccgcccaggccttgccaagcgcccacccggagcaggccgggggcagtgaaggatgcggcgggagcggcgcgctgcagttccgcgacgtggcacgtaccttggaagcgatgacccagatatcggtagcggtggatgagccaggggtagaaggtggacggatcccgctgctgcgaggcgaatagggggtgtggcgagtgcgaggagggtagggggtgggcggccagggcgtgcggcggcggcaccgggtgcactggcacggcggggttgggcgggtgcgagaccgcctcggcgaacaccaagtccgggttggagtagacgcccctaccggcggcggcggcggcggccgagtggaagccgttgaggaacggatttatggggctggagttagcgtagctgagtgccgcgggacggatggggtcctcggagcgcgaggcgggcaggggactgtccttggccaccagcgactcgatggtgaagcagcgcttgggcgccggctggaacatgctgcgccgaggagcgggcgccctgggctcccagctcctggcgaccgccgcacgctgcctccgccgcccgctgcccgcggcgaggacggacgagaattggggactcgtttgtttggggtgggggtgggggtggggggaaggaaaggaagaaagaaaggaaaggaaaggaaaaaggaaaggaggggggagggagagggagaggcaaagccgaggatcccgagaatcttgcaccaaacgcgcccaacctgaagagaggggggaaaatccttccagaagaatttgcaggcgtggattggggtaattttttttctttttttttctttttttttcttttttttttttttttttttttttggcgagatggcgtggggggatcggagttagaggcagggaggagaaggggggaaagttctcgggggaggcaaaaaaaaaaaaaagttttttctcctctgcaaaaggcgggcagggcgccctaagtccaaggacaatccatggaagtgttcgcttcttcacaagttgtgcaaacgatttgttagttcatgagcctaattagtgcggggatcacataaacagcttcctccgaagcctggtaaatggcttgatgattggtcgctattactcgccctgaggtggaaggggggagactctttaaagtgcgtcagagggaggtgagcgcctgggaacccggaggcctggatccgggccgagagtggaacggagtcggcgccgccgcctcggctgagccttctgccgcccaccgggcggccgggcttctccgcgccttcgcccctcgctcccagctcactcgctcctgcggcgcccgctgcggcttctcctcctccttcgcctcctcctcttcctccagtttcttcttctcctcctcctcctcttcttcctcctcctcctcttcttcctcctcctctttccccacctactccccctcagccaccgcctcctcctccaccagcaccactccctccggggcaccccggtccctgcagagtccctggccggcgccgcctccgctgcggccccctgaatcccgagcctgcctcgcccaagctggtaggacagaaggacagacagattcctctagcctagcgctccgccgctgctgccttacgcggccccgcgtcgggagaactgggatcgccccaagagcaccgcgagggtaagcgggcaggggctggttcccgggctaaaggcgccgttcggttataccaatccccacacttagcaaaactcccagcggtttcctaggccaggagggatcctggagtgaggggtacggggtcctcccaccccatcaaccacgcttagcctcgaggtcccagggtcggtgcgttcgcgattcttgacccggctcgttcgtttgcgagttgagaccgggagctgccgaccccgccggagcagtgggcttccaactctctccctctctcgccccacggtctctagcgt

SEQ ID NO: 5793 - DNA, 3292 bp, Homo sapiens
  source 1..3292: mol_type = unassigned DNA
cgcgcccaagccccagttcctgaaggccgctggacttctcggcgccctcggcccggcccagtctcctccggggtccggacaaggaggccgggcgctccctcccccacccctctggggcctcagaccggccgtagcagcggcacggaagagaccaccgggtgcgagtagtagacggggtgcgggaaggtgagcagcggctggctgactggcaccggggcccccgcggctgcagccgccgcgccctcggccgccgagttctcgtggtagaggatgggcacccgcacgatgcgctgcgccgcggcatggctcaggttggccgcctccagctccgccgccagctgccgcttccacttgttgcggcggttctggaaccagatcttgacctgcgtctcggtgaggtgcagggacgcggccaggccggctcgctccgagctgctcagatagcgcttcatgtcgaaggtggactcgagctggaagacctggctgcgcgagaagactgtgcgcgtcttcttcttgcggcacgccggcttcttctctggactttcagcgcccttcttccagtcttctgcgcccggagtggccgccgccgcccctacgctcgccccggccgcgcctggcgccgcttcgccttcctttttgctttcctcggagtcgctctcctccagaatgatctcgtccgggctcttggagtccagctccttgtgatcggggtcggccttgagcagtggctccggagagtcgcggtctgtgccggaggcgggggaggagtctctcagcaaggccttctccgaggctggggagacagacagacggacgcacacacatgcacaccgacacagccttgagcgaggcccggcgcctggggacggcaggctcaacccgcgccggcctccaggtcccaggccatgaggcctcaccattcccgcgggctgcctccttctcggctgggccagagaagggacgccgagtcctgggatccccctcctcccgaggacaggcaagcagatggtggtagcgcggccacctccttccattccctcagcttcctcgccaggggccggcagaacggttccctttcggcttaggcgcattggaatcaccccctccttccaggccgtgtcccaagccccggccgtccgaagcctccctattcacgcccgaggccacttttcccgggaagcaccgtgcccggggctccaattccacttcttttctcaccaagtgggattggattaacgggcagcgcaacccagcgcgagggcaggctaggggccgaaaaaaactgaccgagcagagggtttgcgggtgctggggtcccagaactgcggagggaagcagcgcggggcggggacggggcgggcgcgcagggggacaacgaaagttcaaagagaggtcggtaccttcaggtcgcgggaggtggccgccggcgggggtcagggtgtaggggtaccaccaggctggggagcgctccaggtagtgcgcgggcagggcaaacctctgcgccgggatctcaaagcgagggaaagccaggtcgcccacctgcgagagcgcgaagcccgcggcgccctccagggcccccttggccgccgcggcagcggcagcggcggcggcggcggcagccgaggctggcgcgaagagcgtccgtgggggcggctgaggcttagggggcggccggtggtggtctccgttgagcaggttcttgatggagaacggggactccttgggagcgggtggggggggcggcggcggttggggctgtgcgctggcggtgccggcagcgtccggcccgggttccggcatggtcccctctcctccgggtccccgggagggagggagcgggacaggcgggcggcggggcgagcaggcgagaggccggaaatcagaccataaacggaactcaactacggggcgcaaagtcgggggccgccccgggcgcaaatccaacggcgggagggcggagtgaggacccagacgggcgggctcgcatgagggaggggtgcggaggggcggggagcggccctgccgcggcaccgagggatcgaggcggctcggctgcggctgcggctcccgcggaggaggcagcaagagcagtccccggctcgaggctgcgtcaatccggcgccggatgctaatgatgaaatcaaaatgtcatccaagttaaatgcggggagtatacggcgattgggcgcgtacaatggcaaatgggattaggcaggcgaaggctcagccgagccccggccccgcagccgcctccgccaccgccccctcctcgccttccctcggattttggcgctttggcttcgggctataagagcccgcccgttattggctttatatagtccaattaggcagcaaatgaggacaagcctattagcacaaaaggatattggctcccgctaaagaggcactcggagcgctcctgcgagcgcaggaggcgagcgagggacgcggagcaggcggcgcccttggccgaagcgcactaacggccgcgagcccggagaccgcgcctgcctctcccccctgcggcgcagggacccgcttcccgccgccaggcctgcgggaggggggaggggcggaccaggccctcccgggtcacctcggggttatctgcgctcgcagctgccgctcccccgccccctggggctggacaggggcccgccgcccccacgcagctggagagccacgcagcgccggcccaagaggcaggacgtgacctcggccctcggagaactcatcattttcctaccctttggggtccggcgacctcggtatttttcctaaagcctgctaggaagggcgaggccaagaagagagggatttgggttccccacccaccatccagccgatagtaagggaatccaggtgtaagtcctcgcactgcgtcttcggactcagaaatccgcgtggccttggcctttagccctggaaaaccgaagagtgagccttcccccgggaccaggagtgggtgtgcctgtgtgcgtatgcgcgctgacccggccaaaacccgcgcgtcactcggtggggctgctggggcaacagcttctcggcaccgacggctgctctcggaagggcacccctctgctctggccgccggtgcccaaggctcgcggatcaactccgagtctgtgaccccgacgacagcactttctcccaggaagtctctccggccagctggcgtttggagctgtctaactaacgctttaatgggggcaaggtgaaccgaaggcgcagcggcgtagcttcctccgccgcggcaagcagcggcatccgctgcgcgtctcgacggcagcga

SEQ ID NO: 5794 - DNA, 3753 bp, Homo sapiens
  source 1..3753: mol_type = unassigned DNA
cgcggctattctctcggtgcagcgccctcccagcccctgcgcggccgcaggtgtcagggcgaggaagtccgtgggcgcccccgccgcgcgtcaaggttccattcagagcaagcggccgcgtgctagccggtgatccagccacacgctgaaccaatgcaaactattaacaacaaaagagtgtagggaagcgcctttgcctccctcaccttctttgcctggtcccgggcctcggatctctcctgagccgcagaactgcctcaccgcgcccagttccctctccgcgcgagacacataactctgccaccggccgggtagctgggcgcagcgacaagctggtcgcgccaagctcgcggcgagcaaagtggaggctttactaggtacaagcagcgccatcgcctgctttatacccctggagaggaagtgcgcggcacagggcatgtcatagcgggagctgctgtggccaagctcaaggcgagcccagtgccgggaatatgccgctgggcacccagctcgcttgttcccagaaggcaatcgcttaaatggcgaggcctgcctcccagtctttgtctttctccgcgcggactcttgagctggattccagccggggtgcgccccagcccgcgcgacgattctgggcgttaggagggagagtgggcgggcagctccagccacgtgcagtctgggcggcgccaaggtcccgacctttaacccctgaccccggtcccaccctccacgtggagcgagccaaacttccacagacagacgcatgcaagtctttccaccgaaaaacctgaaaaccttccgtgcgttatcatgccgggtaaccaagcccaccaaagttagcaaagatgtttaaaatgttttatttttttttctttttaaaaatatttacagatctgaactctccccttttcgtccctaccatcctcgggatgagggaaacgaaaagaagcaatttagtaattgtccaaagcctctgagggcctggcttggccgagcgtgtatgcatgtacatatatacaggtgtatatatgggggaggagtgtacctggttttgtaggtgttttcctgatttttttccctaccaaccacagcctgtctggccaaaactccctttcccaccaccacccgagaacatctcactccgaatggttttcaaagcgtactggttcggtctaggtaggaagcaggctctctgacttagggaatgccaataaatacccgaaacaatcaaaacaaaaagtagggcagagaccataaataagagctaatgaatacacatggtgtatttcttcatatttctggaaacacgccgccttgctccggagccctgcttacagtacagtacgcgcccggctctgcgggcagctgggggcggcgcggggcggcgggccggtcagtagtcgagcttgttgtataggttgtagagaggtaaggccgagaggttgcttcccgggtagtagagcggcgcgggaaaggcgagcgagcgcggcaccggcacgcgcagcagcgaactgtcccggaacaccagcggcatgctcaccagagtctgcgccgacgcgtgcgccatgttggccgcctccagctcagccgagagctgccgcttccacttgttgcggcggttctggaaccaagtctttacctgggtctccgtgagctgcaggctggaggcgaggcaggcgcgctccgagctgctcaggtagcgcttcatgtcgaaggtggactcgagctggtacacctggctgcgcgaaaagacggtgcgcgtcttcttcttggccgcgccggcctgccgctcagcgccgccgtcccgcggccgctcggaccccggcgagggcgagcccgcgggcaggagcctctctttctcttctttaaagtccgagtgcgaaggagagaggaaaggcgtgcgctccaagccgcccgggcccgagcctccgctgcccttgggggtacctgaggagcgagaacagacagaaaggccatggagttggttggggagcctcggagaccgccagctctccctgggaccaagcggttggcaagcgcctgcagccttggtcccaccttaccaatcccctcctcttatccctctcactggccccccaaacccagcaccccgtcctttaaaagcgacaagagagggacccagctacttggagtatggggtctctgtgctcccacctttatgaatgggccaggggcaacagggagaggaggtctggagggggaaacattagcatggttttaaaaggcgaatttgcttggtggtaattgagctggaagagttcctcgagctttatagggtggcatcatttcacaggccgtttgtttggaaatcacgctaaggactaacgcaggactccccttcgtcaaatgttgtaaagaggaaccgtctctgaaatgcaccattgtcaatcatcttggagtgctaatcattccaaggaggagagagagagaaaggcagagatacggagcgagtgaggaagaagactcagaaagagattacggtggagacagactgcccagacccgacttgcagatctccacctcgtgtccggaaagaaagtaccagatgtgcagtgattgaggacagccgggtgtaaggccggccgcgtgtccctctcgctgtggtccactctctcaacaactcaaccttccccaggaagcccaagccggcacgggtctgtgttcgcctgctcccaggggcccaccgggcggaggaggcaccacagtgcgcgcccctctccccgcggtcccgaacccccggctgccgcagctctggccagagggggcccggcgcgggagtcttggcggggcgctcagcctccctcccctcgcgctcgctcgctgccacactggcgacgtgcgatccttacccaggcaaggaaaagggatggggggatggtgcttggggccctgctccttagggccgtgctggtctgggcagaagcaggcgggcgccttccagccgtcgtccggctcctcctcctccgaggacacggacaggctgcgcttcctggctggccagccgacgggctcccgcggtgcctccgaggggcccccgcccaggatggactggatggtgaagctggagacgccaccggccgccggacaccccttgcccgcatcttctttgctgcccatcctgggttcataagaaatcgaaggaaaccaagaactccctttagagacgatctgggtgatctgggtggaaggtggtgcagcaggcaggcagtggggaggggcggggaggaaatctagggggagggggcgccgaggctggtgaggcgtcccttccgcgccagggacatgcaggcaccggatggctgcgcaggggttcctgcccgcctggctctgggtgcgcccgcccagccccggtgcaaatgccccttcctcgcccgccaactcgccgggtctccggcggcgcggaggcggcgcggcctcatttgcatagaggttacccgaacgcggccaatcgcagcgccgccgagcggccccggaaaatttcaaaacgctccggccaggcacacagcaccggtgcgcccccagagcgcgccgagggcctggcgggcatcagcggcgtctaaccaggggcagccagggctgaaagcagctgcagattctagcccgggttcctggcggctgcggcaactccgactccttggaccccttggacccttctctccagaggcaggggcggtgcgggactcggagctggagtggctcgacgcctccgcaggcgacgggtctccgcgc

SEQ ID NO: 5795 - DNA, 829 bp, Homo sapiens; identical to SEQ ID NO: 5784
  source 1..829: mol_type = unassigned DNA

SEQ ID NO: 5796 - DNA, 1328 bp, Homo sapiens
  source 1..1328: mol_type = unassigned DNA
cgggcgagagatgcccctttgggcgcttagggccgggcggggtcgcgcgccgggctgtgggccgcggtggagacctgacccgcactccgagggttcccagagagccggggagcgagtagcagagtcatcgtttccagcttcagcctgaaaagctggaccgtgccgccgcatgtgcgcttggcagccgggcgccccgggccctgcggccacatcatcctggggcggggacgtgtgcgctccgggcgcccggacgccactgagccacgtctgagccgcccaccctcgggggtgagcgagccgcggctcggggcgggaccctggcggggggacccgagcggtctctaggacccgcgggacgccgccaactggcgggggtgcgggggagacaataatttgttccgcggtaataagaacggtgactgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggtaagtcgccgaactagggcggctcgctgcccgccccgccgagggcaccgcacgctgcgcctgggcgcgccgaggtccagggctgccccgaggggcgacgcgccccggcgcatctccggagccccggggcttgcgcttccagcgcggcgagaccgaccccccccccccaggtgccaattccttggggaagggcgacacttggcccgcagccccacaggagccagtacctgccccggagggcacagcctcgggaccgctcccccgtcctcaccctcttgggtgacatttgcagatgtctctgtatcttgacatttacacgtgtcactcgggacgatgcgtgtcgggtcctcttgctggccctatcccgcagtgaatatccccaccccaggctccgggccagcccttcaccaggtttcctttccagccccgcctcccccgctaacacacttaggggggcgcgcagcggccccgc

SEQ ID NO: 5797 - DNA, 2957 bp, Homo sapiens
  source 1..2957: mol_type = unassigned DNA
cgagccgcccccggctctgcgcttcctcccagggcaccaaggccttcaacgccaacacgtggggctgtcaccaggggaaaccggaggcctgagctcagcacctctggacccgcacccggctagcctccagcctcccttcaaacttcggtcccttcccggctgtagaggaggtgactgaggcggaagccggcggccgcggtctggtggccaggggcgaagccaggggaggggttaagggtctggggagcgtgggtggcgactgtcggtggccgcctcccgaaagaaaagtcgcccgccaggcccccggggaaggtgccaaggccgccagccagagcgctcatagcagaagcgaaaccggagaagcaggtggcggcctcgggtgcggatggagagggcgaggcctgcaggtccaggcaagccgcgctcgggggctccagcgctggcgcctcggcccctcccacgctcctggctcccgagcgcacggccgcgctggcttcagctctcctcttcctcttccttcggaagttcccgttgtcaaacatcttctcgcagttggggtccagggtccagtaattgcctttacctgcagaagaagaaacagcccagttcagaaggttcgagctttgacgggccgtggtgtgagccagcgaggaggtcagcttcagaaagatcccctgctggcccttacagagggtctgagtcctcgcccccattccacccttgacgggcactctgtacccgatgggcctccacagcaggactgggaagaaagtgacaatccagaaaggaggaggaagggagccctgggaaaggccgagccccgttaaggtgaaggaaggcctgcgagatgctaatggtgggactccgccagccgctctgccaaggacagcgcagaccacgccaggcccccaggtaggctccagagctttccaaacgggcatcctatttgttttgcccatccttggggtaggcgctgtcttccccattttaccaggtagggcactgaggcccagggaagttgagtcactcccaaggtcacccagcttgctggctctcccgcttcttcctccgaaggagcgcacagagattgagagccccgggaccgccgcactgtaaacgcgggcctgtggtgggctcagccgctgtctgagaacctgtccatgcccaagcacttcttccccttctccctcctccccgggtatccccaaccgcgcagggagaaattaggttgtctaaggtgctcccacccccggagtgcccgcggcccggcgggaagatggggagtcctggacggagcgagccggcgcgccgctgttacctgggtcgtcctcgtcgcggggcaccttcttgaagcagtcgttgagcgacaggttgtggcggatggagttctgccagcccgccttgctgcgcttgtagaaagggaagttaccagccacgtactggtagatctggctgagcgtcagcttccgcagcggcgcgctctggatggccatggcgatgagcgccgagtaggagtagggcggccgcaccagcctcagcagctcctgctggccggagaggctcagccaggcgaggtcggcgcccgccaggccgcccggggcgccgaggagcgggccgggagccccgtagctcggggccgcgtagggcggcgcaggcccgggacccgaagcgtaggacttggggctgagcgctggcgcgttcacccacaggagggggcccccgcccaccgcgcccagatcccctggctcatagcccggggggtgcgcggtggcctgggcctggccgggcggggccgaggaggggcccaggtcgtcgcagtaggtggccatgtccagccgcgcccgggcctgggccagcggtgccgcaccgaaactcactggcgacccatccagcttggccgccagcagcgcccgggtgcgaccagcccggcccagccctccgccctttaaacaccgtcggggccagagcccatggagagtgacggtggcgagcccctcccctggcagccctggaggagcgaaatccttgtcctcgccctggtgtcagttttccgccccgcccaggcctgacacgtcctggaccggacgcccctctgattcccccttcctcctttgtgcgatccgtcccgagtccacagtcgctcgcggtcttggttgcagggaccctaagtccgtagcctcgtctggcttcacgggccccgcagccccgactgccctggaccgtaccacgactcctcaaggcccccagggctgtggcttgggagccccgtccaatgcgcggcccctttgctcggctcgggacatctcgccccaaagaaactcgcctcgccggggcccctgggttacccgggactcggggctagggatagagggcgactacactgcgcaagagatcgcaatgaagtccgtagatctccaggctggagccgcagagcgaggtggcgaggtggagaacgcggggctgggcctggacagcggccctggggtcgtctggagtcctcgctccctcaacccggaaggcagcggactgacatctgcgccgaagtcgcgcgtaccccacggagggtcgggaccctggaaatttcgaacgccccagcagttcagggcagtcatcgcttttcccaagccggggagtccggggccccgccaggtttctccgcgctgtgacctcgggcgcgcagagcggagagcgccaagctctctgctgggtgtcggaggacgcgccgaaaacagggacgtctctgcagtgcgtccgacaccagctctccagtcctgctgccgcccggggttgctgcagcccgggttatcccggccccccaagctgcccggctttcggcctcccctgctccccgcgctgtggggtggcggaggatggacccaggctgacgctgggctgggtacctggaaagagggcccgcctcccggactccgagtcgggcacctgtgcgaaagaggcga

SEQ ID NO: 5798 - DNA, 1860 bp, Homo sapiens; identical to SEQ ID NO: 5570
  source 1..1860: mol_type = unassigned DNA

SEQ ID NO: 5799 - DNA, 1422 bp, Homo sapiens
  source 1..1422: mol_type = unassigned DNA
cgcggggagcagaggtgcccagacacgcggcctgtccccggcccccactccacagagcctcccaccccggcactgagcccggaagcccggtcaccagctcgccattccacaacttttccagcctgggagtccccatacgggtggccgcccccccgcagcggcctagcccccagctgcaggacccccgggacccccgtactcaccatgagcgctgcaaagttgcggaagcgtgagcgccgctggaggaggcgtccagggggaggcgatcaggtggcgccctgctccccgccagcctccatggcctctggaaggtcaaagtcccagacggcggccaggaggtcgcgctcccgggcccctggcctcagggtgaccgcggcggggcgggcgcagtccgggagctgctcccatctgtgaagacagcggcggtcagcggggcgggcggagggtccccgcggagggcagctcgcagccccgaccccgccagggagcagccgcggcccctgtcgctccctcccctccgcgggcggcctgggggctgcgcctggggctggcggaggcggtgccggtggggaccggtggggggctcggaccgaacgcgccagcggcagatgcgtctccttctccatatttaaaaatcaatctgcgccccactcccggctccggagccaaactcaaccatctcgggctgcacaaagccagaggcgcgccggggggtttgcaccgggaaccggcaccgagtgacccgcccgccccagcccggccgcggcgcctgctctgcctggatgtggctcgagctccgggccgggcgcgcggggcgggggccctggattatccgtggcgcctcccgccccagcggagccgaaagttactcggagctgctttcctcgcggccagtgtcacctcggggcgcgagcttttctgccgagccgcggccccgcgcgtccctcccgccgcccagacccgcgcgtccttcccacctgctgtggccgaagcggctgccggggcggccgggccgcgctcccggagacagacgcgctgcgctccccccgccggggacccgctctccattcgcgagggcagcggccgagctgggaccgagttatcaacagattgcggggctgcggcgccggccggtgagtcacagccccgcgcacgagcggcccagcccggccagcagcgccgccgcctctgcgcgcacctcccgcggcgacagcggggacccggggccggaggcaggcgcgtaaccatggggaccggggcgggcgatggcggcgggcgggctcctgccgcagggtggggatggctcttccagccgggcggccgccgtcacactgcagagcgtatttaaagagacacctcgctccgcgctcgctccccagcaccagaccctcgcccgaaaacgccgccgggcggactgcacga

SEQ ID NO: 5800 - DNA, 1479 bp, Homo sapiens
  source 1..1479: mol_type = unassigned DNA
cgacgagtctacgaaccccatcgtggccggcggtagtcgctggtcgagcctagcgcccaggcccaggccacctccatgccgtgcgacccgccgggaacgggttcaggcccgtctgcccaaggccagaagcaccctgtccccggcccaacgccggatcgcgtcccgcccttctcaccccataccaaggaaaggaactagacgcttgggagaaaggatgagcagcacccggtgggattcggccccaacccggggccgtccccaactcccaacttcccagagtttccttcggcctcgtcccccttcccacggctccgaggccgccgcggcctcccctcgctctgagtgcagatagcccgggaagtggagagcgtagctcggagctagggagccgcccccaggagccttggcgatgggagcgcaggtggcgggcgtggtccctccaaccctgccctagccgacccggagtcggcctccgtgcagtagccaccgcccgggtccccgcctggttacagcatcaggccacagtgcgctggttcttgatcactctcctggctcggtggccgccccccgccctctcccagtccgcgtcgctgttctgcctcaggccccggtgcggccccaagtcccagcccagggcccttaggtccctccaggcggcggtggcggcactcacctgggtcgcggagccggggtctggcacggtcccgcaggtggtaaatgaaatcctggcagctgtcgtgctccagggccccacgggcacagagctcggccagcagctgcagcgcctggtgacagagcgcgtccctggccccgggcatcgcccccccgcatcctcggaccgcgccgggcaggcgggcgcaggagacagccctccgcctgccagctcagagccgccgcctccgggccgtccgcgctcaccgccagggacctgccgagaaacggtgcgagcctgagcccgagccccagacccagccggcccggcctcccaccggttgcatgcagctcttcgccagccggtcggtcaggctttctctctctcccgcccggtccctccgtccctccccagacaccgaggagaggcggtgccgcacagcccagagcgcctctctgcttgcgctccgcccgctactcgcggccgccggggggcggggccaggtcaggagtgcgcgccgcagggtaggatagcggcggccccagaccggggacctggggtactccccggctcctggccgagcgcgagacttggcttgggacctcgcgcccagagcggccgcgccctggcttggggagtgtgagtgagtgcgcgctccgggcgctttcgctactccacccctcatccctgatgcaaaccaagcacccgctcccaccgccgagtgtgtccaaagcacgttcttggatgcctagtgcgaaggttacaatctgggcacacccgccagatgcgcagaaccgagtccctgcttcgaacttggaaagagccgc

SEQ ID NO: 5801 - DNA, 446 bp, Homo sapiens
  source 1..446: mol_type = unassigned DNA
cgtgcgcctcgcgcaccttgtccctcgcgcgacgccgtccgcgccgcccgcggttcggtcgggagcggcagcccgtgctccggttccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggtaagagcaggccagctccctctgagcttcccggcgccgaagagtacggagaacgctgcttgagggaggggtgactctgagagtctgcagccttcaccgaaatatccaccaaactgactggagagggcgggcgagacggcgttgaagggccaatgcccacggttccgttgttatcagcgggtggcgg

SEQ ID NO: 5802 - DNA, 2991 bp, Homo sapiens
  source 1..2991: mol_type = unassigned DNA
cgcctgccgcctacaggcgtcgctgagggacagctggcccagtttgcggattttcctccggatcccacacccatgtccagggaaagccggagccacggcggtataaattagcgcctttattttgatcacctgagcgagcgcccgcggctcgcccgcctgcggtataaacgtacaaattccctgtagcaccacacaccatgcctcagagataaatacagccccaggggctcctgctctggcaaagcaactcttatttacaggaatagattacaaaagtattacaaaaagtggtcctgaaccgggaaacgggttgggggtgggttacggttacacctgctacatttgggaccggagtgcactgggtctcacgcccccccaaataaccggtgcatcccggggcagggcttaggtctgcgagggtctcacccccatgggggagggcgcgagaaagctgaacctagcccctcaaggttcagctctggcccaccgaggaacacggagcggccatcgcaatgggtctccgagaagggtgctgcgtggaaaaaaccgcgctgtgtccttgccctgtggggcgggggcggaaacttcagttctcccgcctctcctacctcaagagaggtcgcttttaaagcgctgttgggaggggggcatttaagttcaatcttttgggcgcgagggaccctaggggcaccatccctcgggcgggtgggcggccaccatcccctcagagcacctggtatatcgggttggggttcgcacccgcagggcactgcggggcggcgtccggtgactgggtggggtcgccgctgctctctccctcgctgggggcggcagcctcttgcctgcgcggaggcgactcagaaggcacgtccgccagcaggagggcgggcgccgcagggctctcggtggagatgcgctccacgatgctggacaggcagtctaggctcgacaccgccgcactcttcccgggcctgggttctgcgcggggagggctcggttagtaagcaggggtggggccgcgacaagcctcccacccccgggcccagtactttgagacagattggaaactgaggactttagttagagtccgggacaatccaaaagacagggagctacttgcttagtatttcatctcctgcaccacttcccaggacataggcgtgtgtgagtgggggtgggagcgtcctagatagaggccaggacagctccatgaaggaggaggagcgagcagggagaggcccggaatacccaccgctgggcgcctcgttgtagtaggcgccttcgtagcagttccgccgccgggcgccgctcggggggccgctgtagtccatctgcaaacagcaagggcgactgagtcaggcccgcgggacggctcgaggcccgaacaccaattcctgtagccgccccctccctaactctagcctaaggctctagttccgggcccagacctgtcctggttgggggggtaattacgggtgggtaggagatgaggtctgcaacatgcagggccaaaccaagggcggacagtcaccaaggggcgcaaatttacattttggaagtagggataagtagagaaaaagatcttcacgttcgcgctgcagtgttctaatagcgcccccaatggggcagctcgaacgcttgcccgcacacttccaaaacaggctaccccagtgacagctgcccaggacaagggggtcctctctctcgggaaggatcctggcccaaacctcccgcaaggccagctccccgccctcggaaacgcgtccctgatatcccgagcgccgccctaacttcctcacttcctggggtcccggccttaccatgccgtcggagcagttggagcgcgggctggacgcgtcggagtcgccgctgtagtgctcgccgccgcggcccgggggcagcgggcccggcgcatagaaggcggctgcggcgccagggggcgcggcgtcctggtcgcgcagcagagcctgcaggccctcgatatagcggatggcgttgcgcaggatctccaccttgggcaaccgctggtttggattgctcgacgtgcagcgcttgagtgtctcaaaggcctcatttactttgctcaggcggcgccgctcgcgcatggtggcggccttgcggcggtcggcgttggtggtcttgcgcttgcacgccttgcaggcccacagtaggcagcggcccgcctggtggtgcccgctgggcgcgcgcacatgctcgtcctcacgtgcgcccggggccgggtgcaccgccgcggggaagtgcgagtgctcttcgggtttcaggagcgcgcccacgtgcatcaggcgcgggtccaggtcttcgaagaagcgcaggtccggggagtcgaaacacgggtcgtcatagaagtcgtccgttgtggcaaaggagcagagagagccgtcgggggccgtcaggtctacgtcgcggagcggtggcgacagtagctccatatcctggcggtggcgcggcacggtcctggcttcgcccaacccaagcggcagagagtggccggaactttctgccgctcgggagccccggctgtagatagcaaagtgctggcagtctgaatgcccacccactgtcccccacccctccctctcctgtccggcctgatttgtggttaaggaaagcggcggcagcgccccagggcttcctcacccctagcttctcgccaggcgccctgggctatttatccgtagtagcctaaacgccccggagcccaggcgggcagctgggggagggggagtccgaggccaataggaacactgcggggcggggcttgggggggtccccggggtggccgcaggggcccgcagactggccagccagcccgcccctccacactggcgtgcgcgctaggtcccctaccgggcagggagggagggagcgaccggcagccctaggcggctgcacttggctctccggcacgccctttccaaacctctccaacacccgactgctgtatccgcgggaaacgctggctgcgcgcgc

SEQ ID NO: 5803 - DNA, 928 bp, Homo sapiens
  source 1..928: mol_type = unassigned DNA
cgagcctcgcagccctcctccttcgcctcgcccgttagctccctgccccccctccccacaccccccaccccaaagccaggcgtcgggcgcttttccctgtcgccgcccggcatccggccaatctttccaaaatgcgctctcactctgttggctgctccggcagggagcatggaggactgggggtccgaagcctgcaaagggtgaccttagcgttgcagccttcccgaaacggagacttgccatcttttcagagggcggggaagctcacaccactctctgctttatagtgtccgtttcgcctcgcttgctggcccttcgcttacccgagacattccaggcacggctcgcactggagagggccgcgctgctgctgcgaccgcacggcgcccggggcaggaacatgctcgctctcccctgcgcggggggaacgaaacccccagagtgcgttccgacacgctctttctactatccaaggcaggtttcggcagctttggccacctaggcccggggagccccagccggatctgctgcggcctcccccgcagcgtaggcaaggaccttaaaccccaaaccagggactccgattctctcttttcccctcccgtcttcttttctcttgaaagagaaatagacagaaagctcagccttgagacaaagaacgcgagtgatttctccgaaataaacttgaagataacgacataacagtgaatggcaggacgcacaaaaccccatgggctcaggtcaaatggcattagtcacaggtcttagccgcagccgccgcgccgcgcagctccttgggctatcgcggagtttgaaaagacgcgttcaaggagatcacttaaagtaagatcctttcgtccgatttcttgcttccttaggatttatttttcctttcacgggcggccagccctcgccccctcgcccccgc

SEQ ID NO: 5804 - DNA, 1267 bp, Homo sapiens
  source 1..1267: mol_type = unassigned DNA
cgcgggatcccagggttctcccgcagctctctgccctcgccgcaccgcgccctcccgggccccggccgcgcccgccagccggaagcgctccctctgcgggtgcgactcccgcagctaccccttcccagcctggcgggggtcggcgagagtggtttccacagcaccttacaagttcgggaactcggggcacgcgggcccgccctgctgcgggtttcgactccctgggacggaaagccggttactagcagcaagagggtgcgcctactcggccgcgcccctcactcctgcgcccctgaggccgggtcccctgagaaggggcactcaacggggacatcttcaagcccgtgagtccctattttcaccctgtcactccgagcagggcaaagagatcccaggaaccggtccacgctaccgccgttccccagaccagcgcaaagctcggctccaggtctccccacgccgccgtggtctgtgggcacccccatttcccggatccctctaaccgccacagtcatgcttacctgtcctggcagtgcacacacagaaccacacaactaaaatcaaatccatcggcatcgctctcgagggtccccgcctagcagggggcaccgaagctaggtggaagcaaatgagcctggatcctgaggcgcgcctggcttggagccgccaaacttgctagcgggcggcgggggaggtggctcggcagcgccgggtgctgcgctcgcatatgcgcccgggaaggcagccccggccgccccgcccccagcccgccccccaccgctggcgcggcggcggcggcgtggggctcggggcccggccccccgctgcggctgcgttcgtctgggagcccgggcaggagcgcggggtttggctactgtggcttgttgcgctccccactgggggccgattccgttcgcctccttcgcccgcagaactgcgaggatctggactgcaggcgccgcagccgctatcacccggagcaccgaagtcggagtcccaggacctgcggccgaaacgagagagcgggaggcgcacggcgcccccacggcttcacgcgctccagcccctccgagccgcagtcgccaatgttgccctctttacttccgcaccgcggtgggggctgccgaagttgccacagttcatccccgccgagtcgaaaagccgccgagccctcgcgggtgggtatttttcctcgggggaacccagaccgaggcggcgccaccgagcgcgcacggaccccctcggaaaacaattactcgggattcgc

SEQ ID NO: 5805 - DNA, 1225 bp, Homo sapiens
  source 1..1225: mol_type = unassigned DNA
cgccggtcgccccctggtgcttccggggctggtaagcgcgtagctgaggaaagggcacaaaggtggcgagctttgcgggagtagttgtgcagaacctgccggaccccagggcttggccggtaggctcgccttcggcggctgggctctccccttggagctcagactccccagccgcaggctgtctctcgggcgggccccagccagggcgcgcagccctgagcgtttgtcgctgcggcccggctggcaggccccgaggggcgcggggtcgcgggccggccggcagggctttgtgccgctcgttcccgggtgtgcgcgaggcgcggagcatccaaattgacaccatatgttttcctattagttgcttcgcggtcgagttctaggcgcataatcatcgccagtgggcgagagcgccagcagtccctagggaagggacacaatgattgaggcttaacctctgaaggggaatttggagctgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgcccgaagtttggaaagtctctctcggtctctttctgggacagcctttctttttccgggaagcttcctgtgcctagaggtggggctctgtagctggaggggtagatggaacttgcgaagcaaaggaaggcaataaaaggaagttaggagaaaccggaaacgtgggccaggccttgctctgttggagaagcggtgtccccgcaaagtccctgcttgcgctggtcccggccggagcccagatcccccaaacgcctgtcacttctcatcgagttgaggctccggcccccacccgcgccttggtgagggccccccctcagccccaagccttcggctaccctgaaaacgcggctcccctcgaaggggaaacaagtgcagttcaatctcgtctgagtgatctacaaataaggacggaaagggtcgttttatcacggtcccgtttgtcgtgacgatgcaatttcccggagcggagcactgtcacaaagtgacaaggctgccacaagcgccccgactgatcttttcaattagccttccatgcatgatccggagcgacttccgc

SEQ ID NO: 5806 - DNA, 1627 bp, Homo sapiens
  source 1..1627: mol_type = unassigned DNA
cggctgccggcgcgagcggcggctccctcccggctgcagaacgcctctcgttgccggagaaggggctcagcaaaattgactcttccttatttgtttccatccataattgatggggagatgagaacgtaacacatctcagcaccgagctcttgtcgcctggcggagaccctgtccaagacgcttccgtaaagcatttccagtcggggaacaaagcacggaaagttgctgggtagagcggccgggaggagacaccgggagccgggtgggcggtggggtggccggtgggctgctccgggcccgggagtccgcccgcagcgcgctctgccagtaaggggagagggacggtgggaagcggccgccctccgggcctgggccggggatggggatggccaagtcacccgagctcccgcccctcgccggcaggcactacccgggggccgtgcaatccgggcgctcactgacaggtatcctacgcccgcgaggggctgctccggcctcaactgcggcgctgcgccccttctccaggacgcaggctaatgctcgcccgcccgctcctagccgggcgcagagctgccagaccccgggcgtcccagcgtccgctctggggccaacgggcgggagggggcggctaagcccgcaggcggctccttcggccttggctcagctctccccggctggctcctggagacgctgtgcccggcagagaagcaacccctgctaaccccagctatgtgcgggggacgccgagctggctctgcctggcaagaaacttttacttgatgccccctccgctttttttccaagggggtgcacagtggaggagggcctccaagtccacttgcccctccccctaagccgccagctttgccagttttgacgcgtccgccaaacctctctagccctttgcgcgtcccttgcacggcaggcagagagagcagcttggaaaataaatcaactgtccagtggcaacacacacacacacacacacacacacacacacacacacacacacacagcgattcgggatctcaggttccgacccccaccgcgcgcacacacacacacacacacacacacacagcgattcgggatctcaggttccgacccccaccgggcgccacaagagcattagcaaattgttgaaaacggtcttacctcattggggggaggctggtaagaaaaaagaaaaagaaaaaaaaaagcttgccacgcgcaaggaagaaagaaaataaagaaaaatattgtaaaaatagatatccctctgtctccttaggtcttggcttccttgatagaatcctgaaactcgccaccaccccttgcagcagcagcagcagcagcgggacagagcaggagcaaaacaaaccgatgcacggcaaatggtgtaattcgatccatctccaagtcaatccatcaggcgagccggagcctggctccctccacgcactcggcagctcccggcgcgggtcccacccccgggcacggacggcaggaggcgcggccggccgggcgcgctcgccctcgcgggtgaaccgtggccagcgccgcctggaggcccccaccctggcgccgcggccctgctgacccctcggtggcctccgcgtccctcctctccggcgctctgctgcgc

SEQ ID NO: 5807 - DNA, 1857 bp, Homo sapiens
  source 1..1857: mol_type = unassigned DNA
cggcggccgtacttggccttacagtgcaaaatgtgcttggcgaggaagtcgaggcggcgctgtagcagctgagcgtgggggtctgcaagggcggccagctcggggaagcgaggctcgtggcgccggtagaggcgcagcagccgggccgcggcgtcctgtccgcggtgcagctccaggacgcgccgcgcggtccgctcgcggaacacgcacactgactgcaacagcggctcgttatacttgtcccacatgcctgctacccggtagccgtgcaccaagcccgcctcattgtccagaaagaccagcgccccgcccggaccgcggtgcaggttgctggtggcacgctgcatgacgcgcgggtcccactgcaggctgaagaggttgcttacgagccggtcgaagttggccgtcaggtagtcgaaaaggattaagtcggtccattgtactaggtccaccagctccgcctggctgaggttggccagctcacccccggcatcccggagggggcgcagacggccgtcctccgagcgccagggcgcgggcaccaccacgtccgtgaggttgggcagccagcgtgtcaggctcaccacgctgccctcggtccagtgcgcagcgcgcagctcctcctgcacctgcgcccactgcgcgccccgagcctccacccgagccagtgccagcggcggcacgtggcgctggaggcccagcaggcgcgccagatagtaagacagggcctcgccctgaatctgctccgggttgatgccgtagcgcacgcaggcgcgggtgccgtcggcaaaacgggccagtcggttggagctgcgcccgcaacccccgcgctccagggccaccatccgggcgccgcgagccgcctccagccacgccgccgcctgggcctccgaaaagcccgggggcacctgctcctccaggccgcggctccagaagacgcccccgtgcaccgcggcgctctcctccggccggggctgcctggctgacacgtgccacctgggctcgctccgggactgccggggcgggccgtccgcgccggccgccagggtgagcagcgcccggaaagttttcagggagccgccgcgggcgtcccacgccaggggcgggggcagagggaagcgaggcgcgggcgcggggccgccgctccgggccgggcgccgtgggagtcggtcttcgggcggccgggaggcgggcagctcggtccgcggcggcaggagccctccccacagcgccagcagcgagcccagcgccagcagccagagccccgcggtggcggcggcgccccgcatcctcctgcccatgctcccgcggctgtgccggtgcgccgccgccgcttcaagccgagcccaggcacccgggtcccggcggcgaggcgggcccggcagtttgtgggctccggggcttcgggcgcttcggccccatcgcggccgcggggcgctgcggggctctgtccggcgctccgcccggcgctgggaactcgagtccccgccgcttcccagctgcttttgtatttcgctgtgagaccctccggtgggcgcgattcacaggcgcccggaccacgtgggagccagggggatccccctccccctcctccgcctccgctccccgccccccgctcccccgcccccttcctctcctcttccacttaaagcggcgatggctccttccgagagggagaggcggccccacactcggtccgggacttgggggcctggaggaagccggactggctgcgcccgcgccggggcgtaggagggggtggcgcagagccggagtctggggcctggcgggagggacgcgccctgggccctcgcgggggtgtcttggtcgccgggtccctttgcctaggcagcgcgg

SEQ ID NO: 5808 - DNA, 2423 bp, Homo sapiens
  source 1..2423: mol_type = unassigned DNA
cggagcgcagagaacggctggagacatagcggccgcggttttccccgcagcgcaggagcgccaggcactgcgctgggtcaactgcggtcagggagtcacctgcccgcgacagcgagcgcgcacccacactctcgaccaacccaggctggcctccagcccactctcgggtcccaacgcccaaacatctcgcattgctggctccgacatctccccacccgccgccaggaatcagcgcagagggagatgcgtcttctgtggcgggtgcggggcgaggaccctgaccccagctctgggaagtgaactgtacggaggagagagctctccatcgtcagctctgcctccgcccctcctgcggcttcacttcagcccggatgccggcgatggggaatagaccagggacgcaggagcacactggaccgggggtggatccacttggggaggcaggcaaccgacccgcgcaccggtggcgcaacctcgttccggtgaccgaagcttgtggaggtagctccactcccggctccctggtccgacatccccctgccacctcctcccccacctccccgagtcttgggagcctggaccccgaaggtgcaaaaagtcaagagcctggaaaactgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccggcgctcccgggccagggcgagcgcggcgaggggcgcaccgaccggttcgcagcggggcgggagtccgagcgcgcgaggagcggcggtcccgggtccttgcgggtcccccgggagcagggcgcgggcactctcggggttcacacgccggtccccgcgcggaccgcggacgcgcgcgtcccccccgcgggcggcgccccttacagggccgagtcggagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgccgcagccggccccggcccttgggcagcttggcgggccgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgctgcgccggggccccccgggaggcagcagccgggggctcgccgggcgggggatccaaatctgctgcggggtggcggcggccctcgcgggcccgggccggcgctcctcgggagggcgggcgggcgggcggacccgtcggggggcacggggctcggggggcgctgttccgccgcgctccgaggcgctcgccgccgctgctgtcgccgtctgccccgcggcggccaggctcgcggcttatatagcccgcggctgcccacacggctctgagctcggatgacagcgaatgccatttaaagcgtgcgcgccccgcgcccttccgcctgacgtcgccccgccgctctgggaaagtaacggccccttccccggcgccgcccgccccccgccaaccggctccggaaggcaggccccgcccgcgggggttccgggagaagccgcggccccggagcacgcggctggcccgagctgcgcccggacagggaccctcaatcgccgcgactgggcgggcactgtcccttctgggatccccaagtctgcaccaaccgggttggccgcggggccgcaggtccccctcccccgccccctggtcccagatgcacacacttgaggcgctggttattccaccgccggttctgcgcggggcgcgaggcagctctcagctctctttgcagcctggcgagcctgagcgcccggctccccagagctgagctcggaagaaggggtgggctccccttctggatccttgccacccccctccgcaggcgcgcgcgcgc

SEQ ID NO: 5809 - DNA, 1146 bp, Homo sapiens
  source 1..1146: mol_type = unassigned DNA
cggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaaggtgagccccggggagcggccgcccggtgcctgggcgcgggggtgagggcctggggcgcttcgtgggggtcggagtgtgtgtgggctcctgaggcacgggggctgggcacgagggcttgtgagtgggtgcgagcgctccagggctgcggggacgcgtgtccgggcgagggcgcgtggggttggcggtgggcggggcgagtgggcggggccggcttgggcgtggtcagcgtgagtcctgcggcga

SEQ ID NO: 5810 - DNA, 577 bp, Homo sapiens
  source 1..577: mol_type = unassigned DNA
cgctctccctaccctgcgcgccccacgtgcctcctgtaaacaagagaacgcgcaggcgccgcaaaccagcgcccattggtcggcgtgccgtcgccccgctggagggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggtgaggacgcgccgggggcgggggcgccaggcccgggtccaagggataggagctttgacctaacattgggatggggcctgcccgctggacgaaccgatctctggtgatggggaatgggcagcgccgcacgggcggggccttgggcgccgtcaagggccgactgtgcccgc

SEQ ID NO: 5811 - DNA, 1721 bp, Homo sapiens
  source 1..1721: mol_type = unassigned DNA
cgtgagcctccgaaaggcgaagggcaggcagcagccgctggcttctgcgcccactaggagcttcggatgcccgagttagggctgcgccaaggcggccggagcagagagggagacggggacggggacaggcagggacaaagtgcaagaggcaaaactggctgaaaagcagaagtgtaggagccgccaaggggcgggacgaacaggtccgtgggccgggcggagccaagggtgggggccggggtccctccaggtggcactcgcggcgctagtccccagcctcctcccttcccccggccctgattggcaggcggcctgcgaccagccgcgaacgccacagcgccccgggcgcccaggagaacgcgaacggccccccgcgggagcgggcgagtaggagggggcgccgggctatatatatagcggctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcctgcccgaggtcggccgtgcgctcccgcgggacgccacaggcgcagctctgccccccagcttcccgggcgcactgaccgcctgaccgacgcacggccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagtgagtggcgcggccaggcgcgaaggggcgggggcggggggcaacggccgccgggccaacccgctcagtcacactctgagaccctcggcgggcacctgctcgggggccccgggaaccggggcggactcgggctccggtcccttctgacgcggggctggggacgcagacactcttggctccggcagcccagcgcaacccctgaggtcgggcgccgcctcccgccttcagaaactcgggctccgagcgccgaattccagcgccttcgcccgtgggcacagggcgcgcggtgcagccacagggggcccgagacacgcgccccggcctggcccaggctggggaaccgctggggtcgggctcgcgtctgaaggtccgggactgggtgcggccgccgggggtcccctacacaggcaagctaatctgagctagcgcaggcttgggctccggaggccctagagggcagcttgggctctggaggcccttgggggcggctgcgccgggaaccctggccctttatccccaaccccaccccagaaatagggtccccggaggcgaacaagccgaggggcggagtgggccagggatcacctgccccgcaatgacctgcgccccgcccccaggcctgctggagctctcgcccgtggagcggggcgtggtgagcatcttcggcgtggccagccggttcttcgt

SEQ ID NO: 5812 - DNA, 1721 bp, Homo sapiens; identical to SEQ ID NO: 5811
  source 1..1721: mol_type = unassigned DNA

SEQ ID NO: 5813 - DNA, 615 bp, Homo sapiens
  source 1..615: mol_type = unassigned DNA
cggagttccgggcacgcaccgccgagcgccttaccctgagccttcccggtacccgcagccccgacagctcagccttccccacctgaaagttccacctgaggtctccctcaactctgccctcctgcattcttggcgtcgcggggagtcaggggttaaaccccgtggcccgcgtggccccttccccctccgcagccccctcgcctccactcggcgccgcgcctggagcgtccgtcccggagacccgcacaagagaggaggggaaaaagtgggcctgtttctcgggtggccaatccaccgagcccgcggtgccccagaggaggcgccagcgctaggccagcgccaggccgggctgcctgcttcccgcggcaaagtacaaatgcgcccgagcgcggcgcctgaagcccttggcgagcacagccggcccgcgctcagcctccctccgcggccgccgcgccgccgccgctgctgggaccgccgccccgccgggccccaggcccccgcggcccgaccccgagcccaccgagcagggggcgccggccgcctctagcccgcgcgcccgcaacacccgctggtcccgcgcgcctcgcccggcgctgcgcgctcggcagacgccgg

SEQ ID NO: 5814 - DNA, 1542 bp, Homo sapiens
  source 1..1542: mol_type = unassigned DNA
cgggacggtcgccgcgcgctccctccctccgccccttgcttacaagacctaatgagctcccccgggaggcagcgcagcgagccaggcccggaactagtaggctgcgccgcgcgcgccgcgccggggcgggagctgggtctgggcggcgggcaggagctggcgggggcgcacgggcagcgctgcggacagcccgggagccgcggcgatggcggtgcaggcggcgctcctcagcacgcaccctttcgtgcccttcggcttcgggggctccccggacgggctagggggcgccttcggagccctggacaagggctgctgtttcgaggacgatgagaccggggctccggcgggtgcgctgctgtcgggagccgaaggaggggacgtgcgcgaggccacccgcgatctactcagcttcattgactcggcgtccagcaacatcaagctggcgctggacaagccgggcaagtcgaagcggaaggtgaaccaccgcaagtacctgcagaagcagatcaagcgctgcagcggcctcatgggcgccgcgccccccggcccgccctccccgagcgccgccgacacgccagccaaacggccgctggccgcccctagcgccccgacagtcgcggccccggcccacggcaaggctgccccccggcgggaggcgtcgcaggccgccgcggccgccagcttgcaaagccgaagtctggccgcgctcttcgactcgctgcgccacgtccccgggggtgccgagccggcggggggtgaggtggctgcgccggcggccgggctaggaggtgcgggcactgggggcgcgggaggggacgtggcaggccccgcgggggccacggcgatcccaggggccaggaaggtcccgctgcgggcacgcaatctgcctccgtccttcttcacggagccgtcccgggcaggcggcggcgggtgtggcccgtcggggccggacgtgagcttgggcgacctggagaagggcgcggaggccgtggagttctttgagctgctggggcccgactacggcgccggcacggaggcggcagtcttgcttgccgccgagcctctcgacgtgttccccgccggagcctccgtactgcggggacccccggagctggagcccggcctctttgagccgccgccggcagtggtgggaaacctactgtaccccgagccctggagcgtcccgggctgctccccgaccaaaaagagccccctgactgccccccgcggcggcttgaccttgaacgagcccttgagccccctgtaccccgccgctgcggattctcccggcggggaggacgggcggggccatttggcctctttcgcccccttctttccagactgcgccctgcccccgccgccgccgccccatcaggtgtcctacgattacagcgcgggctacagccgcaccgcctattccagcctttggagatccgacggggtttgggaaggggcgccgggggaggagggggcgcaccgggactgacttcgaggcacgcttcccttcattagagacggctgtggagagcgccgcgcctccgt

SEQ ID NO: 5815 - DNA, 1542 bp, Homo sapiens; identical to SEQ ID NO: 5814
  source 1..1542: mol_type = unassigned DNA

SEQ ID NO: 5816 - DNA, 1768 bp, Homo sapiens
  source 1..1768: mol_type = unassigned DNA
cgcgtctggagtgggctctcgacacccagggcaagtgggggcggcagagccctctcctcggtcggcacagcagcctctgccgcggtcccggcctgcgacgcgcccagtcttagcctcccggcctccggcgtctgctgagtgtccggcgggagaggcgcagggagcgcgctaccgggaggcgcgggcagcggggactggttttctctcgggccagggcctccggggcaaccgtctccagcgcgcattcttggtgcaggtggaacagctttctgctccggtagggcttcacctatcgcgggagaggttaatctcggatctaaacctcgcagccgcagagcgggctaaaaccgctactccacctcttcccatttctcccctccccacctcaagacaaaaagtcccaggccgggcaggacctgatcacctctgcctcctcccactgcgctaatcctgcgagcgagaggccccgcaccgaggcggaggctggcaaaggggagtggaaagggaggatggatggggccggggggtggggtggtgatgagggcgacgaaggagggggtgtcattttctttttctttctttttttaaaaaaagtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccagtgggtgcagccggggtcccgacgggggtcgggcggccaccggggctggagctgcggccacggaggcttttgcgtttgcgccgcgccgagggcagggacagggactggggtgaggggctgtcccggaacgtccacagctggcgctggccctcccctgcctgacagcttcctggcccggggctcttggtgccgggctccgcgtcagatgttcggggggcggtggcatcgcccggagtcggcggggacggcgcggctggcttccagcctggcggagagggcaggctgaggagtggggcgttcagagcgcgcatcgcgcgcaattcgtgccgctaaaaaaaataaacccagagagctcgcccggggcttaggaccgctggggatatgggtactttgcgccgcgctcttctggcggggcccgggaggccgagggatcggccggggctgctgccgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgc

SEQ ID NO: 5817 - DNA, 2656 bp, Homo sapiens
  source 1..2656: mol_type = unassigned DNA
cgcacaggaaccccagccgctcaagccccgggtgggcgcgtcgcacctccccaggcactgcccagacagctcgccccctccccctgggcgccctccctagtctggctggggccggggcgggttgggggaggttctcgcgggtttgtctgacacttgtaaatggaagtgggatccaacttggaaaacaaacgcgccagagtctgggggcggagaggagcgggaggaggggagaggggggaaaaagacttcaatcattaccgcggtcccagcgtccctccctcccgccgcggctgctgcaggttcgcccaaacccgaagctgagtcccattgggcgcgcggcggcggcgggatggagctggagctcccggccgaggcgctaggagtccaccagattccgcgtgccagagccaccggccgcccacgctccgggccgcaggcgccactccctcccgggagcccctcctagtccttcacggagacctcgcagggtctccgcagcctccccgcccccgacgtccattccggggacccctctccaccgcctggtttgagcccattattccagcgagctgcagcctcaggatgtcaccgccagcacacccacaccccgggagcacccctgttcctctcatcccgagcaacccaagcggctctcttagctcgcagccaaactccggccacccctgcatccttgccccaagcacgcccccgccaccccccgcccacaagaggagaacggtggaaagtgaataaaagttgctttccgcaaagcccaatcatgttcaatgttaaaccatctcggaaagcacatgtgacaaaagtcaacgagagaggagaggagggaattcagatcacagcacagctaaaaatatccgggctcgccatcatgcaagccggggggccagatgcactttagctcagcgactcccactggcggaatcctcgcgctcaccgcgcgccgcgccaagatggtccaggccacctctactgcctccccgccagcgcccctcagccccctacacttgccctgcacacacactggcctgtagaggggattcgtcccgaaccgcccgggagtggggcctgagctcggagctggtgcccctggcgttctcgcccccaatccggagacagctcctccgcactcctggggatggtcagacccgcgctgctttcttttcaaagacaagcagccttcccacacgcccgccaaaaatcatgcactctcgcaaagcattccggttccctctccttgtcaagatagcagggacagtctctgtccccaaccactccgtaaaggatgtcgtccccagtcgaagagccgccgccgccgttcactacatctcaccctgaccacaagccccgcaagcccgagtcaggcgtggggaacggacccgcagactggtaaccctttccctttcctagcgaaagtggaggctgggctccctctctgcgccgcgcctcgcctagcgatgacccaacttgcacctcggggtcccctaagtgcatcatccatcggcatctgaacatcccccactgcgcccgagaggcaccggctgccaagcaggctcgccacctgaaccttctcatccacctgcaggggcggctgggagccggggatgggtgcactgatccgcaacccccctcgcaacccctccccagatcctcagccccaaacttggccaactctccgtgtaaacctcccggctcccgccgcggggccaagccaccctcttctcctgtttgcagcggtagcaacggcggctcggggctgcgcggaggttggaactttacaaggtgaaaagtttcccccacgcgcttcgtcggctctcgcctccccagcccacctcgcagcccatttgcacccagcagctgaggctgtgctccggcaggcgcgctccagtcggtgcaccaggcagccaaatcatcacgctacaaatccccacgcacccttgcctccgctggcgatccacggctctacgaggcgcctcccccgtggtcttcttcacccggtgctcggcgctcttgctccgggcgagccggtcccccggctgctgccgccgcagcgcccaccgcgcgctagccgggactgaggccgcgagcagaagcgctctgcgctcgggacgccgccgccgccgccgccgggggttcgcaagcggaggaggggagccgagatgaagagaacagcagcgggaggagagggacgggaggcgcgagatcccaatccgcaggccagttcacagcgcagcctgcggggaggagcgccggctctcctgtctgctccgagctgcagccgccgccgctactgctcgccgcctggctgctccgggctccccatcacagccgacgccgacgcacggccaagcccctctccagtctccccctcgcgcttgtctctcgcagtctcctcctcccaaaccgcgagcgaaaagggcgagggggagaggagcctcggcggcggggatgactagcgatctaggagcgtggcgcaggggagagggggcgcgcgggagggggcggcggaggaggcgcggcgaactggagggcattcccggcgccgggcctggaagcggctaattttagagctcgagtcttccctcagccctctggggctctaggatgacaccaacgtactttcctgccgcggggagagcgt

SEQ ID NO: 5818 - DNA, 623 bp, Homo sapiens
  source 1..623: mol_type = unassigned DNA
cgacaccacgcgagtgtgtacgcgctggggactgagcccccgaagcgaagccctgtcggaggagtttcaggcgggagtgggaacggctgggcgtggggtcagcaacggcgccacccggtagggtggggggagccaggcttgtcagagccagagcgcgtcaccgtcgccgcgagagacgccgcgctgcccaataggcagaggcgctccctagcagcctggtgggagcagagatataaaagtgctccaacaaacccggagctggcgtgccgaccgcgggctggtggcgggcggcgcggtgctccgcgcgtccgggctccctggctcctcgggacggccttgtatgctgtgcgccccgcaccccggctgcgcgctccgatcccagcgggaggggacgcccggcccgcaggctcccaggggaggggtggctcctgcaaaatggtccctcacctcttgctgctctgtctcctccccttggtgcgagccaccgagccccacgagggccgggccgacgagcagagcgcggaggcggccctggccgtgcccaatgcctcgcacttcttctcttggaacaactacaccttctccgactggcagaactttgtgggcaggaggcgctacggcgc

SEQ ID NO: 5819 - DNA, 1967 bp, Homo sapiens
  source 1..1967: mol_type = unassigned DNA
cgatgatggaaaggaccgccaggcgatcccccaaaaggcccaccaaatatccgggctccattgtcacgctcccacccgggggcgaggatgtctcaaaaacaccccccttcccccgccccatgtggacaggtcgcgtcgcggcacccacgggcaccgcggaaaggggcataaccggggtggcccccgcccaggtggcagcggagacccagggccaggcggactaggcttggtccccacccctcctctccgggccctgccacggccccgccccgccgtcagtagagcccccggcccgcggtcggccggtcagcgcacgcgcgtaggtgtgcctgccaggatgccctccccggcgacgcgctcaggcccggattccgcggcgcgagagtgagcgctggcgggggcggtgggatgctccaagtcggcgtgaaagaggcgagagtgggcgagcacgggcggccggaccaggagcactcccggtgaccacctagtctccattttatttcctcggaaactgccgggcaggcgggggaccggccgcagggcggggtttctcttggcggtgagtgagcgagaccgttaggctgaagcaccgggagactgtcctggcagctcctggccgccacccgcgccgcaataaaagcctctcgcggcttcccgcccagccagcttcgcactgattggtcgccgtgggagggacccgagttggctggaggcggcggccgagcgctgctcttgtgccgcccgcggagggggcgcactgggtgctccctggcccgccccgtgcgctccccaaccgggggtcggccgtccagggcaggtacaacggtacctggagctgcgaccgcgacacacagcccctccgcccggctttcctcgatcgcttcccagcacacgccccccgcccagaatgtccgcccaacccacccagctctctgcggcccctgcttttcttccttccctcccgtccatcagagccaaagcgcaaatccttgggtggaggtggggggatgacagctggaggggagggtgggcacgcacagaagaattttccagggaggccgggatggaaatagccaaaatgaaatgcacctccctgcacactgccgaggttctctgggcggcggcgcaacccccgccacccgcggcagcatcactactgtcttcctcccagctccctattgttcacactttgccaggatcgggaacctcgcccaaagaaaggagacagggcgaggtgtttcgggcggctacctgccattcttctcccgccccgtgcaacactgggcacgcggcgcgtgtaaagacacacgcgcgcacacgcgcgcgcacacaccaggcagccccaatcacgccctcctcgccctccgcccctccgcacttcctcctgtcaaaacgcggcgctcgaccctcccatccttcagtgctcgcggccgagggtaggctttgcaactaaccagcaatttggcaaatgaaaaactaacgtcatgtcgactggggtgcaacaacggtcacaccaacaacaacggccgtgcgattctgcccattttgccccattttgcaaaccgttattcttctggggcgggggaagcaaagcagcgatcctgactttattagacccaggaatataacgatctggggcggctgccctagccttattgttcactcttcccggagccggggctgacaagccacttccccctcggaatccgagcccgtgcggcggcaccacccgagccgcgacctcccccgccccgccgcccgcctttggggaaggagcgctgcccatcaccagcgcggccgctgagtccccaggagccggccggctctgctcccaccgccgcgggcgcacaaagtgggaagggcggacgcgccggaggggcgccgggcgctggcggctcggggaggcagccccgtgcagcgcagccctggagggagcggggttcggctgggcagcaagggcgacgcgc

SEQ ID NO: 5820 - DNA, 2558 bp, Homo sapiens
  source 1..2558: mol_type = unassigned DNA
cgccccggggtggggacggaggccgtcaaggttgggatgagcattcagccgagccgagccaccgcgtgctttcccgcagacatcggggtttctgagaactaggagggaacagccaaaagaatggaagcttggcgccctgaaacaagccttttgggtcctgagggaaatctgggcgcccacgggcagccgtctcccccacccgccgctcggcgcccgcgatccggctggcgctggctgcagcgtccagccaggcggcgcggggaagagccggcgataacccgcccgagctccggggatcgaccgcgctctcacacccccccagttcccagcgacccccaccgagacttggagacgacttcagcaaacttggggaagcaacttttcccgaggagctagactcctgaaagaaggagagctgagctagggacgagggaaagcgaaagagacggggaggaacggcgacagtccgggcgggctggactccgcggcgagagcggcaggggaggcggacccgccccgcggcgaaggggaagcacaaaagccccgcagcgagttgtgggaggaaaggcgagaaggggtctgcccgccctccctctccgacccagggccgtgaccccctgggagcgaccggctgggtcccaggcctctggccagcggcgccagcggccagcgcgcccggcccaagcacggtgcgagcgtctcggggaggcggcgagcgagtcggtgcggagcgctccgtgcgtccgggtggttccgcgggccggcgggaccgtgcgcatttcaagcgcgtgcgggagtgtgcgaggcgctgtgcgagctagcggcgggcgcgccagggtgggaaaggcatcccgaacgcatcaggtgcagagaccggcacccaccgagagcggccgggagcgcacggcgagctccggtgtcaccgccggtcccgccgagagccgaggagggcccgcagcgctgcagaccctctggagcttccctccctcccctgcaaaaggggggtggggatcaagtccaatcaagaaaaagcccaccacgttttctcaaagagaaacaaaacgtaagcagtcccagtcctgctcccctccgcccccagatctactcgtcagctcctccgattctagcttcccagccggccggcgaataaacacacaaataaataaaccacaaccttatcttgcgcccgcgcaccggtccgcatacataagagcacccacgggctctgttgctccgccagcccctggcggtacaaagcctccggatccccgacccctctgctcacgccctcagcccccgcacaccgctacgccccccacctctcaccccgaccgtgccctgaagaggaagggctggggaggcagctgcgcccaggctgacagccggggctcccccttctagccgacccccaaccggtggcggcgacggctgcagcggcaggaagggaacacgccaaataaaaaaggcacaagcccagcggccgagtggccgaagcgagcgcgcgccccccagacctctccagccccgggaagccccggcgcgcggcgctcgctgggcggtgcgcctcttcccggcccctcactcaccgcagccgagccgggcactgtggggtgggtgtgcgtgcctgtcggggggtgtgtgcctgtgtcggggaggggtgttgctggggaactgttgctctccgtatcacggcggcagcgacagcatcgcccggcagttcgcagtacccgctctcatcgccctcaactcctctctgctgcgaggttagcaaatcaccaccggctgctgcgcctccgccgcgtcccacgtcaacgccgagccccctcccctgcaaggccccggcgcctctccatctttagtgctggcggccgagcccggctccctgcccacagctgccccccttccctcccccctcccgcgccgtccccgggctcagcccgcccaccaccccgcactggccgagcccgcgcgcgctccccgccccacccctcctttcccctcccctcccttcccctcccttccccgcgctccgcgctccgggcttcgcctgacatctagctgctgctggggcgccggcggccgcctctcaccggccgagcggagaggaaggaaggagccagaggacaggagtgcatggggactcagaatccttaataggggaactgagggtgaagggcgcgcagcagcccccacctactcccaagattttaatttgcactggatacgggttttgtccccccctccccgcaccccggtgctcaagcacgcagttttgtctcctcttccaatgtttgccccaattcagtgcgtgtcatctcgcctttaacttttttctcatggctcggggctgcagtccccctgacatctgttttaaaaggccgctttcctagcccaaacccggccctctcatcctcctggttactgcgcgcctcccggcttgagcatccggatttcaataagtctcccgaggcagagttcgcgggcgctagtgaaccaggtgccagaaggtccgcggggatctattgtcgaagcgagacacccgtttttagctgtcgcga

SEQ ID NO: 5821 - DNA, 2558 bp, Homo sapiens; identical to SEQ ID NO: 5820
  source 1..2558: mol_type = unassigned DNA

SEQ ID NO: 5822 - DNA, 1508 bp, Homo sapiens
  source 1..1508: mol_type = unassigned DNA
cgcctctcagacagcggagccgggtcggggcggtctggcccgggccgccgctcctgttcctgggcttgtggggctggggtccgtctgggctccgggctcgcgcggcgctcaccacccggggtgccgcgggggggcggggagagcggccgcctagcccagccccgcggatgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaaggtgagacctgcgcgggcggctgggcggcggaggcggcggggccagggtggcgcggctggcggcgaggcggggtgcccggcgggctccaggtgcgtgggggaaccgaccggggtgcaaggccccgggtggggcgcagcggggaggggcaggcaccctgacaggggccgagtgagagtcagcccccgaccgctccgccagccacccgcgtctgccgttttggggcgcgcccgtaggggtggtggcaaaggagcccctcatctccctgctccctgcacggcggcagttctgccctggacccctcccccagccccttgccctcttcctgcggcttggtggcactgggaccccggagtgccctccgagtcgaggggtcctcaggccgtgactcttgacctaggagtccttgcttattcaggcctcggactcggcggctgattcctccgctatgtccgtgcgtccctctcccgccgcggaccccagccctggcgcgaatgttggcgcaccgcatggcgcttatccgcgcattggctggaggcagggtggggatagtgagagtcccgagagctggaggtccctcggatagcaagtttgttctccaaacccagaggtcaccctcccccggccctaccccacccctctgccccggctttagccccggcttggtgcgccaccgtggccacctcgggcagcgcgccccaagatgcgagattctccgcttccgcgcctggccagttggacctggggacaagtcttcaggctggggggcgtgtccctcttcccggagagagggggttgctaggggtgggtccaggtgtccggcatgtccagacctgcggctggggcgctgcgtacctgatccgcgaggcagccgggatcgggaggttggaagagggcagacatttccgactgaagccacctgggcactgagtcgggaccaggcaggcgcaggtagtctgggttccaggctatcgcagaggacgtgcccccgggcgcgcagatggcgggagatgaggcggccgaactccgcgcccttgcgtggtggagcacacacgctccaacaagctcagcgtcacctgttcagccctctaacttttctccttctcgccccggggcgg

SEQ ID NO: 5823 - DNA, 1119 bp, Homo sapiens
  source 1..1119: mol_type = unassigned DNA
cggtggcgacatggcaggcagtcccgcgtggcggcggccgggacagctgggcgcgctggcaggagagcaggcacagcgctccccacaggcaggatgacgcgggctccgcagcccgtcctcccacgctgccccgcatcactgcctcggccctgacgtgcgtgcgacagactcaccgcaaacagtccccagcgggagcacgaggccgggacaggaggtgggcggctacacaggacaccccaccccccccacccccccgcagccggcggagccgatcgccggaaaagggaggcggtgggcgaaaggaaagcggggagctgggagaggagctgtaaacaaagagctgcccttgtgcgaagtcctgagccgggtccagtcagcccgcttcctgtggcccacgcactgcccgccggcccacgcgggagcctcgaggggcgaggcggaggctgggcgcagtccttgcagccagcagccacctccgcgcgctccgccgcggtccagctaattacctgctgcggcggcggccgtgccctttagggtgcattagtattcccgccgcgggcgctgccctcgcggcgtcggcaccgatgcccggccacctccaggcccgaacgactgcggctgcgggaaggcgggtcgaggggggctacggcaccccagggagaggccgggagccgcccggacctcggaggggatggggtcctctctgggaggcacccgtctccttcctgggtcctaagacccttcccagccctgcgctccgaccccactcctcccgaaacgtcggggaatcgggaaaggagggccacgggcaaagcgggggcgggcgccccctgattagcatgcggcgccggttgcccgggcccggattcccgagccccctccccgcgagcgcacactaataagtttacaaatggaatccggtggcgccgcttgcaataaaaggcagaagctgcgctccggcgcttcaatgagagcattttcccccgtaacaaggggctggattcagctgcctggtgccgtctgagcggggcgagttgccagagtaaccaaggcctagcgcgcacgtggggagagggagctggctggggctccagcgctagccgccgcctgcgcgcccgg

SEQ ID NO: 5824 - DNA, 1119 bp, Homo sapiens; identical to SEQ ID NO: 5823
  source 1..1119: mol_type = unassigned DNA

SEQ ID NO: 5825 - DNA, 653 bp, Homo sapiens
  source 1..653: mol_type = unassigned DNA
cggaagtaaggcgggccagccaccgcctcgagccaaagtttctgcagccctggcaatcccccgcgcgtttctgctcaggagccccacacctcagagaaacttcccggcgtccccagcctcgctgtctcccctaggctttgggacacagctttaagggactgagcggcccggacgggatctgaaacctttggaggaccagccacgtccgcacagcccgcccatgcgcgctggcaccaggacccgcaggctgccagcggcgagtccccgccgcggttcctcagggcacccccggagaagggggcggccctgaggaatctcctgcactccggatgccctattttccccgcccttagcgccccagggccctgctcgggtcctggccgcgcgtggtgttcttttcagccgcggagctttgtttcccagtgtcgctgaaaggaaagagaaagaaaacgccttcggtcctggaggtcctgccccttcctgaagcgatgccatttcctccctccatctctcttttcttagattcctcctggggccccggcagaggcggggcggctgcgccccgagtccctctccggcggcagcgcgggagcggggctggaaaagagggcgccgggagccgccccgcccctcatcgctcctggcttctccgc

SEQ ID NO: 5826 - DNA, 1768 bp, Homo sapiens; identical to SEQ ID NO: 5816
  source 1..1768: mol_type = unassigned DNA

SEQ ID NO: 5827 - DNA, 1101 bp, Homo sapiens
  source 1..1101: mol_type = unassigned DNA
cgctgcgaggatcaagggagatggaatgcagcgtaaagccccacgtaaacgtgtcgtgcaacatgaagcccctcaccctgagttggggagcgggtggcacgcgtggaagctgaatgccaccatccctgggaccaggcgcagcgccctccagaagcgcctctggtgacgggctcctgttctcccccaggacgtttcccccagaatgccccggggccctggacggctctggagaggacgggagggaagggaaggagacgggcggaacggggacgtacctgctttcactgcactccttccgctccctcaccctcagccacttgcggaggaggaagcgttttcggcgcggggacgcgctgggtgtggagcagttggaccacggggtgtcctcgtcgctggagggcgtgatctcgatggacggcagctgcaggaactccttgccgggggccaagacggcgggcaggtcccgggccagcccggcctccaggctctgctcctgtacgttcttcatgcggcgcatcttgaagcgccggcggcgaagcgtgggggtcgacgaactggaccagaccgggctgccctcgggcgcaccctgcggctcgggcacctgcagggcgggcagcggccggttctccatcatgttggccgccggcatgggggccgtcgcctctgcgctccccctgagccctccgccagcggcctggttcgcgtctccctctggctgttccccaccctcggccccgcggcacactccccaatcctggggccgaaggaacaagttcctttcccggagcgcagcgaggaagggacgcgaggggacgcggcgtagcgcgccgccgcccggagtctaacttttcggagcgcgcgtcctccgggccgtcagccgccggcgaggccacccgggaggggcgggagccgcctgccagccactcggcagccctcctggggctcccctcgcgcgcccgcttgtttttcttccgctgcgcttcctcgcttgctggcgtctttgccttagcgggactcggcagccaggggccccagggggcggtgcagcaaactctcagcggtttgcgttcagcagaccaggttggggagccggcttggcgc

SEQ ID NO: 5828 - DNA, 1101 bp, Homo sapiens; identical to SEQ ID NO: 5827
  source 1..1101: mol_type = unassigned DNA

SEQ ID NO: 5829 - DNA, 2341 bp, Homo sapiens
  source 1..2341: mol_type = unassigned DNA
cggcccctgcaacggaggcggctccgaaggacgcaggaccctttcggaggcgacagctccaggagccctggtcctggagccggcgcacgcctaggcgcgaagggcgggggctcggggcgctagggatctgtgcggacgggggctggggaaggttccccgccggagaggcggcgaggccggcccaggagtcccgcggagccggcggctctccagcgcctagagccgggcgactgagtgccgagaggaagggaaagcgctgacatgtaaacaggggcttccatctggaggagcccgctcagatagatcccccgacacactcacttgcacccctaccctcgtgcaacgaggccacttacccaccccagggcccaccaggcagggacccgagcccgggcgactgcagcccccgcccccgccgtgttccgcctctgcggagaggaagcccagtgcctagcgctggggccacgggagccccgggtgtcggtgggagtggtggaccccgaggtctctcgcccttgactccgttccgtaccctggggtcccccggtttcccgccgtcccctcctgcagccccggcgggcagcgaggtgggaggggggccggggctccactttgggggctgggatttcgggggagggtcgccctcaatgcgggcgcctggccggctggcccgcgagtaggactcgccacccgagcgccggaggagccggcgcgaagccggggcgcggagggaagggagagaggccacgtcttccgggacgcgggccccgcacctacccgcccgccgcttcgcctccccggccggtccccgccgcccgcgtccgttgccccgccgcttaccttaatagtcccgtccatttggccaagtctgcagccgagccccccaatattccacacattgacccggttacagcctgacctcgcagccccttcggattagcccggcgcggcctccctggcgccctgggccctccctgcgtgccccctgcgagcgccctgccctcactcccctgtgcacgtttgttgttgtagcggagcgaaagagacagttaaccggatgaaacttttttttcagctaattttgggaagtgacttcactttgcgaatcggggaggaagtcctatctctctctctctctctctctctctctctctctctctctctctctctctctcgcctcgagctctcctctctcttctctcccctctgctctccctcgtcttccctccccccccacaccccctcttcctcccctgctggtcctgcttttcgcatcacacactatataaatatacgcggagatgcccagacacattcatgcgctgcgcacacaggatacttgctcctgggagataagagctagccgggaacaatgacggggtccacgcccagcgtccgcgccctgattcccgaagtctgaacctccccccatcaccttcccccaaaatccaaagccaaagacctttggcttctttgcttttcctgaggcggttggccgaaggtggccctcctgactcattcactttccgtttcttcccacagatacgttcattaatgctttttccagccggagacaaactttttgggggtggggtagggggggtatggagggagagttggctagggctgcgggtaacccagcgcctactgccggggaagactcggacgaaaaccgaggcaaaccaaccattaaaaagtgcatccaataagaatttttccactcaggccctccgctgccgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacgttccctctaggacagtcagcaggtcccaggagcgcagcacgcaacagcgcagagcagacccagacttttcccggggtgagacccggaggcccgcgctctggaccgtcctccctacccagcctggaggccggcgttccccggcccaacccggagacctccccgcctccctcctgggccgccgcgcgccccagttggagcagcctcgaggggctgggccctttcggccggactcccttctcccggacatccaaaacaggttaccttgtccacgctctccggaccacgc

SEQ ID NO: 5830 - DNA, 3857 bp, Homo sapiens
  source 1..3857: mol_type = unassigned DNA
cgagcagaaaccatcgtgtttctgggggctcttcgggcgccgtggggcgacgcggtgcagcgtctagggccgccgcaggccgggggcagggctcccagcggttcccccgcggccagcggccacgcaggaaaaacccgcttcctcgcccctgcatctgctgacaagccgcccgaggtgtctgcgctgagcgtggccacaccgatgcagctttctaggaaatggcccgggagggggagggggcgagtgagggattaggtccggctccccctcgctccccctgcgcaaacaccaccaccccttcctttccccggaggcatgaggcctccacgctcggtccttcgcccgcatcctcgccgacccctccggtttcgcgcctcactcgccaggctttctccctgggagccgactgcggtgaagtcgccgccagcacggtcggccctgacacgtgctctaacgcatgcttgagtcaaggctgtctttacaggagatacgatctggtggcgtttcttcacctccttcctcccgtcaccccccacccccaccgcgccctttggtgtatttcactccaggaggaaggggagagaccagcgccctgatgtgctggccaagctggcacgtgcagcgggcatggcgtggctcgagctctctgggcacaccgaggccgactgagtgcctccctcaccgagagagggggcccgggcaggggcgcggagagccagcaaggcggggtggggcgcgggctgggtgagccgtacactaggttccctgcaaggcggaggaggggagcgaataaactagaggtgcaagcgattaactcaggccccggagccagcctctttaaacgagggtggggcggaaggggtggtgggggggaaaggaggggatatcgctttaaaagggtgaggaagagtttggggcgccgtctcccctccctctatttgcatagccaatagctctggggctcctgctactgcgcgctgattgttaccgggcagattactttttttttttttttttttttttttttttagtaggacgcgttccccactacatcaaaaggaagccaagggagggcggagggagagcgggcgctggggcgggcgaaagctggggagaggcccggccgcctccgaccttatcaatagcagcgggaatgagtatcccatctcctatatgtaaagaaaggggagggaaggggcgggcgaggaaaatgtctaattgctgtggaagccattagctttcaggaagaaaaaaagctcgctgaaaaacccaagttgcaaactcaaaatgaaacagtccagcgccgcggatgacacccgggccgaataccgtgtacacccgcacacagtcggccccgaacaatcacctattggttttagtcacgttgggcttcccgacttaagcttttgagtcaccccggataaggacattcacttacattttaagacccccataagggaattactccaatttcacctaagccacctttgagcggatcaaagaaagttgcagcggggagaggcgagagaaggagggagggcgggaggtatttttaaagtataaatctaacccgacaggcaagggacagaggccgccggggctcccagcctctggacatcacttgatatagctctgcgagcaaggtctcttccaccccgactccgcacacccccccttctccggggaaaggcatccagagctctgggtctcccgaagtgggggcagcgggggcgaggaagaagcgggtggtcgtcccggggcccagcccaccccgaggagaatgcctgggtggcgagtcctcacgtctcgggagtgagccgagggccctctcgccccttccctctccccctccccctactccgtcttgctttacagagaaattccagcggggaggggggcagcgaatgggaggggcagagagggtcgcggccggatgcccccccttcccggcgccctctgcattcatggagacccgcaagttcgggcgcttcccgcgtggcaggctcgcctcttgaagttcccctgtccacttccccttccgattactgactgttcccgagcgtgaagctcgccatcgaatccaatccccggtggttttgcagactctcacacgtggggtggggcgtgagagggtgcggaggttggcaggaatgtctctaggaggcttggactggaaactgagttttcccttttggtcgccactccagccatgtgttaaaaccctaatgtcttgttaaaatgcactccacctagcacgcgggaaaacgcatgttgccttctaggcaaaagtgcacactttctttcagtgtagacttcggtttcaagaaaaagcgcaagagcctgtgctctggctttgaagtccaaactgatcaccgtggcgcgggggtggggggcggcgggagggggtagattgttggttcttccttatctccttttcacccttcacggaaaaaaaaatacatatatatatatcccatgtaggactggtgataaactttagcgaacgccagttttattggacttttattctttttccggccggctccccaccctctacgctagcgttttggagtttcggttggaaagtgtacaaagcctggaggtggagggtgcagcagggtgttgggtgtttataggcacttttctgcaggagcctgcagcactaagcacacatactcccaagcttacctggaggatgcctcccagccaggtgattccgcggtcggctcaaggcccgggagcagcgcgagttcgagtcccgccttctccgcgcaggggcgcctaggccaggtggggagcgggtagtgactgagttcaggctcagaaatgggagccactgccttcccctcggctcccccaaagagtggagctgtgtttgtgtttctccgtggagggatggacggtcaatcaaaaccgaaaacccgactggcaaaatgcgaggggacacataaatccgaggggacacataggaggcacatcaagaggaaggagggagtgcaggcaaagtagaaaaatgcggacaaggagaagaggaaaacgtcgggaagcggagagcacgggggagcagggtgggtggggacgggcagtgcgattgcaggtgttcactcgcttccgggaccctctggtcgcagccgcgcccgccggggcgctgggccgctgcgttctggaggggggcagagtccgccaggcctgtgcatccgcactcccttcggcgaatttcggcttggacggggctggattactgaggcggcagatgcgacaggcgtgagttaagaaggcgagcgcctgccgtctgtcacccacctagcatctcactcccctcccttcggaaaaaaaaaaaattaaaagacccgaacttccccctcttcctgtctgattcagcttaggacacgcctcacgcggccgaaaatagctctggaaatacatttgctttacaaaagtgaattttccaataagctttggggcggggggcgtccggcggtcggcgtcggggggtcctgcctcccgggaggagaaggaaccggccgcctccgcccttctccccctccaggcgcccccgggagggggccgctgggcggcggaatcgcgcctccgctcggggagccaccacgcggctttttcgcggaattttgacgtcatccacacgtgggggaaggggctgggagagcaagaggaagcggcgggggagggggccgcggctgggagagcgcggcggcggcgcggcgggtctggcaccctcgcggtgggcgcagcgccgggcagggtccgggccctgggcagcgcggcagaggaggccgtgccgcggaccccggagccagcgccgcgacccgcctccctccccgccccccgcccctcgc

SEQ ID NO: 5831 - DNA, 1439 bp, Homo sapiens
  source 1..1439: mol_type = unassigned DNA
cgcgggttcctccgccaagcgggacgccgcgccgggcgggtgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggtgggtgtgggggttccagactgcgcacctgctaaaccctcctgggtcccccgggaggggtccgccagatgtgccccttcccagccccattcgggggagaaggatgggggcgggggcgtgggggtgagcacagccggacaccgcaagtgggaacctggggtgtccttccccgcagctcccgggcagccgcgcgccgcgaaccccggtccacctgcaagcaaggcgggccgggggcagagggcgccgggctgtgcgggggaaccggcccgcgtcccgggattggggggcggtggaagagagagcgagcgggcatgcgcagtggggcggaggaggtggcgatggccgggggaggcggggggactgctgtttatttgcagctgggccaactccgcggcgcaggcggcggcggagcgcggggagctcgcggcgggtccagctgccgcagcaccatgcccgagcccccctccgggcagacgccgcgcgccgccggggccccggtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagtgagtccctcacctcgcgctagccgccgctgcctcctctaccctccgcccgtccctcggaccgggagaagttgcgggactgacttgggggcatttcatttttgccgccctttccctccacgcctccctcctctccaggatgtgcatggcactttgctccgggatccactgcccggctaatctgggctctcggggcggttcgggaggcgccggctggggagttgggatcgagtttctcaactgtctgccctctcagcgggcttctctctcgaggcagggctgggagcgggctggtgaaaccgcctccgcaccccttcgcctgccggatcgtgaccaagtgggactagcgcggacccagagggttccggaggggtggcggtggtggcga

SEQ ID NO: 5832 - DNA, 1288 bp, Homo sapiens
  source 1..1288: mol_type = unassigned DNA
cggagagggctcctcgggccaactctgggcaacgatgagcatccccggcctcggcaggggcgccgggccgcccgccctccctccctccctccctcgcgagtcccttcttcagaggacgcggggagccgggtctgcgcgctccgccgcctgtcacctagcgcccgcgccgggctgcgattggacgcgtcgccgccaggcacccgccagaaacaccagtgcgctggggagaggaggggggcgtgcttgcgagtcgagggcttgctttggcttttttacggctcccccctcccctcagcactccatgccgggtctctagttccagcgcgcctcggctcgctcgcgcggcgggagagttggcgcaaacctcgcggcagccgcagcctcctcgcgcgcctctccttcccctacgccctccgctcccgccatggggccaacgtggggctcctaagagttgccggctctcagcggcgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacaggtaaccgggagggctccgctcgcgtcctcgcgctccgctgggaccccgcgcgctaggctgcaagctccggggttctgcgcctcccgcgccgctcccgcggcatatttggggcgccacgctttcctacctcgctccttccttcgctcagctcctgacgacttcgagggtggggcgtttgggttttgtttcctcctgtccacctgccgggcttctcccattctctggtccgcttcccgcctcccggcgccgtctcccgctcccagcctcgccgcgcctctccgcgttctcccacgcctcccatctccctcccggagtggagaagtgagtgcgggcggtgacggcgccgggacggctcgcggcttggctgcttgtgggggcggctcacctgtgggactagggctgctctcgctcgttccaccggccgctggtcccggccttgttgatgggggccaggcgggacggacaagccatgcttggacgcagaactcccttgcagaggtggctgccttggcctccgaggtaacccgcggctgcaacctgtcgg

SEQ ID NO: 5833 - DNA, 1006 bp, Homo sapiens
  source 1..1006: mol_type = unassigned DNA
cgagtccgggtctccacgctttatttggcagggggcgcgcgggttccggagctgtccagcacctcctggccaagttctctgcgctctccgcgcccgggaagctctccgcgccggggaagctctccagcgccccgcccccggcagggaacctctccaccaggacacccggggcttcccaggctcgccatccgtccccaccagtctctacctactttgcccagctccacctcggcagtgcagcgtgttttggtggccttcctccgcacgccctggagggggagtgccctgcaccccggggctgctccggagcccagtgcacgagtgcacatgggcttccctcctttgcttaaagggcaggcgagcgctactcgctccagccttgcctcctgcagctgggtggtcttttttctctcctgtctttcaagacacgcgcccgaaatcgaggggtgagagcaaagaccgcccatcaacttagcaccttggatttagagctttcaatcccgaaaggaggttggcattgcccgggtcatcgagagagggagggagaagagctgaggctgcaacggctcctgggctccctagaccgggtttggcatccaggagaccgtgcgggagaccgacgctgagcgccggcctcgccctcggcggcccctccctcctccttaccccgcctcccccggcccgcccctccctccccggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgc

SEQ ID NO: 5834 - DNA, 1185 bp, Homo sapiens
  source 1..1185: mol_type = unassigned DNA
cggagagccagggttcgcccaacaggagtacgcggagacaccccagacgacagcgcgtcccccccacccccaccccgccctccgggcgctccaggccagcgtccaccagaccccacgcctgggggactgcttgggctctagcgagagtgccacggctctgcacggcagcggggaggtggcgagcgcgcccgattcacgtcgcctccacgcccacctcctcccactacgagtcccctccccttgccacagcactacccttattgttggccgcgtctgtcactttgtggggctggtgacatgaatggatgggctggacacaccttccgtccgtccagaaaaaaacaaaaaacaaaaaaaaaacccgtccagatctgcatagagagggggaaagactcccccctgcgctcccagagcctacgctgtcggccagagaaactcacagcttccccctcccacactcactcctcccatcccttaaaaaaacgcccaacgcaaataaataatatcgttccaagtccgccgccgtcccgggtggcctttcctccctgcctggctccgcgcgctccagccctgcgggaggcggcggcgagaagctgcggctctgggtgcggtgcggggcgcccgggcgacaggcgggcgcaaggcgggcgcgcagcagaccggttggcgccgcactatgctccccagcgcggtcgcagcccacgccggtgcgtactgggacgttgtggcttcctccgcgctcctcaacctccccgctgcgcccggctttggcaacctgggcaagagtttcctgatcgagaatttgctgcgggtcgggggcgccccaacgcccaggctgcagccgcccgcgccccacgacccggcgaccgccctggccaccgcgggcgcgcagctccggcccctgcctgctagcccagttcccctaaagctgtgccccgcagccgaacaagttagccccgccggggcgccctacggaacgcggtgggcttttcaagtgctcagtccctctgcggacagtgcgaggctgccgggccgggctccgggggaccgagactgtaccttccagccttcagcgccaggtgagccagctctcccctccctccccagccgcgcccgcgcccccaggccgggtggtccagggatctgggagcgccggcggtgcgcactgcgcccagggagagccgg

SEQ ID NO: 5835 - DNA, 409 bp, Homo sapiens
  source 1..409: mol_type = unassigned DNA
cggctctggtttcacgcgggcagcgtcagctggtcggtgtcacggagttcccgcgtcctccgcccgctcagcccccgcggacccatccactggggttgctccgcagcgcgactctctctcatcccgggggagggctaagggcggcggtggggggcggggtgggggggaagcggcgggagggggcggtgcgccgccgccttaccccgggctcgcgaatccgcagcgtcctccgcagcatcttcccaggcccggccctctcctccccccgcgccgatggtacgcgccggctcgcctggcccggctgcagtggatgttgctagaacccacgcggaggaaggaagagacgcaggcaggctgcggttacccaagcggccacccgggcctcagggaccccttccccgagagacgg

SEQ ID NO: 5836 - DNA, 1813 bp, Homo sapiens
  source 1..1813: mol_type = unassigned DNA
cggggtcgctgcgtcttcctgaccactgacggccaggacggccccagccccgctttacctgcaagccccactccaggctcgagcccccgagggcagggatagcttcccgggtcccgaggcttgaccagagcctgaaagctcctgccgggggttgctccgactcagcgaggcgccaggctgcccggcgcggctgggggcgctcagcgccgggaccccagccctgccccggccgcccgctggcccagtgcgcacgctccggcagctcagctccccctcccacggcggcaggagagctcccggcatctgcccggggcgggggcgggggcggggcggggcgggcgccgcgccctcctgcctgactggcaggaagacagaccaatcggaggggctccccggggggaggggcggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggtgggtacaggtgcgccggggggcgggaggcgagcgctggccagagggaacccgtggacccggcgaccgaggggcggacctggcggcaagggacgcggcgaccggtgccgccccgccccatcgtccatctccccctcctccggccatcgcgccccctctgggtcccccttccactctcgcatcccacctcagtggtcccccacccttccatacccatcccccactcctcttcagacccccttgcaaaatctcccagccgctgcgtcgcttcccccaacaccccctcccggtcccgcccccagcccccagctctccttcacgccacccctatttccactcttctccggattccgccctcaagccaaggagcgggagggggacccacccggtgcctgccggagtggcgcggggggtgtggccggcccgtcccctccgtgtcttccgcagggtaggtcacagtcccccagatctccgcccaggtggcaaagaagatggagctgggggccgcgccccggcggcgcggggcccgaaggcgaggccgcccagcccgcaccccaccccacgcacggcacacgccgccgcggcccctgccacgcacaccctcgcgctgctccgcccacgtgggcgccggggaggaggctcgagagatgggaagaaaggctggcacccaccctcctgccgggccggcgcgccctgggcgcactggcctccggagatggcgcgcaaggattgactctcgtggtgccagacaccttgccgggcgccctgcgtcggggccagcggcctcgctggcctgcgtcagtgcgctgcggcctcgcctcccagcccctcggtccttcgctccatcccccctgctgtgggctcctgagcatccggcctgggcagcccagatagaggccgcttacgaggctggcgcttcttttcgccttagaagcatcccgctcccacacaccccagctcgccggtctcctgaaggctgggccagcctcggctctccgccagcctctgcccggctctctgagctccagcgatactgtatctaaccgccagccctcctccgccgcccgc

SEQ ID NO: 5837 - DNA, 1294 bp, Homo sapiens
  source 1..1294: mol_type = unassigned DNA
cggctggagaagctctcgctagcgctgcctgtggccagacccgcctcttgtcccctttcgggcgcacacacacgtccacccagacactccgcgcgctccctcgcgcttttgcttgcccgcccgccgccgcctgctttttccctcctgctttcgccggtcgccttctccttctttttttttttttttttttttttttttttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtaggaggctggagaggggctggggagggggcggcgggagcccgggcgcggagcggggggcggccgggagcgggcgcccggggcgcggggtccggcggccgcgcgcgagcctgcggcggcgccccgagcccggaggacccccctcccctcccccctccgccccccagaaatgttgcaaacttttgcagcccgttctcggcttgcgggagcagagtggggcgggggaggcggcgggaaggttgacagccggcgggctcacccccctggctttgatttttctgcaaacactggaggaaagctgcgttgcctcaattaaatacgctcccccaaaatacggagatgcggggagtgggggcccgggaaagaaacttttaaagcggcagtgtccttttaagaaggggcaaaaaaatctgtttatggccaccctccttccgctttaccttttctcctcttgacagtttcggccctggctgcccgagtcgggggtgtgttttcggtccctctcagatctgggcggggggcgggaggagtgagcgacctgggaagtcccgggggtggagagggggcgctccggggtctgggggcgacgtggacaccttctttggagcacggcggtgcgtttgggatttgaaggaagggccgaaggaagcggggtgcgggcgggcgagctgttcgccaagttgtctggcgggcgcggcgaggggagatgcgcaagtttgcagaccgggggttcggagcccggcgcccaggctggcggggggcgtgtgcgcgccaacgcgcagagggcggcggtcctgtggggcgctccacgcgcatccggagggagcgt

SEQ ID NO: 5838 - DNA, 939 bp, Homo sapiens
  source 1..939: mol_type = unassigned DNA
cgccgcaaggttatgggccgaagtggtgcaggggcggcgcccggggaagcgactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcccgtccggggctgtacatggggctgcgcgcaaggtgaggactgcgcatgtgggcttggggcctgcgcgcaccggaggctgcaggcgctggggagggtgtggggggctgtgcgtggggctgccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgg

SEQ ID NO: 5839 - DNA, 939 bp, Homo sapiens; identical to SEQ ID NO: 5838
  source 1..939: mol_type = unassigned DNA

SEQ ID NO: 5840 - DNA, 899 bp, Homo sapiens
  source 1..899: mol_type = unassigned DNA
cggcctctgagggcccgggcagccacccgcacttccccgccacgcggagaaagccgagcacacaggccgcagggtgggggtccgcggggagagggtggaagcagcgggttctccgcgcctggggtggccgctgccccacccaggcccccgtctgccctctacccttccagaccaatcgctccctgcaggtgccaacgcggtgccccgcaccaggtggcacgcggactttccccagagctccccggcctagacggagtcaggctaaggcagaagcgcgggcagccccggcgctactttacagcgccccatctgcagccctggggtcctcacccggctccagggtgcacagcagccggggcgcggtccgggaaatgcagctgcgcttcttgagcacattgctcaggatggtgcccacgccgccgccctgccgcttcaggcatctccccccgcgcctcagagacccggtcagcttgtcctgccgcatccgagagcgccccgggctctggcacggctaccgtccgtctcggtccccgctaccccactcgctgagcggctgagctcgcggagctgggtgagtgtctgcggctgaccggcccgtgggagcagggagcgcacagccggctggtgctggagggtcacggggacttacggggcaccgcgggagccgccgagcgcagggaagccagcaggcatctgcagtgcggagcctgcaaggctgaggcaggagatcgctcgaggcggggagggcgggagcgagcgagcgagcgagcgcgtgggagacggaggcggcgtgcccgcccccaatcccggcaccgccgtgcgcaggcggggccgccccagctcccccgtgcccagaagcgccagagacagggagccagtgggcgcgtaactgcgttcgg

SEQ ID NO: 5841 - DNA, 899 bp, Homo sapiens; identical to SEQ ID NO: 5840
  source 1..899: mol_type = unassigned DNA

SEQ ID NO: 5842 - DNA, 547 bp, Homo sapiens
  source 1..547: mol_type = unassigned DNA
cggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgt

SEQ ID NO: 5843 - DNA, 2505 bp, Homo sapiens
  source 1..2505: mol_type = unassigned DNA
cgccccgccccgcaccgggggcggaacctcgcgctcccggacctgggacagcaccagcagcgtgaaatacgcgcacccgagtgcaggagcaaacaggcaacctcttgttctggctacctccagcccggccgcctcctcagcggcttgggacagcagcgcgtggctgggaagacgcgggagggggacgcgaggcaaacttgcgccaagagttggccaggttaggtgagagggagtggcacccgcgcagacacttaccgctggcgttcttcccgcagatcaggtgctggtagggctgcaggagaccccagatctccgagtcgttgttgaccgtgtgctccagggtctccacggtgaacttgggcgcctcgtggagcgcatggtggtggtgatggtggtggttggcggcggctgccggcgggactgcggcggccgcggcggccggcggggcgcaacagctgctgcccccgctggcgctgctggctgcgctgcaggcgccgccgctcgccgctcctcccccgggcgcctcccgctctttatccgccgcgggggccgcaccagggcccgagctcgggcctgggccggagcccgagcctgacccagggccactgcagctccggggcaccccggaggccacgacccgcgagtagatgtcccggaagaggctctccatgcaggctgtcaggtagatggcggcgtgctcgtggatgcgcagcgccacgcggctgtccaccatccagcgatacacgcggcccacggagaaggtgaggccgcagcgggccgacttgccgcggcccaggcggtcgccgccggcgctgctcatgttgtagagggacagtgcggccagcgcagccgccgtacagtgcgcggccaggccccaggacagcacgatctccatggcgctctggatctcgtacttggtgcacttggcgaagcgcaggctcaggcgctgcgcctctttggctatgcgcaccagcgcccggctcaccagcgtcgacagcttggccagcgcgtccttgggcaggccgccggggaccgccgggcctgcccggggatcccgcgaacgcagcagcagcgcctccagctcctggagagtccaggggacctcgtctaggtccggcagcagccgcgagcagtgctggccggcgcagtccagcccctcggagtcttccaccagggcagtgttgacagtgtcaaagctgttgtgccggctgtgcatggagtcagctagaggcggccagcagctcccgccatacggggacgccgggtgcgagtcggaacagcacaaagacaagttggaggagcgcaccgagtccgccgcgccaccataacccgagtccagcgtcagatcctccagcgttctcaccacgggcttcttacctctcctggccatcgctgcgccacttcatgctgcagccgcctgggagccaaagggaaggagcggcgaggagcagcgagtgccgcggggcgcggggagagccgagtccgcgccgccttggctcacttttccactagccgctgctaccaactgttagtactttcggctgcctcccggaactgccgccgctggaatatacagagcagaccctggagtcatcttccagagtccgggccggagctgggcgcaatggggagcgagccaggccgggaaggaagctcccgccggggcttgcccctttcttccaaaataaaaagtgtctagaccgctcttccctgagccccgctgggcgcagtagccaccgggcgccggccacggtgttcgtgggactgagaccaccccagatgccgccgccgccgcagctccgcgggcagctggctcccggctcccggctcccagttcccggccctggttcgctcggcgccagcctgccctgcaccggagcgcagcagcggccgtggcggctgcaaaccttgccgaaccccagcaaaccccgggcagccagtgggacgggcgtatgcaaagcaggggcggcggagagccagtggaatcggagaatgctaattacctcgctttttttttttttttttaaatccctcctccccatgcggccccgcccctcacacacgcccccggcggacaccgaggctgcaggaagtggggagcagtggccagggacttggggaacccttgcaagcgtagagacgtggatgctgccccctgctgctgtccctgcccgcattctcccggagggtggtgggttgggccggtgacctccccacctaggtgtgctctccaccgcggttcacaaggtgtctgcctgacggtcgctctctcccctgcggttcgcatttcacttttttccccccgtaacacctgaaacatggttttcctccctctctattcccacttcgggtacgcaaaccaattagtgcggccctctttcagccggggtttgctccagcatggagggaaataagcctgtcgagcggaggcccgtggcggtggacaccactgggaggccggatctccggccattcgccacctgccactagggcgcgttaactcga

SEQ ID NO: 5844 - DNA, 1587 bp, Homo sapiens
  source 1..1587: mol_type = unassigned DNA
cgaggagtggggcgttcggaaggacggggactgggaagcggccaggacggggagaaggcgcgggtgctggaaccacttatcagaagaaacttaacgagatttgccggcggattaaaaaaaaaaaaaaaagtgggtccctttttatctccagactgatgatctcgcgtcttccgcgaatgtcacggtcaaggcaggatgctctaaccgccctgttatccgcaccattttcccgcccctgatccccgccgcacccgccgagactttgcgagactccaaggctggggggccttgccaggcgcgtccggggcactccgggaaagaacagaggccggagccgcgcctccacggtgcgttctctgagattccacctcccagccccggctcctacggggtccgcagagaacacctccaaatctaggggaggcacacagactcccacaaagggaggatggggagaaagtgatggggtttcgaagagtcgccctagggaaggagagagaaagagcagggaagagaggaaagaaacagaagaaaagcagagacgggagagaggagacgaggggagcagcggggagaaacgcaggaggcagaacaagcaaggaaatctctcatttaaaagttcccttgggcccgagggctgggagtcacctgctctgcgccgctcccggctctccaccgccctggaggcaggagcgcaaacttgcgagcgcccgggcccacctccaccgcccgtctgcatctagacttgggaaggggatggaaggggcgggggggtaaaggcaagaagcaagacgaaccccaagaccccggcccgaggagaagaggtctgccggcgcttgcggccagtccggcggcggcggctctggcggcggcggcggcggcccccgggtggcggcgcgtccgggctgcgcagccaggcgggcggcgaaggctgaggtgccggcgagcggcggggcgcggagccgcctcctcgccaaccccggctccctcctcctctctcctcctcctcctcctctcctcctcctcctccctgcccgccagctccctccctccctcgccggagccccagccgggtgcggactggcaagcggcgcgctccgcggcctccccgggcgccgcgaagttgggaggcgcgcaaagtgcggctcaggggggaccgccgggggttcccgccagcagccccctgcccgaggccgtagcccctgccttccccgctcctcgcccggccgcctggccgctcggccgctccgccgaccgagggctcactagcgcttctccatggtcgcggcagctaatcgatgactgaaccgaacaaagagcagcggcgagatcaattcctaatacctatcgatgggcagcgggcggccgagccccggcgagccccggcagccgccgcccgccgccccagggcgtccgcctgcccgcccggggacctccccaatgcgcccagggcgcgcccgggggctcctcacggccgcgcggccggcgctgcccgcactaacctggagtcgccgtagatcaaatcgcttccaatattgaaacatcgatcccacattggcggccatcttgggggctatcgagacgcgc

SEQ ID NO: 5845 - DNA, 5693 bp, Homo sapiens
  source 1..5693: mol_type = unassigned DNA
cgcgcggagagggcttaagagcgcccctccaaaggcccagccccgcctggagagagtgggcgggcaccgggtccctgggggaggggctgtcgcaggtttgggagggaatccagcggggctggccgtagcctgggcaggccgtagcttgggccggcgggaacccgccactggactgaagaggcgtctggccgtcgctgacgccgctgtccccttcccgatccgtccgcccgcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgcggcccggggcgggcacagctccttagccccgctggcctgggagccgggagcctcggaggagtctcccgccaagcttccttggctacgagcgcgcctggttctggtctgggagcagaccgtgcgcccgagtggggcacttgcccgaggtcggggactgtgaaccgaaagattccatctagccctgctgtcctcctggtattgcgatttgggggcgggtcactttacctctctgaattccgccccccgccttgcttatggaaggttgtaagcctctctggggtccgggatccctctttacctccacctttcgagcagagaaacaggcgatgccccctccctccctgcgccgaagcgcgggcagacaaacggccagaggctggctccggagccgaggggccgaggcgagagccgtgccgggagggaggcctttatagagccgtcaggccgcgggcgagccggggaccaggaagcccaagtctttatgagtcgccccacgggtccgcgaaatccttcacccttggctggttcgccgaagcctctctccacccctcccggcctaatccggcccggccccgcctcgggggagtcctggtgcggaagaggcgcaaggacccagcaggggcagcccagtcagggaagggagaagagggggggagaggacactcctgatcctgggttcacagccccctcctctgtcccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggaggtaaggggcgccccgggattcgctgttccgcacctgtcctattccgggagctgagggcgaagggtcccggccagcacgctttccgccgctccagaacatcgcccactcgctggacacacgatcacagacacatgtacactcacccacatgtcctggacacaaaatcagatacatggtctcacccatacagtgatgcacacagaagcacacacgagatacagtgacacattcacccacgcagggcacaaggtgcactcacacttgcgttcagagactccagggacacacgtctagacacgatcgcacgatcacgtataggtaaattccaccctctcacacacaggtacactcacggagacacaactccacagacgcgcacactcccaccagtcacactgaggccagtactggcaaatccacatgcatgcggcccccacggacagacgcacagccttcctgccgccctgtgcctggtgtacttggcatgaggtggattccgagcgctggagggtagtgtgaggggaggggatgggggtctggattcattccaagccgcctgctcactagcatcgaaggcagcaactcctgttccatgtggcggggtgtgtgcgcacagcatctggcagtgttagcccaaatgccggcagttgctctgggcaggactgtagtccaccctccagccccgagacccctggggttcctacagactgggggcacaagtgttgggccaaccccagatttccaccgtctttggggctgcagagagcgaggagccccagtttacaaagggcttcagatggtggtaccaggcttgggcctggggtgagctgtccccttgccacctcagcttttcctcctctcacttccctcacactggattggtgagccatcccaactccccctatccgattttttcagctccttaccctgagccgcattgcttgagctcaccaagctcactgtcctgttcttcccagggctgagggctcaagaaagcacctctcctcttctattctgaagcttctgaatttggagagaccccaggactgtctatgtctgagaggcatctgcacttctgagttgtaacgcaggttaggaagaggcaatttctcttagaaagtgggttcagtggcagtgttagcaaggcaggagctaggcacccaggtagacgcagaagggaagggaagataaccccatcactaacctcagcacatccggaagcctgaggggggattagaccttgagaccggaccggggcccctagaaattgtgggcaaaatgccaggctgtgcttttcagggcagagaccccaggcagtggcagggctcaggctggagcgccccagccgcccaaccctggacagccccccaaccctggacagacccccaaccccggacagacccccaaccctggagagcccggatggtgggcgtgtcttccggagtctccactcaccgactctctccacctaaatttgcctctttccctacaaaatctgggcccggagcagcgaggtagtgggggcggtaccggcccggaatttttccccgcctggataattaaccaaggtttccccgaggaccacttcgcccccgccccgacctatcccaccgcctcctctccctgcgcgctggatgaggtggggagctggatactgggggcccctcgttccccgtaatggtggggaagactccccagcccccagcgaggcagccccgcctaatccgcgctgggagatcccggcggtggcgaccggcagcgggcgagaaaggggccgggcggcggggccggcggctccccgtgggagcgcggacaaagccccagctgcggcttttgtgcccttttcagacggcgtttgttccaattacctccggcccggccgccatatgggcggaggcggcgcgcacggcgcgggggcagcggccttcgctggttttccggctcgccgcgggccgcggccgtctcccatccctgtccctttggggctccaaatttgccgctccccatcttccccttcactttcggggagaattaaattaatggttttaaaaagtaattggcaaccgttttagctgttgcttaaactgcctccaagccacgcctccagacaccccccatttggacagatttcagggtttggagagggaagagggtggcagggggcatcaggaattcgccccttgactgagatcccaggactcagcagggggagtggatttgcagaagagactcaggcttctggactcgctggttttcccgccgtacaaagcgggtgcctggtacaaggtggtcctttcgtgacgtcccccacgtcagtccttcagggccccacctggtgggggaaggcaggatatcccgaaggttctggaaaaggggctatgtggggcggtcagagagttgatacagatttgttgaggcagaatgggtttgcaatccggagtccctacacctcctgaatttatgggcaaaattctcatccttgcattttccttgagagagagcccatagctatcaccagcttctcaaaagatctcaatgtcctcagatgcttcagaacctgggggtgctggcaaaaccaacccggggcaaggctggaggaccgagcttctaccccaaggagcccgcggagctctggccatgacccagagaatcttcgtgtcctcctccccctctcccaagtcgctggagctcagttttctctttctcaggctaggctaggccggtacaaatggtctcaccgggatcgacgcggcggccgtacttggcgaggcgaaggacttggactgggttggtagggcgcagggaccgagtttagggcgccaaggccgccccgcccggcccaacccaccagtcgctcctgccgcggcccggatccagtttcccccggccaggtcgcttcccggtctcaaccatttcgcgctctgctctgtccgctggtttgtccctgcccggttcctctccccgggcctgtcagcctccgcttctctggaggttcctgggactcatctctgatccaccgtcttgcgttctctgggcgcatcgacttctctccatcttcgggctcactcctgactccctcgctgccgcccccgggggtttccacgcgtgtctctaaccgcggccgtctttcctctctctgcgtctcctcgactcctccgcgaccctccgatgtctcgggctttcgggtctcagccgcggactccgcgtctctgggtctcttttccgcctttctctctgcccctctgccgatctctccgtctgtctctcgctgtcccgcatctctgtgtctctcaccgaccctaagacacttaggaatcattgtctgtctctgcgtctctggccgcctctgtctctctccatctctaggtgtcagggaacctgtgactgaagtctccgagtttttgccgcgtgtgtcccccacggtctcggagtctctcccgtctctgtgtgtggtctctggcagtctgagtctcttgccctttcgagatctctcattgtctctctccccaaccctccccgtgagcctgcgacgtccaccgtctcaaggggcgccggcctccgcaggtctctctaaccttgggtcggtgtcgcgcgctcccctctctcgcccgcccgggtcccctccccgggtcccgggtcccccgcctacttcgccttctctcaccgcgccctgtctccttcccgctccccctccgcagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcga

SEQ ID NO: 5846 - DNA, 589 bp, Homo sapiens
  source 1..589: mol_type = unassigned DNA
cgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgaggtaaccgtcccggcagatggcccgggaggctcaggagggagctcgtcggccgagtcggctggggcggcgggaatggcggattccagcccggctttgcattctgcagagcacagcttgcagagattttgcgcggctcggagctccccggcaaatggagtctgggaggccgccgcggctggcggagcggcattgaggtttgcagaagcacggcctggttctgtcaaaccgcatcttgttcgcctccgccagcccagagctccccgggaccctggcgagggcgcggggtaggattctccccgcggccggcagtgaatgggagcgcgtgtaggggcgccagccctgctttcttttgttgtgagtaggcagcggggctccagtcgccgcctccctgaagccccgagaacgaggcga

SEQ ID NO: 5847 - DNA, 1294 bp, Homo sapiens; identical to SEQ ID NO: 5837
  source 1..1294: mol_type = unassigned DNA

SEQ ID NO: 5848 - DNA, 1373 bp, Homo sapiens
  source 1..1373: mol_type = unassigned DNA
cgaccctcgctgagctcacggctcagtccctacatatttatgccgcgtttccagccgctgggtgaggagctacttagcgccgcggctcctccgaggggcggccgggcagcgagcagcggccgagcggacggggtgagccaggggcgcgcgcggggcgcccagcactgcgccggggaagcccgcagcctccgtcccgaacttgggttcgctgaggctgagggaggggacgcaaggggagggaagaagagaagggaggagtgggggctaggggagagggggtggggagggatcttggaggcacaaagcggaggggaaggggagggacgcgcgcggctcctaccaggaggcgagtgggtgcaaccggcgccctccagccgcgcggggcggcggactcggaggattcagaacccggagcgcggcggccgcgggcgcccgggaggaagaggaggagtacgaggcgggcgggcgggtgcgcagcgcgaagaggcagcctcggcgctgcccggctcggcgtcaggtgagttcctgatccaggcgtcccgcgccccttctccgtccccagggctccccgctcccgcccgagcccctggtgtgcgcggaaggctcgggctttgctgcgcgtcccaacttggttcgggcggcctcattttcctcctagcgggcggcctcaggccgggggctccggtccgggggtctacgcgcccaggctccaactttgcaagaccctagtcgttcctcagccgcgcgcttggctccgagctgtgcgctggcggtaatggcggagcccttggcacagctcgctaccctcccgcgggcagcccgggctgggggatgccagtccctggggaccgttgtacctgcccaagctcaactttacgccttcctcggtgcccgactctgcggccgaatcgcaactgcgagccgcaggtaatggcggagtctttggcactgccagctgtccgcggctgggggcccgaggctgggagggctccgctcccggaacatcgctccggcctggcctccaactttgcgaggagcctccttgcgctctcctcccgcggtcatggcggggccgcccgcacctctcacttcttccgtctgggcgagattggggtgtaagagcgccgtctccaaaacctgggaaagttgtgcttctcccgcaaaggaggctctagggaggccgaggggcgcgttccgccacggttcggggctgggcagtggaaggagcgctcgatgaggttgcttccaggtggccagggttcggagcagggtccccgggggatccaacttccagggccactcaggggccttgcgtccgaggtcccggaaggggctctctcgggactgcgccccagaggacgccagacgctcgc

SEQ ID NO: 5849 - DNA, 1524 bp, Homo sapiens
  source 1..1524: mol_type = unassigned DNA
cggggaaaggcgtggaggggggctgagcgggctcggggttcgcccggaatctggggggctgaggggccgggcgctgggcggtggagggaggaggcagggggatgcggggagtggtgggggagtctccttaggaagtgagtgtgcgcgcgcgcttgtggggagatgaggcagctgctggtgcgttttggggtctccgatccgagctttgtggcgggccgtctgcctctcccccttccaagccccgattctcctccccccacctcctcttcttgcactggcgggcgggcggcgggggcggctggggtctcagcccttccatttcagctttccagcttccccggtagctcgggggcggctccagctttagaaatgccgccggcccccggttccggcttcccggctctgccgccgcggccgctggggctgctgttaccgccgagccgggcgccgcagcggctcctcctggggcctacatttgccccgccagcccgtgtccggagcccccttcgcgggttacataaccaggctcccggccgagtgggcgaagcccagcacatttcgggggcggggggcaggggagggtccccagatgtcccttcagtgcttccgaagacaccggaggggagtaccccgcgtagagcgcagctggaccctcggggtgcgggcccctctccttgtcctgcttttcagcatctttggcaattgcgcaaagttgcttgggttgcaatggtggggtgcagggggcgctcggctgctgcacctgttagtgctgggcccaggttgagaggcgacctccagcccccacaataatgtcccgggctctctggtttgggtcctcgcagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaaggtgaggcgcccccaccccgggccgccctctgcgctgcgggccgagcgcacgtggggagggagctgccggtggctgggttcgtatttcgcgcccgcgtcccccattccaggggatccggtgacgaaacgaggccgagcactgggggggtggggtggggtggtgagggaggagggcaggcagtaaggggggccgggcatgggcctaggcccggcccgcgcccaccaccagccccagggtgggcagagccagggggccggcggacagagggacctggagatggacaggcggaccgagggagggcgggagcgccgcgtcctccccctccccgagccggtcgcgctccctgcgctgcctgaggtgccgccgcctggctggaactgggttcagggcgcccctggggcatcggggtaaggccccccaggcccgaagccttcccaatcccgttcccgcttggggcctgccagtgaggaactggtgatgggggcgcgtcgggtgtttgggacgatgcccccttaggcctggggtccgcagagccgc

SEQ ID NO: 5850 - DNA, 1009 bp, Homo sapiens
  source 1..1009: mol_type = unassigned DNA
cgaagtggcgggccgtggctattctctttacctgctgtacttcttggagtcccggggcgcaaacagccgctgcatttcccttcattcccgacgggatgacaccacagtcttctccccagacagcgcgggcctctgctccgtccttcctcagcgaccgcagcgacgactctgctccagggcgggggagcagcttcccaagccgcgggcgcccacttccccgcccggactccgggcggtgctggccggggcgcgcggggaggcggggaccagggaccccccaggaactagcctgggctgctgcaccgctgccagggccgtcctgcgcctagccgagcccagggcgccgccggctggacgcccgtcaactcccactgcgcccggcccccgagcgcgcccggctggatccggcgcgcccctccgccccaggcgccgccaagtcccagcactatgcgcccctccagatgtccgaaagcgcctctccagggcagcctatgtccctctgtgtccttcccgcgacgggccgggcccaccactccacacctcccgggtccttccatgtccatcaccgtgtgcctctccagcatcccccctcccctccaagttccaacatagcactccttcacatattccccgcgtcgcttcagaggttcctccagccactgccccgcccctccacttttccagtttctccagttctatcgaggcgcgcccctccagcacgtccccacccctccactccctccccgcgtccctgcactccctccccgcacccctgcactcccactccgagcccctctgtgaccaaacaccgcgcctttccaagcgctcctccttcgcgccgccccaagattcccctccataccctgcactccttccgcacccacccacgcacccctgcgcgcctccacccggcggcctctccaccctcagactcgcccccgcgatccagcgcgcggggcactgggcagggacatttctcgctcccacgcgagtccttcgctgcagacgc

SEQ ID NO: 5851 - DNA, 961 bp, Homo sapiens
  source 1..961: mol_type = unassigned DNA
cgtcgccgctgtgagcgcgcgaggacccggggctccaagtggtgagaatcactcgagggacccttcggatgcctttttccccctctgcttttgagctctgcagcacagcggtgccggccgccggcagggaaggctgcatcttctctgcgccgccaaaccgtgcccaccatcgcggtgactgccgcctaggtcgcatccctgagccgcatccgcgcgtaggggcgcacgggcacgcgcacagggaggccgcacacacacacacacatctgtacagggacgagccgggggtctctgacgcccgccgctcacctcgccccggcctggagccttttggccccgcaggtgcagcgacgcccagcccccgtgcggccagcgcgccgcgtcggcggatcctgcagcccagagagcccagggagcccagggaggggagcggggcgcgggcggggcagtgtcgcataaccgcaggcgcgccccgcgccgcccccgccccgggcccaccctccctcgccgcgcccctcccagctcacccacggacgagcggatcctcgacctccgcggcagggacatcttaagagctttgtccaggcctgcgccgttcagcatctcgcccgtgtcgggggctcggcggccccgggcgagagacggaggctacgcgcagggctgggcgcaggggccgccgcccgaggaccatgggtgggccagcgcctcgccgggctgctagctggcggggaccgccggcgcctgtgccgggccgcgcccgaggctgcgccgtccgtgccgcagcggccaatgcggcagcatccgcgaacgccaccgcggcgggccccgctggcccgggctgcggcgtgggggcgggggaccggccctgagcggagccccgcgggaggaggagcggacgggaggctgggagggatccgcaatattacgcaggaccggggcttttaggtgtcggggaaggcga

SEQ ID NO: 5852 - DNA, 961 bp, Homo sapiens; identical to SEQ ID NO: 5851
  source 1..961: mol_type = unassigned DNA

SEQ ID NO: 5853 - DNA, 980 bp, Homo sapiens
  source 1..980: mol_type = unassigned DNA
cgctcccctgccccgcccggtgcaagcccggggccgccggctggggtggggcgcgcagcgcggcaggcaggcagggctaccatgcagttctcagcctcctggctccttcgcccctcgccccgcgcccctgggccgccctcgcctgcccgcaccctagagcagccctgacccgtgggggcgcgcggcctcgcggggatcccgcgggcgggcgggcggccgggcgcgcgcggggcgggggcggcgcgcgcgcggggagcgtgtgggccgggcgggcgcggcggggaaagctgggcgcgcgagccgaggctgctgctcacctgcagccgcgccgctcacctgccgcggagtgcgcgccccgcgccctcccggcccgctccggagcccggccgccccccccttgccacagcgggcaactgcgccgacatgcgacacgagtagcccacgcgcttcggaagcaccggaggagccccctcggcctgggcgagccaaggtgaccccctcgatgacccccccgcccccgcgggccgcctgtccccgcaccctgtctgtccccctcgcgtccgactcccgtccccgccgccagggaatcggcagcagtgcatgggcatctgtctgtctgtctgtctcggtacttccattgcacacacctccctctcgtggccctcccgactgccccgtgcgcacggggggagtctggagcccctctttgttccggtcgggggtgcgtttgaggatgtgcacgcgcgcgggggatgcgtttggagggtgggagttcgatggaaataggcgatttaaatattccatcgaggatggcggcccctggctcgagacctgccgctgccgcgtggttttctcggcagcagcccagatgtcaaacagttgttcgttttcagcatgcaagatgtgattttccaatgtgcattcccagcgctgttgcaaacagaccgccgcgagtccgtgtgtgcctgcctcgctcacgc

SEQ ID NO: 5854 - DNA, 408 bp, Homo sapiens
  source 1..408: mol_type = unassigned DNA
cgcggcgcctcttccgaaacacctgagcataagcagccgcaagggcgagcgcaggacgcggggcgtggacgccgggctgggaagagccccgaccaaacccgcgggtggctctgactctccccttcgggaggagctctgcgcagaggccgtggctcgcgcgggcaagtcacctgtggcagcctggcagggcagttctctccggcaaatagcgacatgctctcggtttctgtcggccttggcctggcagagccgctttccgctttctggcctctggtgcgcccgaggcgggagaggagccccggccgcgtggaccctagcttgcgcggcaatcatcgcgccttgactctaggcccggctgctcagggaaggacagcccagggcgcgcccagcgagcttcagggggtacgg

SEQ ID NO: 5855 - DNA, 2190 bp, Homo sapiens
  source 1..2190: mol_type = unassigned DNA
cgggtgcatcaatgcggccgaaaaagacacggacacgctcccctgggacctgagctggttcgcagtcttcccaaaggtgccaagcaagcgtcagttcccctcaggcgctccaggttcagtgccttgtgccgagggtctccggtgccttcctagacttctcgggacagtctgaaggggtcaggagcggcgggacagcgcgggaagagcaggcaaggggagacagccggactgcgcctcagtcctccgtgccaagaacaccgtcgcggaggcgcggccagcttcccttggatcggactttccgcccctagggccaggcggcggagcttcagccttgtcccttccccagtttcgggcggcccccagagctgagtaagccgggtggagggagtctgcaaggatttcctgagcgcgatgggcaggaggaggggcaagggcaagagggcgcggagcaaagaccctgaacctgccggggccgcgctcccgggcccgcgtcgccagcacctccccacgcgcgctcggccccgggccacccgccctcgtcggcccccgcccctctccgtagccgcagggaagcgagcctgggaggaagaagagggtaggtggggaggcggatgaggggtgggggaccccttgacgtcaccagaaggaggtgccggggtaggaagtgggctggggaaaggttataaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggtgaggcgcggctgggggccggggcctgaggcgggctgcgatggggcggccggagggcagagcctccgaggccagggcggggtgcacgcggggagacgaggctgtagcccggagaagctggctacggcgagaacctgggacactagttgcagcgggcacgcttggggccgctgcgccctttctccgagggagcgcctcgaggagtggctggcctggacccgcgagcatcagcgctcagaccgggtccgcgctggggctgtccgtttgcgacaggatcgctgatcccttatccagctgtcgggttggggtctcactgccgaggccctgggcactaggagcagcacgcaccgggacctgcctggcacccagagcccattcccagaggacctggggcaggtacgcagggtcccccggagccgggagcagaggctcctgaaagcctgccaggctgcccggggctgggctgaggccgggactttggtgatattgggcactggccgcgacctcgcgtcacgagagtgtaggaggggagccgatttggaggggactcgtgcctgcgggggagcaggaggatctcaggagagggccagcgccggcatcccatgacccgcttgagtccccaagccggactgtcccggggaacgctcggcgagcgcccgctcctccccgccgctctcggaccgcggggccccagtgcgctgcgctcagccacccgggtggggcctctgccgggagcaggcgtggtgcgcggtccagtccgtgtcgcggacatcagtgaccctgacccacaagggcagcccagggcccaaataccgttaacttactgacttacaagcctagcctttaaaatccgagcgaagagagggcgggcgattttgaccaaacgatgtggtttgaggaatcgatgaggtccgcccgccacctaagtcagccttcgctgggcgtttgggagacgggcggtggaacagtcaggggccgggggttttaccagcagttagaccgccgccattgaggggtcaaagccccgaggaacttgagggttcggactcgcagtctctgctcagtggggctgagtggcggagatttgtgcctcgttcccctgggcgcagagagccagatttcggagcgc

SEQ ID NO: 5856 - DNA, 2190 bp, Homo sapiens; identical to SEQ ID NO: 5855
  source 1..2190: mol_type = unassigned DNA

SEQ ID NO: 5857 - DNA, 679 bp, Homo sapiens
  source 1..679: mol_type = unassigned DNA
cgccggcccaggctccgtgcggcaattcttcggttctgttgtttacttcgccccaccgccccccacctcctagtttttgttcagcccggggaagccgcgccgcagcgcctcagatgttatttatcttttcctgcgaggggcttgtgacagtccagggtgttgtgtatcctgtgcgattgtttatcgcccggcccatgcggtggcctgagcagcctcgcgccggcacttcacgtaccgaaccccgggactacgtgagccggcggagggcggggaggtggcgctcgggcgccggcgtgaacccgcgtcccccggagcccagcgccgtgtcctcaggccccggccctgacctcagggcgctcaggtggaatggccccgcagctgcgcgctgctcccgcgcccccgccttgccccgcggaaatcgcccccgacagtcaacccgaccgggcgcgcggcgcccccggccggtccccgcccgaccccgcgcagggcacagatcggggcgcacgcgttactcgtatccggtcacccgcgggtcaggccggccgagcggctgggctcagggggtactcctacgtgcgcagccgccacccggcctggccgcccagacgcccccgggggttcgcgccggccagcccagcccgagcctggcgccgcgctgcggccgctgctctccactcgg

SEQ ID NO: 5858 - DNA, 2013 bp, Homo sapiens
  source 1..2013: mol_type = unassigned DNA
cgccacgcagtccagggcgctcagcctacaccgccgcacacccattgtcggcccagaggcttggccgctgagcgccccctggatggcgtggtctgaccgtccttctccttgactcacctccagccccgagggccgggctccacggcggcggagagggcgtcgcccgcacggccccggctgtgccaccgccccggactgttcccgcgcagcgaggtcccttccccggggcccccgggtggggccggtcgagccgggtgcgctatccctttaagcccgggcgagatgagagctgtcagcggcagccgaggctagcgcgggacgtcgccaccctagcgccaggccggagctagcagccgcggagccgcggagagcggagggggcggcggggccgggcgtggcgggtcccctcgccgcccactgcgcgctcgaaccctgggccccgcgagcggcgggcggcacccgctgtaatgcggagaatgtgagaggcagcgcagggcggtggggaggaaggggcgcgggagagggcggcggcgagacagacggagagcagcggggagaacgaggaccgggctgggcaggtgggacaaggcagggaggcgccggagaggccggactggaagggggggagaagggcggcggcgccgcggagggggccggcgcttcccgcgggagtgcgagaagcccgagtcggcacctgggcccaggttcgggctgggagcgcggccgcggcccggccaggcagggtgcgggagccgggccgcccgcggggtccctacggggagcagcggggcacctaaggccggcgggtcccggaggggcccagggccgcgctccgcaggctccggccgtcccggcagggggtctttgtgagcgctccaggagggcgagtcgggagtgcggagccgggtgtgcgcgcctgggtgtgcgcgtgtgtgcgcgagtgtgggcgccgggcagtgggggcgcgcggtagagattctgccggcatcgcatcgtggcgagcaggaggcaggagcgggacgcgcaggggagccgggaccctcccgcgcacacgcacatgcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacggtgagtgtggccgggccgggacgctgcagcggggccagggccgcaggggcgcaggccggggagccggtgtgtctgcccgccggcggcgcggcgcgcgcggcctctgattgggcgggagcctcgggggcagcggcgggggtggggtgctgggtgcgcgtccgtggggggcgtgcacgcttggggctgggagggggcgtgctcggcagcccaggccgcggccccgcctcacccttacctgcagctgcagccccgacgacttgcagcaagtttgtggagcccctggggcgcggcgggccgggaggggtggggacggaggcgctttgagggtgcaactccggccttcctttccagagaagagaacgcgaggggagtggggcgggggcgcgggccgggccgtctggcgggcggaggggtgcgcctccagctcctcagtcgcgcagccgcccgctctctgggacacccacctaggcccgcggcgccgcgctggagccgctccgggcgccagactactatgaccccgctagggtcaggcaggaccgcgcggggacagctcccaggcccagggcctgggatgtctttgcaggcaggaggaagacaccaaggttcagttgggggagtgcggcgacgtgcccgggcgtgtatgtgtgtgtccccgcgccttctgctcctcaggacggtggctggaagaagggaacttgccgcaaggcgcgccccacccgacctggaccctcaggagctcccaagaggccgggggcgtctccaggtctgccgg

SEQ ID NO: 5859 - DNA, 1501 bp, Homo sapiens
  source 1..1501: mol_type = unassigned DNA
cgtggccctccgcctggcccctcgcactcaccaggaggaggttgtgcgccaccaggtacccgagccgcgggctgccccggatgccgggggccaggcgcccggtggcgtagccgtgccaggccaccacgtaggggttgtcgatggtgatccagtacttgacctgaccgccgaagtggcggaagcagagctccgcgtaatccctgaagtggtcggccagggcgcggttggcccagccgccgtaggcgtcctgcaggcgctggggcaggtcccagtggtacagggtgaccacgggctgcacgcccagctcccgcagccgctccagcaggcgccggtagtagcgcagcccctcgcggttggggacgcccgcgctgccattggggagcactcgcgcccacgagatggagaagcggtagtgagtgaccccgagctcgcgcagcgcctccgtgtcgcggaagacgttgttgtagctgtcgctggctacgtccccggtggcgggctgcagcggcgacggggcgcccaacggcagactggcgttccgggagtctcccgggggtgccagggggtggtgggtgaacgtatcccagatggacgcacccttgccgtgctgctgccagccgccctcggtctggtaggcggcgctgcccacggcccagaggaagccgtcggggaaggtgccctggaagaggcccgcggcctcgggggcaggaggccgcgagaaacgggcccaggtctgcgcgccgtcgcccggctccgcacgcaggcggcggccgcccaggcccagcagcaccagcagcagcgacagcgacggcggcggcggccgcgggcggcgcggcggggcgctggcgggcatgctgcgcgggagccaggctccggggccccgcgccgcgcccctttatgcccgcgccccgccgcgcccgcccgcccaccgccggcgcgcccacccccgctccccggcgggctccgctggcaataattacctgcgagccgggactgcctccgccctggcactgggggcgggggcaggggcgccgagggcgaggggtgcccgggaggggcgcggcagcgggcaaggtgcggcaggcgtcgcccgcggacgtcggagaaaggcacctgtttctcccagctcccgggagccgtgcaggacgtttcgtggacgctcaggttcattctctttgcctgccgcgcgtcctctgagagcagccctggagcggcttcgtcggggagaaaaggcgccgaccaactttccccgacttgggggcgggatcctgccgggccctagcggagcgcgccgctggggaagcacctgctctcacttttctcccactcggaggcccaaagaagctccggctggacattgctggagccaattagggactggccgaaatcctagagggactgccaggtgggacagccgagggggaacttcgccgtgcgctgaaagggattcccccttaggtgagatgctcgcggggagacgcgcccacccgcgcccctctttcga

SEQ ID NO: 5860 - DNA, 668 bp, Homo sapiens
  source 1..668: mol_type = unassigned DNA
cgaggttgctgcggtgggaagagggcgctgggagggaggaggacctggggcgcagccgtggtgggtgcgccctgccaagaagggcgggggcgacggggcgcgcacgcggaggaggaggaggaggagggagacgggagggcgtgtgagcgagtgagacaagaaaagggagcgcgcccgccgccgccgccgccgccgccctcctctggagagagaggctggagtgaggctgtgcgaagcgccgcatttcaatgaggacgggccgaggcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtgcgtggtttgccttccctggggacgggagctgcggggagggcggccgggggactccgcagagcccgctccgcccgcagccgcggggcgccgagggcagggcgggcgctcagcttggccccgccgccccgcccgcagttcctcgaaaggcggccgccctgccctggccagcctggcccgacccgggggcgttgcgtgcgggcggccccgg

SEQ ID NO: 5861 - DNA, 1006 bp, Homo sapiens
  source 1..1006: mol_type = unassigned DNA
cgccacagccgcagagcccccatcccgagcccgcgcctctctggtcgcgccgtgtcattctgcccacccattgggcgacctgggcacgagcaccgcgacctcccgctccgcgcagccctccagcaccgtggccccagcacacctgcagagcagccaggcgcaggaaccgaaacccgccgggtggtgggcgggaagggaaaggtagatgcccaagtgaaggcgctcatcttttttcctacgtgaacagaagttgattcttaacttcaagtgagaaatgacagggagaaaaagtatgcaatcactaccagaaaaggtgagaggccagtgttgtttcccagcgaagggacggggtgagattcaaacccatcgtccggccaggggagtccgcccccagagcaccgagaagctggggtgcgtgggcggagagagagcagggtgcgcccgacagccctgcgccaggttgtccccaaactcaacacttcctctctcccttctggagtcactttcccttccggaatatgcaagctctgggtggcccagccctgccgccagactcagtttccaagtgcgggggaaggagatgggcgctctcagccgcgatcccctgggaaggtggccactcacctgcgctctgaaatagaagaacagggcgacgctgcagacaacctggcccagccccagccccaggagggccacgaacatggagcgggaggcggcagggggctggtgcggcgcaggcggcggcggggcgtgcagggggccctcgtgcggggctccggggccgccgcccatctcctccgagccacgcaggtacttggtgtagtctctgctggcgcggcgcatggcgctcggccctctcgcttcggagctctcctccctctcccgctccctccccttcttgtctgcggccaactccggaggctgcggcggagcctcgacgtggggcgccgacttggagcccggctttgggtcctggggcgcgcgggcgagcgggcagggcgcccgg

SEQ ID NO: 5862 - DNA, 867 bp, Homo sapiens
  source 1..867: mol_type = unassigned DNA
cggaagcaaagttcgcagtgaggtgggctggaagcgggttttgcagcagccgcgagtccgggctcaggtttccaggcgcggctggagcagaagtgcagggaccgccacgatccaccgccgcggccggtcccgctccgctagaggagacttcgcacgcgcagccgactggcccgggctgaccgaggggacccagacgctgccactttctctttccaaggcagtttccgtggctctgcatgtaggaagtgctccgattaattttctttccggtctccgcagagattccaaattctgcggtccccacctttcgctgtactccctctccgcccttctttccaatgtccctgccagcaaaagcctctatttgcagcaccgggcatgttgtccgtttaacgcgctccggggatctgctggctcgtgctcccaacccaggggtggctatacgtctcgcgcctctgttcctgggtagactcccccatctgtgcattttggccccttcacttagcaaagagatgtgcgaagtgtgcgcctggagacgagccgcctcggtgacccccatccgcccgcagcggtggccctggttccccggatccgcgcccgcgccctgcgggtctcccgcgccgcccttgcccgccggaccacccgggctcagagggtcgctcgctttcagcgcctgcgagcgccgcttccgcccgggcctggggagcgccagcgcgtccctcccacgccggaccctgcagagcatgctcagtgcacctcatggaacccggctctcctggggccaggatcagatttccgggttttcgctgctgccgagggggcgcggaggaggggaggctgggagacagtcagcgccttgttccgcgc

SEQ ID NO: 5863 - DNA, 1072 bp, Homo sapiens
  source 1..1072: mol_type = unassigned DNA
cgcggagaagactgcctggccccgccggccccgccaacgtgacggtcagccccgccgagcgctcgcacccgctcacactcatgatcactcgcacactcgctccaatacgtgttaaggcgcgatcgcggggtccctggcagccttcgctgcaccctcccccccacaggggtactcacagttgccatctgcatagggggcaactttctccgacccagctgtggccgccgccccctccagcctcctctggctcctcgcaccctccggcctgggttcgcgccggccggccctcccctcccccctcggctctcctcctcgccgtcttcaccacattcccccctggtcagtggcgcacgccgggggacgagccagagggagcgggtcgcgggggtgtgcatgcatctcccgccttcttcttgcagcgcacactgtacatggtagtgagggggcgagcaaaggtggcaccggcccctcggctgctccagcgaaggcggcggctgcagctcctgcgctgtcctccgccccccagcgcagcggcgaccaccgcgctgggatcccgccgacgctgtctccgcgccgagcccgccgccgccgcggcccctaattagtatttgagaggctcttgcatccctttggcagtttcatcctcacggtgtttgcagggtttttttctgtatcccttccccagatgcggcgcacaatcgtcattagttggaactctctatcaccgacatcctttggggtttctgggggaaggggggggcgggcagcaaccgcgtcgttctatgcctgtggcttgtcctggcagcccggtggctctaaaaaaaactccgagaaagttgcgtcttcctcccgggcgccgaggaggtggcaacgcggtaagcaacaccgggtctctgagacagctgctccggagcgggtgcagggcccagtccagtgcacttgtttattgtcgcgcctctggtgcgagccaagctgcagcagacatgatgggcccggggcgaagcgggcgctcggtggccgatagatggcagccgagggcgaaggcgtccctgggctagggcggcgcaaccgg

SEQ ID NO: 5864 - DNA, 1633 bp, Homo sapiens
  source 1..1633: mol_type = unassigned DNA
cgacacgtttcattcacagagccccagagaagctcggattcggttggagctaagagccggaaaacaagcacccagactgccgcgcaagttgtcggagaccaagtgctacacacactggcgccgagagaaagggtgggcgctctcaagctcttggtggagcaatgccagtggccgggcatgcgggggacacggggcccccgaacccggacccgaatccccagctgagccacccgctaaagttggctgttcgctggcagacgaggccggctccagaccgggtggcagggtgtccccgggccctgagtggccaacagcaactggggaagcactgaggaaccctaacgggaaagcccgccccacatctgaaacaggcagcccgtgaagtccccaaaccagccttgaaacgccggcgtccagaggccaggtccccggcgagggtccctcccagccttgcccgcccccggcccgagcgccgggcgctctgtcgcccgaaggacggataggggagagaggggctgggggagccctccgcgtctctccaccgcccctgccggcgcaagggcgggagtggagaaggcgccactcagactgtggcgctgggcaaactgcggtcgcagttcttccaagtttgcccgaaccagaacgcggagtgagcgcccggctcggctctccgtctgcgccttgcagccgccccggagtgacccgggctccctggccagccgggcctgagccatcaactaaggggtagaagggcgcgagagcagcgggaggcgggagccagggtgctcccgcgtgtgcacacaatgaggcggcggagacgcacaccttcccccgccgaagaagccgcaggagcatccgccgcccaacacggagacgcggagtcccatagcggtggcagaaagtgagcaccaactcagcaacagggggaaggaaggggacgccgggcggccagtgggacgtgcggcagccgagggctgcagcctgcccctgcagcgcgcccgcgcttacctgcgatctcctggtaggggatgtccgccaggctgaatcccttggcaccgtacgcctggcggacctctccgcagctccgagccttcacatccgccccggcggggagggagagcagcagccccaagaggggaagaatcacagccccgatccaagaaggcatggtgcaacatacaaatccagctcggtaaaccccacggccggtgcgctcttcaccttgcccctcaagccgaaagcccgccagaggcagcggcgcgctcctcgccgctgcccagcgtcacccccttctgccagccgaggggacgagcagcgcagccctctggactgcgctcagcaaacttttataagccagatggacgatggcaagccaacaagggctggctgggaaggctgctgccttgctcctctagcccccagatggaaacggtgcaatcaaaacgaggaagagaaggaaaagaagtgtttaaaaaaccaccatgggggttcagagctgcaatccgagttccgagccgcagaatcctggagcgctgcgggctcggctcgccggagtgtgcggcaaaggtgggagcgcgcgccggctcccccgggagggagatggacaagcgagagcgagtgtgtatgcgcgcgt

SEQ ID NO: 5865 - DNA, 1143 bp, Homo sapiens
  source 1..1143: mol_type = unassigned DNA
cggtaccgtgcacagtctgacctcacgctcgcacgctgggctcccggcctcctggcagtgcacttaagtgtaccccgcgtgtgcccggcggactcccgtgcacaccgccgccgtgctgttgagtacgaaagacccccgagaggagctcgcagatgagagcctagctgttgctgtgagactgactgcgggtggcagccggcaagaaggaactgccagtaccgaccctggcgctccccaccaactgcggcgcagcctcctctgcggtgcccgcccttcggcatcactgcagtccctgtagcaaagctaactttaaaaatttaaataaaataataattttttaaaggcccgaaaactccggctcccacccctcccccagcctgcccggcggcggcggcgctcagtgagtgacacggcgagcgtgagccgcggccccagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacaggttggtcaccgccgccggtgcccgggaggctgcggcgcggccggctccgtgccctgcgcccgaggcccgcgatgcgcgctcgttagttccttggccggtccgggccaggacggctcaggggcgctggggctgcgagaggggctgctagaggggctgcgggcgggggccccgcgcgggggaggggtggggaggggcgcctccacccgagagcggggcggtggggtccttgccggcctggccggggcgcgggagccgcgatgcgccctccctattcctgcgcgtgggtgtcgggggcgcctgccgcgggatgcccctgggctggcttgggaagcccagggccggcgacacctcgggcctgccccgcctgggcatctagcaggtgttggggggcaggtggctgaggacgaggccactgggcatcactacagcgctgcacctgccccctcggcaccagggccgctgcctgggtaaacctctgggccaacgcgcgggtggggaggtgggggtgggcagcctggctccagcaggtctccgcgggggctccgcgg

SEQ ID NO: 5866 - DNA, 1143 bp, Homo sapiens; identical to SEQ ID NO: 5865
  source 1..1143: mol_type = unassigned DNA

SEQ ID NO: 5867 - DNA, 1371 bp, Homo sapiens
  source 1..1371: mol_type = unassigned DNA
cgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccaggtacgcgcacaggcgttagggctccggagggacgggcgcccgagaaggggcgcggggtccggaggggctgccggcgagaacaccgcgcgggcgagcggagagggctggcgccgtcgccggggactcggaacccgcgcagactggctccagcccggcggcgacttgggtggggtggctttttccctttcggctcacctcccacccctagccaccaccaaacctgggagtcactgagcgggcgctggtacgcgccgggtgatggggaggtcgagaccgggtccttcgtcttgggcgcaggagttggggattcgcgtccccgcgctgcccgtcgccctgccccgcgcactggctcccaaactggcgcgcccaagcctcccgctccaccgtctgcatcccgcccacctcctcatttgacggagatggctgaagacttggccaaggccacctcgggaagaggggagtcgcttcgggactggggctggagctggagcgccagcctctcctccggttgtagcctcctagcgctcctggctgcgtcgctgagggaccctccaccgggagagcgcctcctgtcttcctcccgctctccagaggagcctgctgggggaagccggccctggcccgccgctgggaggctcttgggtgcctgggagggctggtgggtagcgagagtcggggaccgggcaaggctgcagggaattcctggagggcccaggccggcggtctgtcgtgcggctgtgagctcagagcgctttccgccctcggtgccgaggcctgcactactcagaacgccatacgctctcaaccga

SEQ ID NO: 5868 - DNA, 1545 bp, Homo sapiens
  source 1..1545: mol_type = unassigned DNA
cgcgctgtgagagttaggctactcaaatgttacgctccccgcaccgccggcgaggggacaaatgactactctgatggattcggtagcccaaggaaattatcgctttcggagggatggcggcagagcaggtcgggcatgctgcatttgcctgagttggaccgcgtgtgagcgagcttacgctccccgcgggccaggcccagctcccgtgctttctgacaggtgaagttgagcatccttatcaaaccctcgggaagaacaacgatcccattccacatcaacgtgactggaaatctcaatttaagaattggatgcaccggtcggtccacctggggcttgtccagctttccatcttacttcgcgcctctgatgtgtcaggctttttgcacagatagctcacatatttaaccctcaaaacaccgtttcctgaagcgatgctcaaccaggaaaacttgccccaaactgcatgatcatcttccgtggcttctcttcccgaatccctgctctgtccaccaggtgcggccccgccccgcatccgcacacaccttttccgccgctgccctgagcgcagcgacaagggcccccacacctccgcggcccgcaatgctccggggccaagccgaggcagggaggcgctcccgcagctcctgactttacaacccgcgcgcgtgtgcaccgagccgcgggcacaccgcgaacacacacacacacacacacactcgtgcgctcccgccctccgcccggcccgggctctccgaacttacctccgaggcgccccgggcgcagggcccgcccttctctgcgggtctccagcggctgttcggcagtggtccgcacggcctccgatgccgcgcctccggtaggctccagagtcagctggtcactgtcacccggcagcccggattccgcgcccagggttgcaccccgcggatggagcgactttcgcctccgccgcccgagtccaggtctgcgctcacacgcgcggcgctcacacgcgcggcgcccacctggctgcagtcccggccagggccagcgcgccgcggctgaagggggcgctcggactcctctggggcggcgcgcagccgggacagtctcgcatgacgcccgcgctccagcggccccgggacgcggcctcaccctcaacccctggcggtctcagcctcggtctttgtgtctcggtcggcgtcgccacgtcatgggcttgcaggctgggagcagcgcgggccgggaacgcggctggggagagctgggctgggcttctccaccgccgcccgcccggggcgctcaagctggcggggcgcacgggcagcaactgagcgcaccctgggggaccgagggggcggtcccggggaggggcgcggcgtcgcgccaagggggtgccctgccagaggctgcggcggaggaaagtgggagtcagagcgccgccggagccccgggaaggcggtgtccgttcggtcccaggtcgcggctgcagcgccgaggggaaagcgagcggaagctgcgcgctggagggagcccaccacccggagccacccgcggggttcgcgt

SEQ ID NO: 5869 - DNA, 1545 bp, Homo sapiens; identical to SEQ ID NO: 5868
  source 1..1545: mol_type = unassigned DNA

SEQ ID NO: 5870 - DNA, 1027 bp, Homo sapiens
  source 1..1027: mol_type = unassigned DNA
cggtgcgtgtataggggcgctccgggaggggtggtgaccggcagccggccttccacccttcgcgttcaccctctcgtctttgttctttccccagctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgtaagtgggcccagcccaggcagagcgggccgaagtgtgtcccggggaggcgcccacagacccgtcggtctccccgtccaggaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacaggtgcgctccgcccccagccccgccccctccctcgcctcctgccccgccccacgggctgcccggctccgccccctcacgcccaccagccgcttccacctctgcccacccgctccacactgaccgtagtcctgccctccgcactggtcctctccccgcaacgacttgccccaccttttcccctcatccgctgacccttgccccaaccgaggggcccggggtgctctgacccgtcctctccgcagtgaggtgcagtacgttgtgctccagaacgtggccaccatgtccatcaagcgccgggtgagcctgcgacggcgggctgtcctcgctgtccgagggccgcttctgcgggcactggaggcgttgtcggggctgggaccggggccgg

SEQ ID NO: 5871 - DNA, 693 bp, Homo sapiens
  source 1..693: mol_type = unassigned DNA
cggattcgttctatttgaggatcccgggtctacacaggcgaccgcctcggccccagactggaagcgacactccagggaccaaagcttccagcccgcgctcggccccagcccctgtttccgcctcagagccgcagcgagcagggtcctgcggcaccgcccagagactggcctaggaggttccagcccccagcgccagcacacactcaccggctgcagcagccccaccagccctgctccttctcccgggtcccggccacaccaagagcttcggaaacgccgagaactctgcgggtccagaacgcccgcgcggacgcttctcttacggcgccggaagccggcgccgagtctgtcaccgggcatccctctgttgccttgacgacggcgggcgctgtaagagtggagaagctgcaggtgctgaggcgcggtgaaagaaaccctgggagccaagagcacgaggagctggtgtctgtgtcacatttgtacttgcgggtaagaaaccgctggtgtagcggcgggccagggcttgggagccgacctagggcctaggtgcacggagcgggctcctcgggaaccctgagagtggccgtcccccggagatgaagggacgagggcgcagcgacttccgcacttatcccgccccacgaatactcgctccgcacccgccggctacccggggataaaacgtttgttcgt

SEQ ID NO: 5872 - DNA, 1496 bp, Homo sapiens
  source 1..1496: mol_type = unassigned DNA
cgcccccgaatccggagaaagcagcccgcccgccccctcacccggcagccagctcagctcacccgagagctgagcccgagaagccggcctctgacggtgctggcgtggcgcttgccaaaatatgccccttgcatctcaatttcccccggccatttctcttgcacgcacagctcgcccggggccacctcggctctccagcgcagccctttcgacccctgtttcttccttccccgatccatgcctgctcaaggccgaatgcaaaacccacctccaagaaagcgcagcgggcacggggggcacctagcgtgccatgtcccgcagtcccctcccagccaagaccagagccccagactctagattacggaaatgagtgtcattcagaccaaggactgcgcgtctgcggtcccggtccccggctctgggtgcttctctggggtgtctgtgcgctccggcaccccccgtcgccgtccgtgagcctgcgccccccacccacccaggcttgggagcgccccccacccaaggcttgggagcactccccaatcacctccgccacgttcatttcacttcctaccgcggtccggattgcagcaaaaccgggtagcgcgagggccaaaaagtggaaaggagagcgcctttccgtgtcgtgcagccagctcgccaactctccctccccagccccgaccctcgcaatctcaaatgcaactttttcccttcggtctcggtttcccccgggctgcggctagcgggcgccgcgctgcgaggcgtggagcgggcgggctgccgcgaggctgcgggtggcggtgccggctacagccgcgagccggcgagtgggtgggtgggtgggtggggaggagggagaggacaggcggggagagagacgggtgtggggaggggagggagggggagattccgctctcctgccgctcccagcccgggcggggggcggggggaggaggccgcgacgagggaggggaggagggagggaggaagggagggagggagccgaggaagacgctccgataacccgtgcgtttcgtaaggctcggagcacttgtacatttctgcagccgcgcggcgagccattcgcggcggctgctgcagctcctactgcatcttccttctcttcctttcctcgggctccgggtgtgtgtatgtgtgagagtgagtgtgtgtgttttgcaggtgcgtggtgtgtccgttttaattctgcccagtaggtgggacttggtgactttagcaccattttttccttttccttttttttttttgcctccccaccgtctgttgcaaccctgcaaagtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgt

SEQ ID NO: 5873 - DNA, 5820 bp, Homo sapiens; identical to SEQ ID NO: 5626
  source 1..5820: mol_type = unassigned DNA

SEQ ID NO: 5874 - DNA, 699 bp, Homo sapiens
  source 1..699: mol_type = unassigned DNA
cgccgcggcctccaaaggccgctgctgtgggtgcgcatacccgggttggagaaatcccggcggttctgcaccgcgcggcctcgcctgggccctggagggcgcatccgtcccgcctgggctgtcccgcggctcatggccaagcgctccttgcccagcccggaaccgggcgcccgagccagcgaacaggccggctcgccccagctggccgagcccgacccgccgcgcgctcgggccaggcgagcgcggcgcggcggattagccctgagcccgcagcctcgagggcgcggggcgggcgcgtttggggtatgagggcggggcgggcggcggccgcgcctctaatcccggcgctgcgtgtgggagcggccggatcagggaattagcgctgtaacttcggattagtaacgctcgctaaatgagtgcctaattccgacccttcatgcttttcagcgtcgcggctgagtcctaggaggcctcctggccaggctccctccgcgctctggtcccatttcccgggaggtccggccgcggccggcagagaactctccggcctgtggagatccggcctcaggccgcgccgcagcctcctctcggcagcgcatttcattggcccgggcagaggcccatgcagtcccacagcgttcggagttgggagttcgtggaccagagaaaaggaagccccggatgcctcgcccaccacgg

SEQ ID NO: 5875 - DNA, 1845 bp, Homo sapiens
  source 1..1845: mol_type = unassigned DNA
cgcacgcggcgcgggactcgagaagagcgcctggcagagcacaaatcccacagaagaagagaccttctgccctctttgagacctcaccttccccttgcccagggccaggaagctctcctcgggcctcctcagaaccccggctgcctccccacctgtcgtctaccgccctttggaggttccggagaggggcccggcccggcgagccgaaggctgcggggcggggcgcgagtctcagcccctgggacacacagccggtgcgtcccgcgcctcaagtgcgcactccaggaagtccggagccgggaggatccgggctcgcggtcccaccctacctctggcgaggtcgggagaaaaaaagcgccagatcgcccgcctgagggcccagaagcccaccgggcggcggtacagactttcccgaaatgtctccgtctccgcgctgcgagcgcacaggaacccagggtcgccggggttgccgtggcttggctgaacgtccaaagccaggcgagggcggggggtctcagtccagctatgcgagcccttctctagtggtgccagctcctacgccgggctcccgggccggcgggaggcgcgtgtgcctgtctgtgtgtgcaggggacattccgcttcccagtagcccatgcagaaccccgccctccgctccggccccaggaacccctcccccagctcagagatccctgcgcgccccctgcccactttgccaaggcgagaaagcggccgtgctggagacaaagaaactcctgcctccctccactctcggcccctccgcccgcccgagacactccccggcgccctccctcgaccccggcgacactgcgcttggacacgccaggcaggggggcagggtgggcgagtccgcttcccgacgcgggccagctgggggcttcccgtgaaccccgcccggggacaccccacagcagccgcgcccccaccctcctctccccaaaccgtcccgggcccctgtcgccgccaccttctgccaaaccgtccccatctctccagcggagctacagcggggcgcggcgcacacaaagggggtcggagggtggagagtacagaaggagggagagatcccgccagggctcgtggcacgggcctgggagcagctatttacccgatttcttcttcgatctctgagatgtctgcgaagatgaggaagaccacgagcagcgtgagcgcggccagcatccagctccggaactgcagctgcatggtgggttcgcgcccgccgggacccacgcgggccggcgcgaggagcaggggccggagggcgcagcggcggacgccggagcctccgcgcgccgcgcgcagctgggcagacaccctgcgctccggacgagtccgggccggcggcggcagcggcagcggcagcggcagcgacaggcaggggttgctcaggcgcggcgagcccgctcgctccctcccggctcccgcctgcccctccctccctcctctcccttcccccgccccgcgcccggctccgcgcgcagtttgacagctttgctccgcgcctctgctcgcctcctcccaccaactccagcgtccaggcgctagcctttgcttctcccgcctggctttattcagctcccgagggcgcggggatgcagccggacgccactcctggcctagagagactgggctctggccaccgcgagcgaccgggtacggagctgagcccagggaagtgcgcgcaccgcccggcgcacccctcaggctggcaaacgccctccctcgcccgctctttgtccagctccctcgcctcctcgcaaagttttctcgacacaaagaccaacacctggggacagcccccagcgcgcggcgagaaggcgg

SEQ ID NO: 5876 - DNA, 1844 bp, Homo sapiens
  source 1..1844: mol_type = unassigned DNA
cgatcagagacccggcgcacggagcggagctcctggtccttacctgtaccaatccagcccgcggccgtagttcctgtcaaagaagtggggttccgtgcccaaggcccgcacgtccgggtgtactcggataaactccagcacggcccgggtgccccccttcttcacgcccacaatgagggcttggggcaaccgcttggtacccagcttgggtgagccggagtggttggaaccggagaggcgaggggcgggcacggcggcggcgggcgcgctgggagcgctgggctcgctgggcgtcggcccggagggatcacaggggcgggacttctggagaagtttctggccgcccgcgctggggccgcggaggcagcgaggcgcgccgaggaggcggctccgacccaggtcgtcgcagcagcacaggaagctgtaacacaggtaagtgcaggagagcgagagcgtgaaggcgaagagcagcctgcgcgccctccgcggctgaggtggccccgcgcggcccaggaccctataggccatggctccatgggcccgcgccgggggtcatggtttccgagggggcaccggcggctgagctgctgtggccctgcggtcgcctagagggctcgcgtggcgctgccacggccacgcgggtcgggcgttgggggcgccgtcttctccgggggctgctgaccagggtgcgcacagtgccagggggtcccgggggcagcggctcctcggggaacaggcggttgcatttccagcatctcccggtcctaggcgatggggctccgggcagccgggcggctcgggcgctcccaggctcttacgtgcgccgggttcggagcgcgcccagcgcccgaagccccattcctgatcctcggagcgccgctcacgaaacgctcggcggcggcgcggctgtgcgggctggcgggtggaccggacggtggcgctggcgccggccgcgatctggctcttcgggaaatgccgagcggagcgcgctgccggctctatttaaggagtggcctgacgtcagccgcgcgggtcccccgagcccgcgccgcgcccagggacctggcccgccccctgcgcccccactctcttacccctcccagaaacacagcacgcgggccctccccatgcaggccactccctacggagccccaggccagctttggggcggtgaaacgaaggtgtcaaggcatagtactcctccgggaggctggacacccccaccacgctggcctctcgacatccagggacacgaatccaggtcgagatcgcgccgacatgcagaccagacagacccagacgcagacgcaggcaccctgccctgatgcgcggtcccaccaccctgacccgcacacgcacgcacaggcacagaagcacacgcgccctagcccggacacacccccacacccacgcgggggtggggaggagaagtcccctaacctgggcccagatacaccgacaaggacactccccccgctctcgacatctcgccaaatggacacacacagcccggaatcggacaccgagcgcacgcacgccctggactgggacacgcgctgtagacgggatgggtggaggagccgagcgtgagtgagattccgtgactattcacccagcttcttagcccccagcgcgctgactcacaccccggcggctcgctctgtctcgcacctatgaggcacgcgcgcaccccaacccattgtcaccccacctctccccgggcctgccggagagcgagccccggagcggcagactccgcgtcaggagggttcctctcttagcagccgccgcctagcggtagactgctccccggggagctgtccagggtaccagagggtcgccga

SEQ ID NO: 5877 - DNA, 1480 bp, Homo sapiens
  source 1..1480: mol_type = unassigned DNA
cgctcccggcgggttttgttgccccacgtccgccgtggggatcttttctcaggagcgccttgcctgggattctccttgcgtctcagaccctcaccctggctcggatttctttcgggggcgtccctccactcccaggcccccgcccgcgcccggcgtggcggccccctctccccgtgcgggcgggctccggaacagtgtcgccggccgcctgcaggtgtctccccacggaggggcgcgcgtccctgcgccgtggccgctgccaggcgccagcggctcctagccgaggtgcactcgcgctccgggctccgggcgcgccgtagccgctcctccaccgccgcccgccccgccagcccgccccgcacgccccccgcgccgcgcccccaccccggggttggggggggcatgggcccgcgccgcgtccgccgccgccgatctcaggcacccgagccccggggcgcggcgggcagcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgagtgcgcgcgggcggcggccagctcggctccggctcccccggggcggcgcggccatcgaggcccgagccccggacccgttcgccctcctcccgccgcctgggcccagctcccagcgctccgcctggctaggggcgacgttccggggcagggggcgcgcgccgttccggggccggggaccagcatggggggacgtgcgggacgccccgccgtggagaggtgcaaggcagagctcctacccgctgcggacgccccgcggctttggggacgctcccgcgccccgggaaggcgcccacccccgctgccggtcggaggggcgcgcgctgctttccgctcctgaactcatctccacgctcgccccctcctcctcttcctttcgcggggcactagatgcccccacccaccccggaacgcccctgggggtgggggtgatgcagggactcctgctaccagccgcccctcctgccgcagatccacagacccgggagccttccacccccatcgccaacccacgccgaacctcccagacgggagtggggagtgggggagtcccgcgggctcccggaaagccgcacccgc

SEQ ID NO: 5878 - DNA, 5065 bp, Homo sapiens
  source 1..5065: mol_type = unassigned DNA
cgccaagcgcctcccccgggtgcggttcctctccgccagtgaggtcgcgaccccggcgcagctgccgcctcacttcgggctatccccattcgctattgcggatcagcccctaagtaccaggccctctggcggaacctgcaagtccaaacttcgctacccggattccccagtagtcccccccccaccccacctccacccagagttaggagggtgctaccgcacgtagagcgcgcaggtctctggggtgagcagggcgcgtggagggactccaggagtggcacctcactcccgctcgccgcctactttcgacccgcacaaaaataaagaataacccccactctgcttctgtttttattgatgtatttctttgcatcgcggcacgcggagcctcgccagcgccctgacactgcagcgcccgcaccagcgaaccacggaacttgggaccgagacaatggcccgtaattgatgtattgccatcaacaataaagaccaattctcctctccccgccattccgaccatccccctcctcccatccccccctcctccacctcccatctcctttcccggggccaccgagggaaagaaaacaaacaagaaattagcgggggacgccaagcgcagatcgaaacgcccgcctctacgccgtcgaggacgcaaaaaaacgaaaaaagttattaaagtttggatcccccaatttattcgtctctgctcgcccatttttaattaagcatcgcgtagctgcttttcgcatgttcatttcgtttggttgtttgttgtggtgtttttttggggggggggaatttttttttttcctacacttaatcttaaatcacacgtagaccaagtaacaaacacgtgtgaagttattcccgggagcttcctgctgcgcacgcggcgcgcaccaggagaaaagctttgcgggaccgccagctccgctaggttcctggctgcatgcggtgcccgggaggcccggactttcaagaagccaagattgttagagaaggatgcgggcggctccaaacacgggcacattccgggaaaggagtgtgcaagtgcacacaaacgcgttcgtgtacctgggacagtgtggattggtgggtgtgcgaggacccctgtttgtgagatggaggcgggtgcgggatttacacgtgctcccgtacacgttccccggggtctgggagatgcgagccgctcacaccccaggagtgcgcagatccatctttgccgagggatctctttaaatattcagtgagaaataatggcatttgaagcaccacctatggaaacattattatcttcattcttcaacatcagccccactgatagcttcgtttgtctttttatcaaaatctactgtacccatcaggacctggcgagaacgggagagcgaggcggagagggtgtgaatgtgtgtgttagggagtgagcgagggcagaagataagtaagagaaaaggtggaaaacggacgagcagggagagagaagggagaagttataccaataaaaaaaaataaagtcagcagatgaaaaacagaaacattcatcggcacacacacacatttacaccttaaaagaaaagatttaagaagctaagagaaagggaagggtcctctaccggagcgcagtacaggtccggagtacacgaagtcggctcgggagaccggtgcccacttcgcgcgaaccgaccgtggcaccggccagactcaagggcgctcgcgaattggggcgtccttatgagccctctcctttcctgatcgtgagatagggcagggattgtgtatctgcacccccctcctcccccattactcagccgaagtttagtttagtttagtccttcgggcgcaagacttcgagaaccttggagcgaggagaccccgaggcgcgaggggaaagagctaggctgagccgcgtaccgagtctcaggttcgcgggcgcctgagcccggcagagggatcgggctcctggctctgggctctggggcgagggtagggaggttgcatctcagcttgagggagatggtgatagagcgaaaagttcgggcgccgcgctcggcaagtgcccaaaaagtggaggcgagcttcggcgccgccaggcagcctcggacagaacacctccccaccgccctccccccaccccgctttccggctctgcgccgccacctcgtcccggaaggctggggcgcggccccctccccagggcggggtgcccaggggtcccagggactggcccagtccagtgccgggtccgcccgggctgtgtctccctaggccggtgctcgctgctgcgctcagtgtgagccgcagcccctcccctccccccggccggagctgaactcggagcccaggccggtccccgctctccgcccgcccggggctctgcggcgccaccgctgccgccgcctccccgcggagtgacgcgccctgcagccaaccggggcagccgggggggaggtccgggaggggtcctgggcggagccgggccgcccccttatcccacgggctcggggctgcttctcccgaaaacttcagccctaattgtcctgggaatgtccgaggtagagaaagggagcgagggagcaagcaagaagctggaggatcagtgcccctggcggggaggggatggggtggcgggagaactgcccctccccccagccacaaacccatcaggttcccaaacctttcctggatcctcttctccgcgcccccgcgagcccgggatccaggggatggagaactcggggcggaggagcgccgagccaggcgggagggaggccgagccgtgggcgggaggcggaccggcgtggggctggctcttccccactcgcttatttttttttttaatgggggtgggggtgggctgctttctggtagctcttaaagaaacgaagaaacactcacgaaacgggacgccctcccccctgatcccgccgcgggactccctccccccgcgggccggcgcgcctcgcccccgagttgggaagttcgcagcgcgccggcagcccgggtccccagccctcgccgcccggccccaccccccacccggggcggctcaattccggggagggcatgctaatttgggtcggcccagcccgggattgtgggggggggcgaaggagggagggaagagggaggggagagggagagagcggggggcgcctgccggggcgccgggcccgcagtggagaggaggccggcccccggcggccgggccgcggagtcccgggcggtcgcaaagagggttaacccagtgtcgggcggcgcggcgcgcagagccagccccgcggccggcttattgggccagcgcgcggagagacaggggtctgcagcaaatcacgaactaattgattaaggcgagcgggtttgaatagcgctggcccggtgccaatcgcctttcaaagagcccctctatgattaatcgcaatgcattattgataatcataattatagcaggacacatgcgcgctgcgcccggggccggggagccggggagggggcgggcgggccggcgggcggggggagccgccgccgccgccgccgctcgatttccgtaattttgagaagatttttttttagtaattttttattctgccccagctgatgtttgagccagcatgtcgcggaggaagcaagcgaagcctcaacatttccaatccgaccccgaagtggcctcgctcccccggcgagatggtgagtgctccggcccgcgccgtggacacacacacacgcactcacactcacgcacactcggacccactcacacgcggctggcccccgcgccccctacctcaccgccgccgcggccccgattgcttcttccactcggcgtaattttttttttctttttaattttcaatgtgcctttgctgggctttcccccgctgccccggggaaagcgagcacatctcccggcaggatctttccggagttgttgggtcctcccgggggaaggagggcgggcatgccggcctggcttctccgtccctgcttttccggggatcccagccgcggccaagacccgggagccccatgaggcgtgggtgcgggtggaggtcgccccggcctgaccgcacggggcccctagcgctcccggcgccggccccagggcacccggcccggcctccgccgcccggccttgctgccagcggtaaggaagtttacttcgggcgctgggctgaactccgagcgtgggggagttcgctgcgcccccctgcccccacgcacactccccctcggcctgcgaggcagaaccgggtgtctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggtcggtatgcgccctctgcggatcgtggtgctccctacttccaggggggtcagggaagaagtcatagaatagttttccaggtttgcgggtggccagccagagtggaatcccccctgaaacaggggcacttgttttctccgatggaggcgacaactgtgggtcccgaaggggctgaacaagtccagaacaaagtttgtgtgtgggggctatggcagagagtggaagagatccgggcagggagttggggtacaaagggaggacacctggaatccctccttgctcctaaaggtgtttcacggtaccggcctcaaagctcccaggcctagcgcccgaggcggtgtagcggcgcccggactcgggtccccgggtcgtcccggcacgatgctggcctctcggctgtgggaggacgcacaaggagcaatctcggcggggtctcagcggctccggatgccactcgggatgcccacgccctaggcggcattttggggtgtgaaggagggagctgggccccgacagagctccgaagcgtgaccctgatcggcacctcagcccactaagctgcggccgcccgggcccccaggtccccggctcgt

SEQ ID NO: 5879 - DNA, 2372 bp, Homo sapiens
  source 1..2372: mol_type = unassigned DNA
cgagggacgcaggatgaaagaagccaagagtgtcgccagggcttgcgccagcgccgtcagactcccgggatgggggagctccagggcacggcgtcagcggattcacggagaaggagaaaagccccactgccgtgcagaagcctaggcccgggtgagacgcctgcgaaggctgccagcagcggaagagaaggggcgtcctccgtgctgcgcagcactcgcccgcggtaggtgggcgcggagctcagagctgggagccaaacgcaaacgctggcgagaagccccagccccctccggcagcccactcgctgcggggaggggtttctcacgcccccagctcctgggagactgcaccggaggtcggaagtaagccgggcgaggatgaatcatcccgcctaactcctccttcccggtcccctagcctccgcacgccggcccccttcagagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataaggtgagtcctaagaaaacccactcctaactccctgcgtctccgatcatccggttttgcagcagacggtccccgtctcttgcgcacagcgcatcccagtgggggcgcaatgcaggtgccttcgatgtttacctccctggtctggtgcattgcaggaggcatgggggaatcttaaccggcgcacgggggagttgaatgcccccacagagttgttgcggggatgccttagagcgggtctctcggggcgcgctgcctgcgagcgggactcagggcgccccctttccgcggcgggtctgcagccagtggccgcggccagtgtgtgggaaagcactgcatagctgggtagagccgcgccagtgcccagggccgctaggcacgctcgagggcagggcgggctgcgaaccctcggggagggactgggatgggggcggtggggtcgcgcggacggcgggagtctgtcgctgctggataggcggacctggtgaggcacggcggagggtcggggagacgccgcaggcggaatactgatgagcccggctctgggccagacctggctctcgagctggagagaacgcggggtcctggtgccacgtgctcaaaagacagagcggagagggcagccagcggtcgccatggcaacgcgacgtgcaggcttgggcctgaacccttccggagttgggacctgagactagagtgtcaggaccggagtttgcgcagtcgcgg

SEQ ID NO: 5880 - DNA, 2372 bp, Homo sapiens; identical to SEQ ID NO: 5879
  source 1..2372: mol_type = unassigned DNA

SEQ ID NO: 5881 - DNA, 2372 bp, Homo sapiens; identical to SEQ ID NO: 5879
  source 1..2372: mol_type = unassigned DNA

SEQ ID NO: 5882 - DNA, 2142 bp, Homo sapiens
  source 1..2142: mol_type = unassigned DNA
cgcagctggtttcgaggttgtgcggtttccagtcctgcggagcagctcaggttaccgcctccgtggccgcgggggagggcatctccgacggccgcagcaatgggcaagagatcagggtcttcccatccccgcgactcgcccctttctgcctggtaaccaagcgggatgcctcatcctactccccaaacggagcggatcacacacagtagtatttcatggtctttcctgctgcggttttcccgggggaaggtacttccagagggtggccaagtcttccctagcggccggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtaagttcagccccctcctggcacttttcccgcagcttcttccctggggtcggtctcacggaaaccctgcctccagaggggaggaaacagaccccactcctggagccccccagcacccttgcggtggtacccggccagagagcgatgccgctgcctgccccgctgctgtaggggagcaagaatgacctggaggggagagcaagaattgttcgcagccacgtacgcgtcccaggcagaaaaggtggcgttgctagggcggccagcgggctttgcagttaggaccgcgagaaggctgtgcccgtctgcggagctggggtgttccctcttcagacctggaggcttcctctccgaggacatggggctccggggttgtgaggggagtgagaagataggtgaacgagttttagggcccctggacctactgcagcgcggagctgggacagtcgcaaaagttgcgcttgtttccctgaatccagactccctggccagtggggaaggagagagaggctttttgcctaagtcagttcccttccctccctgcgcgaaagggtagcgtccttgggcttgagcgactgtcacctttttgtccctctcctctcccaggtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgg

SEQ ID NO: 5883 - DNA, 544 bp, Homo sapiens
  source 1..544: mol_type = unassigned DNA
cggtctccagccggccttgtgctgcccgctgcgaatacagcccgtgggccaccgggcagccgagccatgcaagccaccctgatccccaaaaggcagacgcacaaacccgacccagaactcgaggcgaaccttgaactcacagcgccaaaaacgcgcagtgccttcgtttgcccggctcgctgaaggctggctctgggcctgggggcagtgcccgcgaagggctgcgatggcaggccccgctgccacacggcatcgagggtccctccgcctcggcgccaggcgcacgcccttctgccacatccctcgcggggcgcgccgccagggccacctgccctttcaagccccgccaggcagccaagggtgaggagcggagagggacccggccgctgctgccgcgagccagcacaaaggcagcgtctgaaatcgaacttcccaccctgggcaccgcggcctccccccacccctggcctccgcggccggagcgcactcactgtcagtcgccatggtcggacgagggggctgcccgacggccgcccaggttcgg

SEQ ID NO: 5884 - DNA, 2002 bp, Homo sapiens
  source 1..2002: mol_type = unassigned DNA
cgcccccgccccgtgccaagcgggcccaaggcccgaggctcccccgctcacaaccccggtgcccggaacacgtcttcgaggggccgtgctgtcggggttattactcgcgactggacctcgcgccgtgttgctctcctcgggccccgagcccgcccagcggtctgcacggcccaggcctgagctgcgggcttctcctgtggggcgcgctgggagtgagctctatccccaaagcccatttcaacgtcccaggtatgactacgacggcagaggccggccgcccaccctcgcccccttccccggccagagcgcctttgccgggagccgacgaccgcggcctgaccccgggccccaccgcctactcccggctcccgcccttcctccacggtcaggggtcacacacagcggacgccccgttctcagccgcccctctgatctctgaatttgggagccagcgtgtccgctggggcatgcactgccacgggcactgggacccctttgctgctgcggggaggagccccgacggcaggtgggaagacctagcctgcccgcgtccccgctccccagctcctgcgacccgggccgaggctctcagcccctgggcttccccgctccgggtttgagggaggggccgggccttcgggcctgcagacccgccaccgcgcgtgcgcatgcgtcggccgcgagcccccgggtgcaggcctgggcggctccggcccgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcgggggaggcatgggcccgggcaggcctaggaggaagctgcacagcccgaggcccgggcgggagtggcgggccgcgggcaagggaacgtatatttggaaggggtcaggacctcggctggagtctggctttttatggcgaggaagccgactgggaagggccctctggcgaggctttcctgttgtgccacttttccccggcagcgccgggcgcggggaacgcggggctgcaccggggcgggggagggggctttacccggcggctccgaggactcgactctggggtcgggcccggcgggtaggcctgcccaggagccagctggcaaatgcagcggactgtcacgttattccactgtcaccacttactgtaaatcactgtcctaagcctccgggagaatccgtcgaacctgagaggggggagggggatgggggtgggcgcgcaggaagccccacaggcaccagggactggtgacccaggacatcagcccctcgagttctctctgggaatttctagcacccagactgtccctgactgtagggaccacggtggggcgtcttccttctaagctctccccgggacaccgggcgcgcccccctcgcccctgggttagcgcacactcctccacgcgatgaccagcacagccactgtgaggcccggccttggccgcgtttgtcctttgcgagtgataataataaaaatcattggaattgcaaggaagcccctggccccggctccccagccgctgctgtcctgggtgtcccggctgcggaaagaccccgcagccgggcccgacccacgagtggaacaccgggctgcggacccagccgggcctacaggactggcgcggggctccggggacaggcctcgcagggccctcctgcgcaccgtctgggacgccgattttgccaacttggaggacaatttttgttttcactctaccagcagatttttaaaaatccagtcgccgctgaaacgtgcttcccacccgtccggtttgtttgtagcctttgacgagccccggcacagcctccgg

SEQ ID NO: 5885 - DNA, 983 bp, Homo sapiens
  source 1..983: mol_type = unassigned DNA
cggtgccgcgcgcccgcctgctgcctggagctcccaactcggcggaatccaggtcaggacgcgccgccgttttgacgtgctgccggccgggaggcgcgggcgccaggctccaacgactagggtgggtggccgcggggcaggggttggatctgaattcgtccctcgggggctctggatgcgggatgcgggatgcgggatgcgggctcgacttcctcgctgctggtcgaggagcgttctgagagtctcccctccgcgcgcgaggataaatatgcgcggcttgtcagtcagtgcggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacgg

SEQ ID NO: 5886 - DNA, 947 bp, Homo sapiens
  source 1..947: mol_type = unassigned DNA
cgctcggtgctcatccccgggatcttgaacttcgcctccctcttactttctgccagacccgcgagggccaggaagggctctgggaggaagcgggagcgcagcggcggggcatggaagaagagggttgggggcgcgcgttacctgcaaaggttctcgaggtctccttccagccctggtggtaatcccgctcagcgccgcgccctcccccagatccaaacttttgctgggtcctccgggtggcggcggcggcgacggcggcggctgctggagccaagccctgtcgcccgcagcgtcggggcgcgggggtgcggaggccggagcctcagagcggcgcgcgcctccccgcagcgggccggggccggggcgcccagctcgcctcgcttgctctcgcctacgtcccctacggagctgcggcatcgtcttcccccgtcctccgccaccaccgcctccagggttcgggcatgccactttctcttggcttcggccgccgcgacccccgccttctctcctcctccgcctccccctctccgcttcgccaagccaacgaaccccaaaagaagtacagcgagcggggaaggcggcagaaagctgccccgcggcgccggagctcctcggatttggaggatcccgggactcggcgggagagctaggcgggctctcctccgacgcgtgtgtgcggacagctcggagccgggcgtgcggcgctgcgcgggggcgggcgcagggctcgctccaagtgctgcgcccgcccggcgtgggtctggaggctgctcagaccacactactgcctcaatccgacgcggccgggctaatgtaggcgccgcggcccccacccctacccctcctgacacccccggatatgtttacagtaatgaattcgcgggatcgcctccgcagctcccgcgctcctcctctccctccgtccctcgcgctctggcgcgctccgc

SEQ ID NO: 5887 - DNA, 1362 bp, Homo sapiens
  source 1..1362: mol_type = unassigned DNA
cggcctccgggccctgcgaagggagctttgttcgcgaggcggagggcctggcttaccgagaagcgcatccggaggcggttgaggggcgcgcggggcacgcagcagagccgcagcccggcccggacccggagcgccggagccgcaggaaggcgaggagaaggaaaaaaaggaggctgccgccggctcctgcctcattctcccgggcagcgttgacccgctggccgccgccggatagggctggccgccgggcgcgggaccccgtgcgcgctgctcatgtccccgtctgccgctggctaggtgtgcgcgcagcctgctggtctctgggcggcacccgggggctcctcatgccccgcgccggggctcggcgggaggacctcggagaggcagcgcggagggaaagagagagagacagcatgagaacgcgcagagctgcaccccgcgggggccgggcgccagcagcaccgcgctgccccacccacggcgcgtctgctccccgcgctgcgcgcccagcggggcgccgagccccagaaactttagcacatggccggtccggcggccacggtggccgtagctgccctgctcttcgagcgccccccactgcttcctgccccaagccccagagcgcagcttaccagcggcgaccgcgaccgcagcggcggggcgcccacccggccgcaagcacagcagtgcgcacctgcgggaaaggaggaaggggctggcggcgtcggggtccctacaggggaggggcacctcggcggcagcaatcggcgcaggttaaggcattctgggccggggctgcgcgcgagccaggtggtggcaggccgggattggggagggtctctgcgccccccgccccgcggcgccgctgctgatgacgcgcgcgggcttccccggccccgcgtctgcggagccagccccgttacctagcgactcgctccggggagcccccgctgacgcgcgctgcgagccgggctgcggcagccgaggggcggggagggaggggagggggagctccagtgcggggagggccggcggctgcgggccaagctcctccctccgcttccctctccgcgttggggagggggcccgggaaagacgtggcctccgcctggccctggaggatgggaggccttcgcggggcgggggggacggagggaggcactgagtgcccctgtccccgcagtggggatgcagcagcaggtggcggctatgtggcctgtggaggctcggcacccagaggcgcgcggtgagcccgccccggcgggagcgtggcgaatgtggctttgggcgcgcgggtgtgtgggacacgctcccacccacgtggcgtacatggggacctggggacgcgggtgaaagaggcgc

SEQ ID NO: 5888 - DNA, 1092 bp, Homo sapiens
  source 1..1092: mol_type = unassigned DNA
cgaccgcggcgcgtcgacgcttggcgggtcacggtcacaaagcgggtctcagagccttcctcaggcggcggcaaagggggcgcccgaggtcaccggcaagagacagattactggcgcctcgggaaaacagagtggggaagggcgagactgtgtgcccatccacgttcgcgcgggtctgagctggcccggccttggagggctccgggaccccagaagggggacagcagtgggggatgggcagaagggggcgactcgggctgcccaggctcctcgcagccttcctgccaacgagaggggcccgggcgggaacagctcgagccgcgggggtgcggggcgcgcagcccgccccaccccgggagagccgcgatcgccgcccccgacgcgtgcaccaagtgggggtgtccggctcgggacaaaggaccgggacgcggatcgcgggcgggcgccactgcccagccccagcgtggagggcgagaccgtggccccgaacctccccaaacttggcggcccggggcgcgtgggggggacgccccgttacctgcgcggccataaaggagagatccatggtgtcgctgcagccagcgctcgagtcctcgctgctgccgctgccgctgcgggtcagccgcctgcacagttggcggggatcgggctgagcagcgagcgtccggagaccgcacggcgcactcggctgtctctgggcttctggctccagatctctactaggcggagggccccgagcgcgggggcgggcggggcggggtggggcggggctcggcggacggggcgcccctccacgtgaccactccccgccccacccccggggcggggtccgtcagaaaccccaagcgctcgcaatcgcctcccttcgtgggcgggatggggaaactgaggcccgaggccgccccgctggttggtgcaagaaccagcctgcaacccaagtcctgagctgttggcgccccgccccgtgcagttgaacccaacccacccggggctgtgggcagcgctctcttggggctgacacgttatcccgagcctgaggaccaagatcggagtgacctggctttccacgccaacgctcctcccagagtccgg

SEQ ID NO: 5889 - DNA, 1092 bp, Homo sapiens; identical to SEQ ID NO: 5888
  source 1..1092: mol_type = unassigned DNA

SEQ ID NO: 5890 - DNA, 1092 bp, Homo sapiens; identical to SEQ ID NO: 5888
  source 1..1092: mol_type = unassigned DNA

SEQ ID NO: 5891 - DNA, 580 bp, Homo sapiens
  source 1..580: mol_type = unassigned DNA
cgtgtccaggggagcccgatagagcacgcgggaaaagccgggtgtctacgcttccgcgacttaggctgcagagataagagaaggtcaggctctgggaggacgcgaggccgtccaggaatggcagggaggcccgctggggcctgactttggtcctaatggaccaaagcttcgacggagcaaggccgggtgtccgtggtggcacctctcatcagtggacgctggcgaatgactatggaaacaacattcaacagcagtgttttctatgccaggtacacaaccgccttggcgtgggttgataaccatgcctatctcaccgcgtggcactgagccgaccgcacacccagggccccggtctccagggctcgcttactcgcttactgcgtgaagcatccatccccgcaggagccggagcaggaacagggctgggccctggggcgcgcgcatgcgcaggccgtgctccaggaagggcggggcactgagccgagggccggcgcggggcggagggcagggggtggtcgcactctccagggcacctgtgcggtgactgagaaccgacccggcaatccgcgggcccgggcgg

SEQ ID NO: 5892 - DNA, 888 bp, Homo sapiens
  source 1..888: mol_type = unassigned DNA
cgacccgctccctggtcgtctcctccgcggccaggcgcatcctgcagcgcccagaccgccgcgtccccacccgcgtccccaaccgcgagcgctcgcctgggccgggccgggcgcccgagattcgggagagattaggggcccgcaaagcagaagagcagattcagaaagaaaaaaaaaaaagcgagaagtgcgagaaaaatatactgaattcagctaaacacacggcagatgaaaaaaataccttgctcagaagccaaaaacgagctcccgagccgtgagacactgttgcgcccccgccaggcgtgcaggccggatgttaggggggcaacctcgaggcccgatggtggcttcgaccccagggcggacctgcgcctaccctcagcccctgcaactgcgggtcaggagaaagggacctgccatggcgaagaaaaccgaatcttctccaattaggcttctccttaaagagagaaaaagtaggtagttgggcaacttaatccaatctgggactcgggacgtgtgcttgggcgcttcccgggcagctggccggagcgtgtgggttcggagctcccagcgctggccccgcgctgcccctcgatgccaccagcaaacccgcagggcgccttggcgcaggctcgcgtttgcagagccggcctgggaagcggaactccctccggtcccgatgaccaggcctctttagggtcctggctcaggctgcctttgtgggacagagcctcatgaagggacacagaaacagagacagcctctgggcggcgcccccgggatgtggcgtttctgtgccccggggagggggcaccacccctgcctatgcggagcgatccggacgctgcaggggtgacgccgggcagcgcccgctctgacctcccacgg

SEQ ID NO: 5893 - DNA, 1483 bp, Homo sapiens
  source 1..1483: mol_type = unassigned DNA
cgcggctctgggcgctggcagggggaggcttcggcaacgcctgggggcttcaggccagcctcctccgggctggaaggcaccgcacaggggcttccgccaacttcggtcctcgcgcggtcgggacacggccacacctgcccgcgggggtctgcctcccaggccgccgcaggccccccggagcctaagaggaccccacaagcagccaaagccagcgccgcctgccccttgcagaacactgccccccacaagccctgcagaccctcccggctctccagacgcccccacggctctcgcgaagccattcccgcgctctgaatgcccccgaatctctgcagagcccccgcggttctctggaagcccccgcgcccgtggagcccccctcccgccctcgggggcaccgcgggcccccagcccagcccctccgacgctggccgctgccacctcccacgaggcgccggccccgactcacctcattgtcgctgccggggacgggcgcgccgggccaggggcgacccggcggcggcggcggcggcggcggggcgcgggacgcgggcgctagcgggggagccggccccgggcgcggcggctccgcgtctgactgggctgcggggggcagcgggggctcatcttctccgggtgggcgtcggggccgctagctgcggggaagggccgcggcggcggcgactgacagctgggccccggcccctgccatcttggcgggcgcgtgcccgggccggcgtgtgcgcgggcgcgtgcctgggggccgccgccgggggatgggggggcggggggcgagccggctggggtccgggcggcgggaacgcgtgcgcgtccgcctgagactcggggcggcggcccctggcgagtgcgcgggcggctccgagtcctcgagggagaggcgcgcgggcgcgcgggctagtctcagcacagcagccaagagctagggtacgcgcgttgctgttcgccccaccgccctccgaggggactgcgcgcgcgtgcgcccctccgcccgcggccgctgaggtgaatgagcgcgcgcggcggtcaaagcccgacacaaaaggcgcggggccccaccgtccgcgcctccgggagcgctgagcttgaggctgcgaggggcggggcggacgagagtggcggggctgaggggcggggctttgagggaagcgcgaggggcgtggccggggtgggggcggggcgccgggcgggcacgtggcgcggtgcgctccctcccggcgcggacgctcctccagtccccgcctgaccccagagctcacagaggccaccgggggagccagggtccgtgctcgatggccccatgattcccatcacctggccctgctgagcaccctgcccgctcggactcggggcatccctgatccgagggccgtcgaggtcaccggcgactgattccctctctttgtacataaggagccgtggcggggccggagagttgcagctttggggcgatatcagtattcga

SEQ ID NO: 5894 - DNA, 3714 bp, Homo sapiens
  source 1..3714: mol_type = unassigned DNA
cggcgtggccctgctcggaggggtcggcctaaggaagtgtcacttacccggagggtggtcccgggcccgctgaccagcttccacgcctgtcgcttgagctccaccagcttcgtgtggcagtggcggcaccagccgcctccgccggccgagtggccctgctctgggccggccccggcgccttcgggagcagggcggctgccgcatgggtcctggtcgggcccggcgggtagcctctttcggggggacacctccagcagcggcggcggctcgcgggccgggccgccctcggccacctgcagggtgtgggggcggaagcggacagtgagcctgggacgtccgtcggatccagacccctgcgcgccctgccccagcgtgacgctcttgccaaagttaggagccctgggcacgaccctggcgctcacccactccctccatccccggaggtcccgcctgcgggtccgctaccctcagcaggaggcccggcccccagggatccagcgcacaccgcgagtatcttcgccgtcccgggcccccgccgcccgcctccctctccaggccgggccgcgcgtaccgcgggctgcgcagcgcacagagggacgccgcggccgaccatggccggggcgcgggaagagcccggcaggcgctcccggccacgctggctctccgggggcgccgcggctacgtgatccggccccgaggcgcccccatggcccggcccagccgctcggaagttcgcagagcctgcgagtgtcgcgaggagcgcggtggctccggtgggcgcgctcgggaggcgagggcggggccggggaagggcggggctcgggctcccggggcgggcggcgaggggcgggagcccagagagtgccccgcccttgcccagtgctgggcggcgcgtggggggggtagggtccccgcttccccacgcggccccgcgcactccaaggaccccaacctgttaggtgagtccctgccccggggaggggcgctgggggcggcggcgaggatctagttgcgcgcgcgcatgcgcctcccgcccctctcccgggacaccagggctgcgcgtctcccaggaggcgccgacgcccctccctctacaggcgggaaaactgaggctgcggaggggacgctcttgcccaaggcccacggcgaggtgggccgaggaaggggcgggaccccggccccgagactcccaggcgcctttccagcaagcccagcgtactctgcgtgtcgcgggccactttaggtctaactgtcgcgcgtgggttagtgtcgccgcggtgtgcgcctcgagccgggcagcgaccgcgccggcgtatctgtgcctcggcgcgtctgcgaacggcacgtgtctttacagccgcgcgtgtgcccgcaagtgggtgtgcgcgccgtgccgcccgggaagcgggaggtcctgcgggcgtgcgccggacctgttgtcagcaggcctggcagatgggaactcagctccggaattaattgcttgtttgtctccggctgggaggccgcccccccgcccttccctggcgaccagttgctctgtgcctagccgggccccaaatgtcgccggcatccgcggccgcaggcagctccgggccaggctccgggtcagccccaaagcccgggtcaagccaggcgggcgcggcgggcgggctccccgtgacgcgagtgccccctgccggccgctgcgcacacggctccgagactggggagacagcgccgcgcgtcccaggcctgaggcgcactcggaaactccgaaggtcgtgacccggcggagaccaggacacgcggctgccggcacatacggtgaggccttcgcagagactcagtacgtcaaagtgaccctttccgttttgcccacccccttttacttggataagcctccccgcccacgcacgcactccccagaaagtggggtgggtgatcccctcccggctttccgggtcgttgatgaccttaggggttcgaaaacgcaagggggtatggaataaagtggcaggggctctccactctttctgagatccgtaagcctgcagtcgctttccacccagcctggggggccggaagcgcttcccctacccgtctcttcgcagcctggagaatgaaaacgggcgtcagcccacatctggatctgggtactgaggacaacacccaaaccccaccccgcactgccggcagacagcaccgcctcccgccgctccactgctccgggacacacactctctatatcccgtccccccacccacacacgcaacacagaagcacgcagcggtcgggagcaccggtcctgcgcccctggccagccacacccgcaacttcagcgcttctaccgccgcggcgcttcgggaagcacaagctcacatcccatatccgcagaacacggggtgcacaaggctggagtcacctcgggggctcacgatcagtcaggggccccgaccccctacttcgcccatcctagcaaggcgcaaggtgagcccgagaatccctgcgctgcgctctccgccctagccacagcctccgggtgggtccggttgggacacagccttgaaggcagagggagacttggacaacgctaatgggggaaagtgcggcagcgagtcccagcccgggctgcgggacgcggctccggacctgccgtctccttcccggcgcagcacccccggccgcgcgagccgcgcggcaaagtaacgggacggcgcctacgccgcccgcccccctcccgacagccctcaccttgcctcgtcgccgcaggaggtggctggtgaagcccaggatgatctccgagtccaggcagagcgcccccatctccagcaggctgggagccttgcggggcgcgccgcggggcggctcgggcggctggggcagcgccatggaagagggaagcgcggggagcggcccctagtgcctcccgccaccgccgccccgcccgcgcgttcactggccgcgcgcccgccgccgccgcgccccgcaccgcgcagggccgcccgtcaagcccccggtcctccgcgccccgcgcccccgagccctgcgctcgctccgcgccgcgcgcccccgcgctccggccccgcccgcctgcgccgacagcgccccttccgccccggcggcgagccagacaccagccacgcggactggaggtgtggggcgacggccccgcgcgccactgggcggaggttggaagccagaatcgggtcgcggtccgcgcccacctgcctcgctagcccccagacgtcggtgtctactgccgggtatccggcagggagagggcagcgcggctgctgtaaaacccttccgactggggcataatcgcagccccttccccctccaatctgtcctgaggacacggcgcgttggggtcctggcccatggaaacgctcagagcccagtgacctgtgcactccaccccgcccacgctccagagcccccgttcaaccttggcctatggacctccaaggcccaccccaaccggaccacggagcgtgcgcagcgggacccgcagtctgcgcctccactccaggatcccgattgtgccgccacccgtggccttccctgccccgaccccgactccctgagggctggaagattcgggctggctgccgggcacgacgactttactttcagggtccgaagctaggggcgggggtgggcgctctgcctgggtgcaaactcaagcccgggtcccgcgctcctcctgtgggctgccccagcctcgcgcgc

SEQ ID NO: 5895 - DNA, 1266 bp, Homo sapiens
  source 1..1266: mol_type = unassigned DNA
cggctcgggcgccaggtagaactccagctcgatgctgccgccgtcgggggagagggaatccgttgggagggacagtcgggggctggggaaggaagagcgggtgctgggagggttcaacactggcggagccccaggtggcgacgcgggcggcgagagctgctccgaggcgggggcctcgggcaggtcgctctccacgcagtacacggagcagaagacttgtctcttggcgagggacgggcgccgctgacccagcacgtccaggaccagtccgtcggcggcccccacgcgggtcctgggctccagctcttcgccggggggcgcctcctgctgttcatcccctccctcttttcgatccccagcttcctcctcttcctcctccagctccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgctcaccgtgctctgctcctcgcccatcgccgcccgcggcccgcgccgccgctgcccatccagccgccgggacccccacccggcgcccgcgggcagcgggggcagtggctcggctcgactcgcggctccgcttctgcttccgggtccttcctcctgggctgggacgccccaagtcccctccggggagcccgtgctccgaggctgcggcgcgtggggagcctggcccggcccgccgctcctcctcgtactctggcgcggcggggcaccgcctcgggggcgccgagggccgctcgctctgggctcgggcgcgcccgccccacatgcagctcggggcggcgccgcagccccagcgagccccaggcgggacagaggggtctgggaggagacggccgtcagtcccgcgccatcaccggtcccggctgccggacgcgcggcccgagggcggtggtcaaagggtcgaggggcctgtggcgccgccgcggcgcgcaccaggaggtgcagccggagcgctggccagccgcagggcccctgggggagaggccggagcgggcgacctccctctccccgcgcttcacctacagccctcctcgccgc

SEQ ID NO: 5896 - DNA, 1316 bp, Homo sapiens; identical to SEQ ID NO: 5773
  source 1..1316: mol_type = unassigned DNA

SEQ ID NO: 5897 - DNA, 10783 bp, Homo sapiens
  source 1..10783: mol_type = unassigned DNA
cgagccgggacaaaggcttccaacgggagcgggacatttgtctacatttcgctcattgtccgcagcttagcaatcggtttgtatttgtgtttgcccgggtccgaccacccaggacgcgccgacgaggggcttgctctaacctgggccattgtcacccacgtcacatactgggggcgaggcagctagggctgcagaaagccgccgagcggctcggggagaggtgccctcacccagcgctggcaacccgggggcagctggggcgcggcggcgtccgctgcagctgcgcgcgaggaggacccggtgcccgcgcgctcagcttggcccgcgcggaggagcccaggttgtgggaagactagacctggaccccgcaggggtggccttctgtgcccctccccgcccccagacaaagctccttcctgacactcctctggggcgaacgagcatcaggtagccaatctacacccctgcaccccccccccaaaaaagttttaactagaagaaggggtggcaaatgcggcgtggtcttttccaaccccagcgccgaggaggaagtgcaagtcccgggaaagttcagttcccagagccgagagtggctggaaacttcacactaacctgacttaacctggaaacgtggagcgcgtactccgaacgcacccaaggcgtccaaaaagagaccacactaaagaactcgcgtgggagaagaaaactggggagaaaacgaggcatcgtcgggccacccagcgacccccctcccccgcagctttctgggtcttcacccaggctggagacacaacccccacccccacccccgcaatcccgccccgccgccttcccgctgctccacctctagccagaggctggagagggagggggccggagagggagggataatagagggcaggaaagagcagggccgtctgccctttcctccacccggggaaagaggcccgcagagcccagaggcagcagggccagggtccgaccccagacgaagttggagctcctcactcttaccccgccctccccgggaccgcccgcaaagcagaaagtgaactgcgcgtcctccttggccgcagagaggtggaggcggggggttgggggtgggaggtggggggaggcggagtgaaggaaataaatgagtctttagcaaataaagggcggctggaagggggcgggtcgcttggtggtggctctggccggcccggagcggagctctctcctgggttttgggctctctcgcggttaactggaatcaattacttgccttgtcatttctagcactcatccttaagcctcaaccaaaatattgacctaggaggcttacagaagttgggctcttgccatttgaaccggatcttgtttaggcaaccaccaacgatggaaaggagagatttccgcagctcggccttcgccccctcccccttttccaaaggcgccacaaatcgccaattttccggcttgccgggggtgggcgcgcgggggcggggaggtaggaaccggtgaatgttaaagaggattttttccctcctcctggtttctgttttgttttctcccctcctcctccccacccccaccttttttaagatgcaatttgttaaaacggccctttcaagtgtgtggactcgcgagcgacgcggtggccctttgtatgtaaatactgggtttaaaaaaaaaaaggctcgccccgtctttgcaattaattgacacgttacacctctcatcttgctctagagggccgttggctgggagcgcggagctccccaaaacccacaatttcacatctgcaaatactgtcttcatccacttgactcccaagacccgcccacacgtggccaacctttgcgtttttaatgtctcttcccccttttttccacccttctcccgctccctctctcgctccccctccctccctctttctttccctccctccctctctttctccccctctccccgcctccccaggttcgtgagtggagcccagccttatatggactgatcgctcgggcaatggcccattttttcctcgccaccagccgccaccgcgcgccgagcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactcccgtaagtagcaaaacttggctgccgaggccgtggtcccctccattcctgcagccgcagcccgggttggacgctgggagtgaaaggggaaggggccatgtaagcccggaccccctcactcggatccgtagaaagatttttaacacctgtataggatgtcctctgccctcctcttcaagcctccttagttccgggaaagaacttggtctccaaaatttttttcaatgcgagaagttaaggagaaagagggagaagggctatacctcccaggggctggtatatgatgtcaacccggaccgatggctccagccgcagcccccggactccggccgctgggagggactggcctggcgccctggaggtagccagcgagcctcgtccgggtacgggtggagggtggggaggcttcgggtggcccgggtataaatagctcaccctgccccctgcgcgatcatagaggacgctttgtgcagtgcagggggtgtctagaaggcccgaaagcagaaacgaaagcccccaaaaacctgccttaaatggccgagccgatcaatgctgggattgtggggtatttcttttaaaaatctgcccacgtctcgccggagaggaaaccgcttaagggcgccggagcccttaacccgcgatgatcttcagtgccacttccccccccaaattctcacccacactatgtgagccccttgaaaggcgagcccctagcccccactcctacggatttccctctttaccctgggaggtcccgacgtcttcgtcaggcgtagaggaaggcaggggtcatggcaaaggcagcggggctgggctgccaggcgcggaggtccagggtcgcacggaggatccagggtgctccgagtctggtgcaggctgcgcgcggcctccagacgcctgacgcgcttctctctccccctccccccagtgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaagaaaaaatccctgccctcccgtttgtcctactgcgccgggccggaggcctgggcctgggagccgggcccggccgcccgcggggctcccacaggcggttcctctcgggcggggaggccgggggtaccggggccctggggcgggcggggctcccggtgcaggcccctccgaccacaggctgcaccccgcgcctaggattggggcggggaggagaacgctcggcctccggcctgcgagcggtcggccggaagcccagggccgcccaccctcccccgcatctcccctggtctcgcgcgctgtctgaaccccgggcggcagcgtccggctacgggaggaaaagtgacttcgggagccgcaaaggcgaggagagcaaacccccctcgctggcccaaatctatgagtggctccttcagcctgagaagctgttgaagccactacactcgatgactttcactttgttacatttgacttacctcacgctaagaaagtgggtgggtgggggtctgaggttaagactggctgccttctccccactccccactccttttcaaaatctgcgggctggtgctgacctaggagaccgctaaggctgggggtgggaacggtcagggcgcgcgaggctttggcttagggggcttgggggaagtacgcggggttctgggctcgggggagggaggggatactgcagccctccctaggatctttggccccaggaagccagggagcgagaatctttggcaatcccagcaaaccatgcctctcccttcccttacgctcccatcctttccgggcttccaggcctctctccggggactggatcccgggcctccttccctccagcgttcggcggtccgaaccagggtgtgcggtccccccaggtcagcccttgagcgtggaactgggtggattgctaggaagtagaggtttgggggtggggtgagctccccggatgggaagtgggcacacagccccgggcacgcccgggaagggcgcatccatctttccggcggggaacggattccgtcccacccttgttgctggaggaagatctccttggcagatgctggcgcacacttggccacgcgggggagcgtcttaggaagcctggccaactggaggatgagcctttctcctctatctcgcgggtttctaaaaatacttgggactctagctcagagcccagcgggtgctgcagacgctgagggactgaacgtcggcgcatttggaaattgtatctctgttctctccgaagctgcaccatcaaggctggggggttgggtggcagtgaggaggccgggcaaaaggagcggtcccagctgactttctcgctccctgtagttgatgatcaggtttaattcaatatctaaagcaaacatgattatccgtgcgaccaaatctgtgcgtcgatagcactctgcgcagcagcccagggacgcgatgacactttattcccgcgttccacaccgcccctggataattgagggctcggaagtctttctaataccccagtaaaggtcctttcccatctccgggctcatcctcggggaaagggcagtttttctaaatgctaaaaggtctccctttgttctccacactagcttggcaatgtttgggggcttatgtcttactgtttttaaaggccaacgaatttctcccaaatagtttgttgtgcaataattgaacgcccaacctgccctggtactaaccactcaacatccacttgcaacttcccctaatcccaaaatcctcttgggaggaaaggtgagggtttcaagtctcttggagcggagctgtcagaaggcctgaggccattttgacttttccaggccccagggcttccagggtgagaatgatcacaagagaccctcaggtttccagagaggaagggggaagcgtggaaggtcctcaccctggcaggcttccaccacttgctcattgaggacaaatttggagctgtggccaggaccgcgggcctgcaatctgggtgtgcgctcctgtggccggccgggagcccgggaggtggacccggcgcccgcctctctctgtcctcgggtccccatggagtcaataaaagcgcctgcggagccctgtgtggccctaaccccagcgccctgggagcgcacccggcgcggggtccgcttcagcagtctatcttcgcccaatctacagcgggcggtacaaaaccgcacaatgggaaagctgggagccggagatgttagaggcgtgcatattaaaaagggacagagaaaggatcgcggggacagagagaggggaagaaggagaaggggcccgccccccaccccccgccccaccccgcaccattcagcgcgcttatcgccggcagtgaatcccggagtcaggcagaagtctccttggggttttgttgggcctgtcactgggtccctttgtcatccacgggctccatgctggattccatatggccagctgggccgagggagcgcgaggagggacccgcacaaaacctaaattgtgtccggctttcaaaccctgtattgttgtctgtgaaaggaagacgcattaaaaattcgtgctatatctattggggaggaggctggaggaggggagaaaaagccacccctgtctttgatggcttcggagggcgcttgccccgcctaggccccgtgacactgaaagttggatctctctcattctgtctctctctctcaaaatctctctttttctctcttctcataatctcgctctcataatctctttctctactttcataatctctttttctcataatctctctcccttcctcacttctctccttcctctcttctgtctccttgactctaacgctgggatgggagtccgcgaacctgcgtcttcagggtttggctcacttgtgcgcactttgctcactgctgtgtgtgtatcaggaaactaacttctgcctgggagctctgcaccatcggaccgtcctggggctcaggaggcaactcagggtacccagggcctgggtgatgctcggtcccctacgggcttagcggctcctgggtagatgaaaatccaccccctgatttcgcaaccgaccggccccgaagcgcccgcgcgcggagccgcccttccactcaccgcgagaaaggttctgagaggccaagggtgccgctcagtcccgggcccagctagacttgggctgcagccggttccaaggcgacttgcgcccggccggaccacttggttaccaaccccgaagagctaaagacgcgcgcgttcctttgaattatgcgcggggatccatcccactggcctcttggtgcgatgggaaaccacttcagaaacttcttccaacagcgtctctccccatgttggaggagggagatacttcctctttaattttcaatgtctcctgtatcgcgtgcttacaaaattcagtaccagggagacacagcagggcttccaaggaatttgcccattttttgcctcctctaagcggtccaaattggcgcgaggcagtcggaaataatttgggtcatgccttctcccctgcaattgccaggtcaaaactcccataagcagtccccaaataaaccatatgtactaaacaaaaatagtttatgctgagctctgtggaaataaaaactggaacccagatatgttccccacaaagtcactcggcccttaatgagcagaactgagctggtggaaattccgactaatgggaaacttggatgcgccccctttcctatttagtacaacggtcatatttagtagaatcagataatttggtaagagtggaagtcccccttcccaacattccccacctcagatggggaaataacttatttccttacctattgactgttgggcttagttgagacctggtgtgtatttctcgagccttttcaagagcctggtcattgaaaagctaatccaatatttaccgagcataaggacagttctcagacgtatttattaaggcccatcgctaagtgattacttggactgaagacaaaggccaggggagggggcgtctaggcataccagatccttctcatttgggctctccccacccagaaccaggaaaccgggagcgcgcttgtgcgctgctgaagttcccctcccggtgttaagtggcgggcggattagatactgtgctgggcggtatttcaggaaatatgtacttgtggctccctgagaggccaagcgcagtgacactctaaaccgtgtcgatatatcatcttttatccaggatctgcaaataaacccctgatccccccggcgcattatagccgccgctatctcgccaaggaagcgatctgagttttattgctttcaccaacgccccgagacacacacacacacacacacacacacacacacacacactcctctctcgcactctgatttttaaaggctctattttttccctcccgaggcatcgttattaataaagaggcgaataggcctcagcgccgccatccgagcaagcggggaaatgtgggccagcagcccaggcccgcgcgcggatcccgcgtacgctccacgcgccccctcgggccggagaaccgagcgtgtgccgcgtgctgccgccgccaggaggcgcccgagcccagcgttcccgagcgtctctgcgcgcgggtccgggcagagcccgggagccgccggaggcagctgcgcatcagcggactcgcggcccgggtcggagcccggtgagtggtgccaagaggtggcggcgagtcggaaccttggggagagccgcgagtcagacggcggcgggtgcctgggaggtgcgagtcgacctgtgttcggctgtggttttcccgccatgcctcttctcctccacgtgcgtaccaccgcccgtcccagccccggtttccatcgtgtttgggcacagaccacagccgactggtccaggagcgctctggccactgggagggccccaccaggcgccagggcgcgctgtctccgcgatctcagggcccctggcggcgtcggccgcgcgggtggacgcggagagggcggtgctgcgagggcccggagagtgggtgcccgcgtggggaggcggcccgggagcgcgggagcgatgcggaggagggacccggtttggttgcaggtttccggggcgggggttccgggaaggagagaccctcgccttccgcccgccctggatccgggtcccgccggacccccggctcctgccgttcgtcgcctggaagcggggcaggcgcacagtccagacgccagggagagacgcctcgccgacccagaccgtggggtcagggcccgggaggcaagaacgccccacacacagcagggcaccccaggcaaccctcactccgtgctgaggcctcggctagggtgcaaaggtgtccgggaatggaagggacacgagggtgtggacgcctcgcactctactcacgcctggtgccttctgagaggctgggcgtggggcagagggtaggggacaagggggtgacattccttaaggtcctccccccaacaaaagtagggcctgcagttccagcttgattcgttgattgttgggtggaaccgcctcacatcaaaggcatcgtggctccaaacactgtcccctttacttttctaagcccccgcttcaaaaccagctgtcggtgggccggtgagggcgtctgcagtacccaggctttccgcggggcggcgcggttggataagaaaaggcttcccggctggggcgcgcagcgcagctcagacacctgcgggactcgagatgtctccgcga

SEQ ID NO: 5898 - DNA, 810 bp, Homo sapiens
  source 1..810: mol_type = unassigned DNA
cgagtgccgacccgcctgggcgggaccctttgagcgcatcccctccgagcgcgccagtgtctctgggagaggcctgtctgggtgagggactggacgccggcctctccgcaagtcggccggctgagggtgggggccgaggcggggtcgggaacagccctcggaccagggcccagacaacctcgcccggcgcctgcctccccgcgcgcacctgccgggcccgggggctgctagaagaggccgcagcccgcgccctccgggctcccacgccccgcagcggcgccccctcccccggcggcacggattggctgcggcgccgctccaagcccgcctcgcgctgccggcggggggcgccgcggaccagagcgcgctgcgccgccaccgccgccgccaccgccgccgccgccgccgccgccagcagcacagcgcgcctcgggctccgcgcgccgccagctcctggcccgcccgccggccccgccgcgcccgccagccccgcagcggagcctcggcccggccccgggccgccgccaccacgccgcgcgccgtactccgcgtcaagaatggggcggccaagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggtaagcgcgcggcccgccccccagacccccggggtgtcccgggatccaggtccggtagccccctccccgacccgtgcgc

SEQ ID NO: 5899 - DNA, 1142 bp, Homo sapiens
  source 1..1142: mol_type = unassigned DNA
cgcgtggagcgcggccccggggcagcggagagtggggttttaatatctagcacatgtagaccctggggcggtgctgctaggggcgcggacccgggaccaccggagcacttgcaccgcggggaaagctgacagggcgcgcgaccctaggaggctgccgcgccgcctggtgcgtgaagctccagggcagcggagcgcggggaccttgaaggctgtcgcgtgcaggcgaaggggccgcagggtggtcgctcctgggagagcagacggggaagaaggcaacgggagggagggcgtagcgcgagcagtcccggacgcgggctcaggaactggccgcgaggagcgcaatccagcaggcgcgccagggcccccggatccaaggtgcggggtcccgattgggcgcctggacgccccgtgacggtggcgccgctgccactgtcccgaagcgaggcgaggccaggcgctgcgctttcggctgcccgccccttctccccgccccgcgctcagtcccctccctccgtcccgcctcctgcctcgctccctccctcggcggctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggtgggaactttgcgcgctgcagcctcgccgggcgccaccaaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaaggtgcgggtccggcttcggttcatcccaaggggtcaccgggatgcgaagtccgggacgttcgccgccgcggtgaccccggcgggggcgcatcccggctgtgggccgaggtttctcccccga

SEQ ID NO: 5900 - DNA, 2885 bp, Homo sapiens
  source 1..2885: mol_type = unassigned DNA
cggaggctccgggaaagcccaccaagcctcacgcgtttcgctgatagatgcccaggaagcggctggcagggaagaggcggtcctgcagctcacagagctcccctcccacccccggggagccccaggccgcgctgccctccaccttcccgccctccccggcctgcaacgctcgtggcgtttttcaacaggttctagaaactccctctcactctgcccctcaagcctggccacagggcgccccgagcagggagtgtgcgggctccgggtacacgctgcgccgcggctgcaccagagcgcccacgaccctgaccccgacccgaagcggcccctcagcgggacagggtgttggcgctggcgctgctgctattgcggcgcgcccccccgctctggcccctgcgtgtcgccagggactcttgcgctagggtcagactcaaagacggaccgaggcgggtgcccacctgggacgcgtgcgtttggtggcggaatccccggggcggccggaggcggcggccggggagtcgagaagcaagtactagcgctccaggaccgcgcgcgccgccccgcgccgccccgcgccgcccctcggtccagagcccccacccccggcctgtgagcctgcggcgctggtggagcccggctccaggaagaggagctcacccggtcccccctgattggacagcagcgaggtcccaccgggcgcctccgcggcttaaaaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgcagagccgggagcctcatcgcagcggcagcggcagcggcgggctcgggccggcctcgggggctgctcacccacatgagcatccgcccacccggcgagcccccgagcccaggcggcgcggccatggccgagctcaagtcgctgtcgggggacgcgtacctggcactaagccacggctacgcggcggcggctgcgggtctcgcctacggggcggcgcgagaacccgaagcggcccgcggctacggcactccgggcccgggcggcgacctccccgcggcgcctgcacctcgcgccccagctcaggcggcggagagcagcggcgaacagagcggggacgaggacgacgccttcgagcagcggcggcggcggcgcgggccagggagcgcggcggacgggcggcggcggccgcgagagcagcggtctctgcggctcagcatcaacgcgcgcgagcggcggcgcatgcacgacctaaacgacgcgctggacgggctgcgagccgtcatcccctacgcgcacagcccgtcggtgcgcaagctctccaagatcgccacgctgctgctcgccaagaactatatcctcatgcaggcgcaggccctggacgagatgcggcgcctggtggccttcctcaaccagggccagggcctggccgcgcccgtaaacgccgcgcccttgacgcccttcggccaggccactgtgtgccccttctccgcaggcgccgccctggggccctgccctgacaagtgcgccgccttctccgggacgccctccgcgctttgcaaacactgtcacgagaagccgtgaccgcgcgggcccccggccctcccgcacgcgtcctccgatcgcccctgtgactgtctctctgcccggacaggaaaggcctggagggaccctgcagaccaggaggagggggcccgacttcgcttccagcctgtgcgcggtggacagtttagcgcagcgggaagcgccaaggccgtcggggcgcgggattgagctcgagagccggacgctggactctgcgcccgggaactcgcggcacccactgggtattgtcgggacccagcaagtctaggaacgggggtgggtagagcatccttcgggcactgccgttcgtccccaaaagaagaccaccgcggggtcccagggccacggcgaggacgggcactggtcagattccggacaggcggtcctggccccgggcgcacgaaaggtggagacgaagaaaagccggacttactggctcctgatcctcttgcagtgggcctcgcgctcccgctccagccggcccttcgtgctaaactgcagggcagtgctctgttcctgaggacgcgcgtggccggcacctcccacctcggtgactccgagactccgcagccctgcggagagcccacgatggccgtctgcagaggagctggaccgcgggcgcaggaagaccccggggaaggccttttccaagtaggagtttgttctatttatttgggaattggacgccgtcgccggctgcctcgaagtctgaggaatttgtcccctaaatgtcccctggcctcccccccccgccgccatccgctgcctgggacgtccgcggggtggagttggatggagaccgctttgcgggccctctgcctcggggggctgcgtggaggagggtcctcacagcccgcgccctacttaaccctgacggtcaggggagggccccgtctagccctggtgtccagcaaaccccctccccaccgatcccctctcccttccgagggaggaggccgggctacgggtgagtaagctgctgcgggccccgtgccccgccgggtgtgaacggagatgcgctgcgcagtgcccgtcctgcgcagctcccagctctgccaccatccgggatccagggagccgggcagggtgcccccggggacccatctgtccgcgccggtttgcgccccgcggccccgccgcagtatccggctttattaacccaatttcctcggctgtcggtaatgccaaggggagagggccgccgccctgcaacgcgcctgtctacagcgt

SEQ ID NO: 5901 - DNA, 1460 bp, Homo sapiens
  source 1..1460: mol_type = unassigned DNA
cgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggtgagcggcgggagggcggcagagaagggggagagggcggggggggctcgggccggggtggggcggggggggcaggggtcccgggccgcggggtgcgggggctgcgccaaaccctcgcggggcgtcccgggcgcacggagggctcggcgcccacccgcccgacggcgttccactcactggcgcccacggcccgcaggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgt

SEQ ID NO: 5902 - DNA, 1560 bp, Homo sapiens
  source 1..1560: mol_type = unassigned DNA
cgttctccaaccgaaccctccctcctgggaaccgcagcccagcgcggtaactgagttaccgcaaccgggcggtggggaggaagggtggtccaggaaaccggcgagggagaaaagcggtggaagggagagtcttctccctggagcggccccagcagtacaaagtgctggtcacagcgccccttccgcccctagattgacgagcagtggcgtggagccagcgcggaggctgccccctccccctcccgagcccgcagcgcggagcgcggtttagcaccaacggagccgggggcggcgtctttgggatggaaaagggccaaaggggaggagtggggtgggggtgggggtttcactggtccactataaaaggaccgctcggctgcccggttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgt

SEQ ID NO: 5903 - DNA, 5118 bp, Homo sapiens
  source 1..5118: mol_type = unassigned DNA
cgcccctcctcgcgacagagctcccgagcccagcgcaggccagtcctcgcttccccgcggcccctggctcccctgtcgccagaacgcgccggcgccagtcggctcacttggcgtcggaggtgaggcgcggcaggctgccggcgcccatagccgacacgtggtggtgcggcggcggcacctggcacatgctgcaggggcagggcatgccgccccagtgctggaagcccccgctcgccccactgccgccgcccccgccccccagcggggcggccgcggcagcagacggagacttgagtaggccgtgcggtggacggatggagccgaccgacggcagcccggatccgggcagagaggcgctggacacagccgcggctgcagcggcggcagcagccgctgcggcggcgggcggcaggatggggtggtgcaccgcggggtgatgtgcggcgtgcgctgctgctgccgggtgcgcggtggcggcgggcaggggcgcggagtgcgccaggccgccgcaggccgacgggtggaagccagcgtggtggcccccgtagatctcgctcaccagtcgcttcatctcctccagcgagttggtgagcatgaggatgtagttgcgcgccagcagcagcgtggcgatcttggaaagcttgcgcaccgaagggccgtgtgcgtacggcatgacctcgcggaggccatccatggcgatgttgaggtcgtgcatgcgcttgcgctcgcggctgttgatcttgagacgcagctgctgcagctccggctctgtcatttgcttcttgtccttcttggtggacgacgcagccgccgacgacgtagacgacgaggtgctggacgaggatgacttgaagccactgcctcctagcttgtccccaggatgcgcgcccgcagagcccatagcgccgcgcagctcggcgctcagctccggcgggcagtcactcggggtggacgaggacacggtgcccccagtgaaggcgctgccgctgctgcccttactccgggccggcagaaaaaggtcatcgggctctggcgacgacgggcggctggacaccaggctggcgtccgagtccatggccccaggggaagatagtcgtcgcagctttcgcagggtcctccttccctcggacccgaaaacttccaggagaggaggagaaaagagagagaatgagagagagagagagggagagagagagagagtgagtcagtgagagacagaaaagctgctcccgcctgcaccgcagtaccacagcgcggggtcccggcacaggtggcccgtggctcctcgtccccctcgctactatctctggccctccttttagctgcacgcgggtacctataattaagctctctctatctcccctctgctctcatgcaacaggttatttcagggagcgttggtgaccctcggggtgcgggtggcattctagaggcttcgggctttcagttaggtgtgggaaaactgagcccccgggctggaataaacgagtgggaagtgagggcctttctttggggagaatggagatctagatagagaactaatgatttggttcctcaaacggatccaccttatctccatcgacaccacgcagcaaacacacgcacacgcacatgcacccagagccggcgcggggcccagagtccatgtgctgcatctggagaccacggggagctcaccagctgactggggcttgggcagaaagagctgttgtcgctccgacttctcgcttttggtgagggagatgcagcggtgagtgtggggaggacagaagagcaaagtcgctctggagaaatggcccgcagagtagggatccagaccccctgtatcggagcattctgggtcacagccgagttgaggagagtctgtccctgggatctaggctgcggctgctgtggggcggggacacttactctggatgcgatttgaggagctcgctccgaaaagcctcaggggagaacctggcaccgggcgctggtgtcgcgtcgatctataataagcatccgcacctttaggggctcggccggtttttatagcccggtggcagcggcgacggcggcagcggtggcgggggcgggggcggggaacaatgtgcgtgtcctggaggggctgcctcgccaatgagctgggcccgccggggggctgggaagctgatgtcatccgggctaattccgctcaatgaaactcgccaggccgggcacacgcctcctccctgcgcacaaccaatgggcgcccgtggccgggagattcttggggagggactggaggagggacccgaggaggcgagggggaggagaagggcggctcaagggggatggagggagggctgagcgcgcttgggaccaagggagaaagggaacgtggtcaaatttctgtaaaaaatacggccaccacagagtcaggttgggggatgggatggtttggagactctgcagagtctaacaaactaacctgatgccccacgcagccgcaccttttgggatgcgcgcggaaaaccctggcgacccaggatccggggctggggtctcctccctagctcttcctctgtctggtttcccgccgcctgttcccatctcactggtttcatcaacacgtgggcatttggcgccccaaatgtaaacgatgcccaggcacaaagtccccactatcttggtgctctactcgcgcgtctaggagatggccgtggctgcagctccgacggcagccggtagcgcccccagctgggggcagggacttgaggggtagagggcgggcaaggagggaggggacggactccagaagagtgttttgaaagaattcacaactctcctttaggttgaggatggtgtgggtacagggacgagttatttccgcacggtaaccgcgctagcacaagggcagggtcgtgcctgtagttaaacacccctccatttattagcaggggagccggatgatagtaagtattttcagtgtcgtctttgtgatcaccacacgccttggggcaggggcaacgctggcatctgtagtccaagcagggctccgctgtaaaaggttagcaaagagccttccgtcccagtcgcctgctttctggaactgcaaagagaagtttcaggcctgggcaaggcttctccacgctgtgggccagacagcgagatggaaccactcgcgaccgcgttgggacatgttttaccgattgcaggctggctctgaaacctgaaaactcttgacgatgaggaattaagcccgaactggagaagcacctcacggaggtagctgaggtacggatgcattcacccattttacagatgggaaaagccagagaccgtgtgcagcaagcctacagaaaaaattgctaagcctttacagagcagccctgcttggactacagatgctggcgttggcggttccttatagtacaggcagccacctgtctcccccagtccctaatctcttccccgagctgaatttctcacacccatacatttcgaattcagacatttgtttctgcagatctcggatgctagcacttgacactgtgagcgcacgcgcgggcacacacgcacacagtctcctagggagtgtgaggaacgtcgggttacttccgttgttggggaacttttactgtgcaagtacggttttaaaaacaagcaaacaaattagcatagtaaataattggtcttcaagtagcaaagttacaaaataaacaaatacaaagagaaacccacgttattgcccctagttctgagatatgtctccctctgcggtctccgctagaagcccagcccgctctcgccttcgccccagtctcgtgccttctggagcattatttttcaatccgcgtgtttcccagctggctctgcagccatccgttaaatatgtatttaaaacatgaagaactgaagcgtggtgttatgtcgtccaacggttacaaggatgacccataaccgttcaattagtagaatctgtcactcggacgacgcagggagcgggggggtggggatcagaaagggctcgggcatttgtagatgcctccttcgggcctaccccgccaacagcagcgaggccatgtgtggtgcgcgctgtggggccaccagtcggggcgcggagttgtgcgcctgccagtgtagctaataaacaccagcaggcgcaacgtgcgcgctccttggttgcagccgctgaggttagtccagccgccggcacgtgtcccggaacccggtttctttttttgttgctgcccactggtgtctgtcctgcgaccgacttgcggcggtgagagcaagcggtctcaggttctttgcgcgctcggtccagtggctggagttgggagtcaggggtgaaagtcgaggggcccgtcttggcatggcgcgagtctagagcctggaaggcaaagtcggaagctctgtgctgctgctggccccttcttcacctggcaggcttccctcaacatcctcccgtcgccggagtagcttgggaggtcggggaggtctgtgtcgcccctgggctcccttggccctggtgccaatcggatgctgagtacctctcggtgtgtctcctatgcctccccaccccgtcccaggaataactagaaattagatcccggtgcccaagcttgccctggtgcgtcctggaggcgtccccaggacttgtccgggtcctgcgcccggcgcccggggtgggcgacctgggcgggtcccaggcactgcggttcccaccagcgcgcgcagctggggccccttcctggggaatggagtgctcatttgcagaggctaatgggccccggctccgggagttcctggttggcccccgcgtcctggtgctgttggcctcctccgtgtttttccctcttctttgtgtttctctcccacaaaagaccgggtgcgtgtcggggccggcctttgttggaccgccgggcggcccgggaggagcccgtgccaaaccggcgggctctcgcggggctccagggcgcagacctcccactgcttcccgggtccctcccgggccttctttctgattctctcccttcccttctccgagttcctgctcacattcaggctgcgtctcggcctggctgccaaacagaacgacgttcttgcgcagagctgaccaggggtggcggcgggaggcaaggctcccggcaccgg

SEQ ID NO: 5904 - DNA, 1423 bp, Homo sapiens
  source 1..1423: mol_type = unassigned DNA
cgctgcgggacaggttcctagagatcgctccgggacggtcgtgacggcccccgagggacatgagagaagaggagcggcgctcaggtaagctggattttgcggtcggaattcgcgtagaaacgaaaacttctggaaggggcttagccccgagccccggaggcggacaagctgagcctcctggctgcaccctttggaggctgctggttgcagacgccgtcgtctcccaagggcggctgtcaccgcgtgcgtcggtcagaccaggccgcggtgccctcggcatccccgcgtcccggcggctgtatccggctcctccccacgaccgaggtcccgggcaccgcgcctctccctccggacgctctgcgcgacgtcgtcccagttctcatcagcatcgagggcagtccgcggtcattttataaacgtcttagtgtcgcaaccgttttcacttttactattttcaatgtttgcaacggttttcaatgaggctggaaaaatatcacttctcgctaaaagcgaccccgagttaggaggagcgcgcacccccgcggctccccctcccacactttccctcccctgaccccctctcctcccctctggtccttcccttgctcctcgcccctccagtagtcgcgtgctgggttcctttcctgctggggccggactctctcctccggccgtcccagcctctgctcctccgcctccctcctcctcttcctcctcctccgcctcctcctcttcctcctcctcttcctcccggagccgccagccgcgtcctaaacccgagcagggcgcgtagtgtccaaacctgcccgcgcggcccgcgctcttggccccgagggcgcgcgcacggacacgcgagcacacccacacccacgcgcacacggacacgcgcgcactcgaagactcccgcgcgctcgcacccacgcgcacctggccacgcgcgtgcattcccgcccacgcgtccctgccccgcccccggcgcgcactccgggttcgcaagtcgcgcgtcggggcggccgccctgctccgcgattggcgggagccggagcctccctgaacccggcgcccacaccatgggctgagcccgtcggcgccgagggagttagtgcgacccggctcggcgcgcacggccaaggcacgcgcgctggcacacgcgggcgcggacacgcgcggacacacacgtgcgggacacgccctcccccgacggcggcgctaacctctcggtaagtccagcgccccacgcgacctgcccggctcccacgctggctacagcggctgcggggacggggaggaaggcagcggggtggccctaggggctcactctgcagggctcttccgacggcgccgggacaggtggggcgtccagcgccgggagggacggctcgccagtgcggggtcccagggaggcgcgtgcagtcgggtgcgg

SEQ ID NO: 5905 - DNA, 1384 bp, Homo sapiens
  source 1..1384: mol_type = unassigned DNA
cgagcgccttctgaagtgacggggccgggacgcgcagggaggcggcccaagaagcgcgccctaggccagcccagaatgcgctcggccgcgactaggacaacggcgggtggggctgggggcggctgccgggcggggagcggtcccgcgccctcagctacccctcaagagccgttgtttccctaacttcagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgc

SEQ ID NO: 5906 - DNA, 1361 bp, Homo sapiens
  source 1..1361: mol_type = unassigned DNA
cgccgaggatgtggcctccgccccccgcagccgccgcaggagcttctgcctctaaagcggcaggcaggggtctcagcgggcccacttcaacctgggaaggccggtgcgtttccccacagaccccgcagggcgtttcttctggggaccactgaagccctggcatccccaaccccagcccctccgcgccacgggaaacgaagacgacactcttttgaacaatcccggatgtgtcaccacagaggggcattctacactggcccctaccccaacccccacctagcacattgcttgcccacccctcaaaccccgtgcggattgcggtacctagccccgggggaccctccagccctgccttcccgatccgcgtaggtgcgtccgtccacctaagggtagggaggcatgtccctccgggtccctccggccgcatggcttgcctgcccccctggtctcccttctccgcatcaggaggggcgtgagatagctaggtcgacccccaccccggcagtctgcggcgatcggccgccccgagcgcagcgccagacacttgggttggggggtgtcagcctgacgcgcaggaagggcgcagcggcgggagggggcttcatttcagatctgggaggcttgcctggcgccggccctcgcccgctctccgtcggtggaggtcgcggctggcggagaccgccaagccagaggaggggatccgaggtcccggctgggcgaaggttctggagggggagaagacggccgaggcgtggaggggcagccgcggcggggcgacccttacctgctcactgcggggcctgtccgtggggccggggcagactccgcaaaggacgcgcagcctgcaagtccgcggcccgcgcggcgcggggatggggagcgtgtgcgccgaggagcgcgcgccgagccgggtctccgcgcctgtgtggccggctggcggccggggtccgtgtgtccctgcgcggcggcgtgtgcgtgtgcgcacgcggggaccacgctcgcccggagccgccgccgccgccgtcactccctgcccggggccgagcgcagcgccccctttgcccgccccgcgcggcgcggcagtccagcttggctccgtcctgcgggagaggcgccgcctccgccgcgaagccaggctgggcgctggagggaggcgaccgaccaccgcctccccctgctcacttcacaggctggggagggggtgctgcaggccaatgagcgcccgggggcggggttagatcgagggcggtgcggtggggggcgcggtggggggcgccgggctgctcaacccgaccccacccgcagcacagactggagcaggagctgcggcgggaaatcccagcggcgggggtcgggggcgc

SEQ ID NO: 5907 - DNA, 1175 bp, Homo sapiens
  source 1..1175: mol_type = unassigned DNA
cggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagcgcgcgccgcgccccggcctcttggagcccacggacgccggcggtcccccgcgaagcgcgccgaggctgcctccatgttggccgctgacgtgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgt

SEQ ID NO: 5908 - DNA, 1087 bp, Homo sapiens
  source 1..1087: mol_type = unassigned DNA
cgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacggtaggcggcggggggggcgcgacagggcttggggtgtcgaccggcacaggcccctccgtttggccccatggaccgggtctctggcgggtagtgggaaccgcgcgtggcgcctccctgcaggttgctctttgccggggctccggagctgccagagcagcaccccctggcccgcgtcggatggggacctgggctgatccttgggacgcctggatcttgggccaacttttttttgcggggaacgggtgtaggggagtcattcctggagcgatgtagggagaggcacttcggagcagcctgttgggggtcgtaggctctgcaggctcagaagcgcctaggaaggacgcagaggtgggggagcttggaggctacaggtgggtccaggacacactgccgctggggtcctcggaaaagaacaggagggagctggtcgcggagtccaggtttccggggtgcgcgcggcctgggtggggcagggtggaggcggtgcctgactgcccctctgcgtgtgccctgggaggtgggtttgctctggggacagaggtgctggacgtgtaggagcagacatgccgcgcgctccgaggaagcgccggaaccaccagaagcacagggacgcgggtgccga

SEQ ID NO: 5909 - DNA, 693 bp, Homo sapiens
  source 1..693: mol_type = unassigned DNA
cggcctaggtacccgggcagagggatgatcccgcgctctgcgaaaagcaacaggcggctgcaccttaccttgcgccagtcccgggccggggtggctgctccatcctcgtggctcagggaggaggcgttgggtgcgtatgcttaggggtgtgcccgctgccagggctgcagcggccgccacctccaaccagctgcaagccgagctgcccacctgggaccgggccggcccggcgggcttggctcccggcgaaggcggcggcgttggtgcgcggcggctggggcgcgggacgcaggcagtgcgtggcgcggctggcgtcttcgggcgccgccaccgagcgagggtgcggccccgggcggccgtgcggggcacgacttggctcgcgttgctgcggcggccgctgcagaccctgctccaggcgccgtagccttgcaggaagagcagacaaagacaggagagaggcaaagcgccgcttgcccagagatgcagtcggctcagtcaatagagggaaatcgcctccaaacccaggctgggaatgagggaggaggggcgaggcggctggggactagaaaaagcagcagggaattaacgtgacagtcagagcccagccagtgcctcgccggcgctgctctctcgcctcgcggttgcggggtccggaatggagagaggaggcgggggctgagcgttggctgccgg

SEQ ID NO: 5910 - DNA, 5065 bp, Homo sapiens; identical to SEQ ID NO: 5878
  source 1..5065: mol_type = unassigned DNA

SEQ ID NO: 5911 - DNA, 307 bp, Homo sapiens
  source 1..307: mol_type = unassigned DNA
cgttttgggggcgacatcgccggggaacttgatgatgggcgacggcgcggcggcggcgtggctcagcaggcagcccaggagacagagcgccctcaggggacccgtgagcgcgccccgggccattagcgcctccatcgtagcgctccctggccccgcgcgtcgcccgggggtcgctggctcggtgcgtgtggccgcctcgccgcctggttggagcctgctccgcggcgcagggctgcgctccgagggtccgctggctcggtggcctggggtttgcccggctcagcggctcatggtccggcccccgcgc

SEQ ID NO: 5912 - DNA, 1563 bp, Homo sapiens
  source 1..1563: mol_type = unassigned DNA
cggtgctcccgcagcccggacgccagcgccagggactcgccacaacctcaagtcctctcccggggctgggctccgcacacaaacaggtagcacaaaactaggacttagttggggtccgcaccccttcctgctcagacccgagccgccccagtccccggccgccgcgcccggagtccgctccaactcggaaagtggcggccggctgcggggcaggcgggcggtacctgtgagcagctccagccggtgtcccagcaccttcatctcggcgcccggcgcggcccggctctgggtggcggcgtcggggcagcgcgctcggccgagccggggagaggagcgcgggagacccggagcggagcggcaggagagcgcggagcgaagcggcaggagcagctcacagccaggagcgctctcccgcccccaacgccgcgctcccccctccaaaacggtttaaaaaaatccaccaattgcatggccgcgcacccccaaaaaggcacccgccgccacctggtcccggtgaactccaggaggcggaggaagggcgcggggtgggtgcggtgacaccgtgggaggtggtcccccgtgcccgccgcccgaacaaagagaccccgccgcctccgggcgtcgcggtggggggtcgcggacggcggctgggggtccccagcgcggccgggaaggcgaggaaggagagcgggagccgcggggaggagggggcgccgcccccgcggaggcgaaatggggcgggagcgagtcggtgcgggactcgcggggctagggtcgtgcgtggggctggggtcgtgctcggggctgggctgggctgggcggggacgcgcgcagcagccgcggcggcgagagaagctggccctgggctcaggggcgagggcgccgccgactcaccgcggagatgcggacgagacagacgcgcaggcggggagcggggcttcggcgccgccgacgcgcgggtgcaggtgcgggcagccaggagcccctccgcgtgcccgcggctgcaggggcggaggccgggctgggggcggtgcgccgcgggggcgtgcccgcgtgggtttggcgggtgtgggcgctcggcccgcggggcggtgccgggcctggggctagtcccggacggaccgcggtccctcgcgcgtggcttccgccttctgcgcggctggggtgcccggtgggcgggcgggagggcgagcggggaccgcgacgcggagcctgggggacaccccggtcgatccgcgcccccgccgacttctcacccgctccgccgcgcggactgtgctgggtgcgctgcgaggccctgcccgcccctccaggccccctgtggccgcgcggcgtcgggttcccgggggaggggacggcgctgccgtagtctttgtttagactcccaaggggaaccttagacctgcagagacatccccatcccagcgcccctgcgcctgctgcttcgcgctacccgccgtcgccgcctgggaaccgagggagaaaagcccttagggtcgggaagaaccaggggctcaggggcctctggggcgtcgtccccctccccccgttttcggagcccga

SEQ ID NO: 5913 - DNA, 512 bp, Homo sapiens
  source 1..512: mol_type = unassigned DNA
cgacccgaggctgtctacccggcctggcatgtcccggcgctcctggggcccctgtactccgctggttcctcgctgtggtgtcccgcagcccgaccatttctgtgcttctaggagcccaccctgggcggcagggaggcgttgcgtggggctcacgagttccacgctgtcatctccaccagctcctacctcccaggcgcctgccctcccgcactgtcaggttctgcctccgcagcatttggcagatctgagcccggtccctgtcacccctccgcgggagcctcatagtgaccctggaggagaagcagcaggagcccacaggccaccgcgctcggccgcgcgtgaagtctgtgcagccgcatggtcggctcgctggtctcggttctctgccgacggacacgctgctgttcacccagaggctgccccgggtcggtccagccgtggatccagtgccttgcccagcctcggagtttggactgggcagggagtcggcggggtgcgctgacttgggccgg

SEQ ID NO: 5914 - DNA, 1070 bp, Homo sapiens
  source 1..1070: mol_type = unassigned DNA
cggcgcccggggctcgactggtgggaggggtccggcagaggccccgcctcgagatcccagcacgccccgccccgctccacggtgtagcacagactccgcggagaacgcgagcatggtcggaaatcatcgcctttatttcttggcgggtctcgagggaaggtcgggaacgggcgggtcctgctggcctagagggcgtcaggggcagccaccggcggctcgggatcctcctcgtcgcgagcgcgggggagctcaggtccggcctgccgggggctgggtgaggctgcggaccaggttcctacgctcctcgcgtccgcccgcgtctgccctaggcctccaccgcggcttcctctgtccccggggccgccctgctccccacagaccccactctcgggggccgctcccaggacccccgcccgctctctcctgactcggtccctgcccgccccgcctcccttcctcgggctccctacctctccctcgccggccccgacctcgggggcgctccggacctgctccccgaatatctccagctccgccttcagcctgcggagaaggggccgaggagacaggaggaagagagcgagagtccaggggacgaggaggaagccaccgagacgcggagacccgacgacgccgagggaggcacaggccggggaagcggcagtcgggggcggagcgggggacctgggcgggttcccctccgccctgcccctgccctcctcgcccactcctcccttcccctctcacccgtcattcaccgccatggcgccctcgacctcaggcggcgagtgcagccgccgctccacctcccgcagcttggcgcgcaccagcctccctgtcggtgggcgggcgtcaggggcagggccgaggcccgggcacatccccctccccccgcccacctggcgcgggaggctcactctccgagagcagctgctccttgcttctctccagggcacggatctcccgggccagtcgctgctccagcatctgcgaggacaaagaggaggcctccccgtttggccgtcctcttggctacacggcccgcccctccccttttgtgcttctcgcga

SEQ ID NO: 5915 - DNA, 766 bp, Homo sapiens
  source 1..766: mol_type = unassigned DNA
cgggaatcccacgcccttgcaccagcccgggggctcggacgagcccgggagccgctggtcgccaatcaccgcgcggtggagaggcgggcgctcggctccggcgcgctgggggagccagctggcgctgtcttccccatcgcctcagacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcaggtgccgccgagcggagctccgagagcgggtggcagggggcgcccgacgccagccccgccgcgcccctcacgcgcgatgtcaccttttctcttgcaggcgctccagctgtgctgcctctgctgtgcgtcggtcgccgcggccttagccagtgacagcagcagcggcgccagcggattaaatgatggttcgt

SEQ ID NO: 5916 - DNA, 363 bp, Homo sapiens; identical to SEQ ID NO: 5689
  source 1..363: mol_type = unassigned DNA

SEQ ID NO: 5917 - DNA, 2919 bp, Homo sapiens
  source 1..2919: mol_type = unassigned DNA
cgagcgcgcaatatgagtctcaaaggccaaactccggccagtcaggagccggaaggctgagcccggctgacctgactttgagcttccccggagttatctcgcataggcgctcgctctgtccaagggcacgcgacgccagcgggcagccggtctccgtgaagaatggcctctaaacaacttattttacctcgttgtaaagagagggataaaatgggctttccctctccacggatgcccagccttctgggcaggcgcatggccgggcggcgcccagcccgcagccccgatccggacaccccactgcatccctcccttcccggtcccttccccgcacgggcgcccgagagacggacaaagagttggggccaagtttgagcgccgggcacggccaggctcagggaaggaaggtccccggcagacacctgggtaccagagttggtgcgaggaggaaaagctgggaggcgaattcacaatcctgggggtggagggcaggcaggggaggggaatcaggccaatcccagccgagtgagcccccagcgagctggggctccggatgggaggcctgtctcgcgctccaaagaaaagcaaaccgccctcccaggtccgcccggattgccgaagcccctctggaaaaactccttcccctcttacaccaaactttgcgccgggcctcgttccctcccgggtaggcagcggcgcaggaagggttaagccagcccgtcccagctgacagtcagctgattgggccctgattgacagctccgaaaagtttccttgtttctatactattatgctaatcgcggccgctctcgccgcctcccattggcccggagtgccagtcaatttctcatttggacctgacgtcacgagtgctataaaactcagcaattgctttaaactcttcttgctggatcagaggctttaaaatcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgg

SEQ ID NO: 5918 - DNA, 2267 bp, Homo sapiens
  source 1..2267: mol_type = unassigned DNA
cgggcgggggagggggcctgccggcagagaaagtgcggagagggcagagcagcggctcggggcgtttctgcaggtggacatgaaacgcacgatatgcaaatgaatgcaaagtgtatgcaaatgacctggccccgggacccgcgggaagcgagggcttcgcatcggacccgcccgggaggctgagcggggggagcgcgacccctgccggccacgcacggaggtggccccgggccgggccaggcgccgcgctgggggcgagcgcggggcagggggcgggggcggcggccgaaggagcgacctcccccccaactccccacctccccaccccccccacaccccccaactcccgttcagcctcccgcgcggccgccagaagccgcggttctaaagctgcgaggcccgcggccgccgactgctgcgaggtgggtgtgcgcggcctgcggagggggagagggtgggcgcaggcgggggccgccccccagagccgcgccccctccacggcgcccgcacccctcaacctcttcgctcgcccccgcctgcgcctccccgcgccgccccccgcaggaggcggcgcgcccgtcgccccctccccgcgcccctctcccctctccctgctcccggcgctccgcacagccccggcccccacggccagttcttagggcgccgccccggtggcggaggcgttgggggcggctctcggcggcggggagcccctctccaggccggcgccccggggcggagctgagcgccatgggcgccgggcgggaggcaggtggcgcagcggcggcggcggggggcaggaggcggaggcggagcgcgcggggcgggggccgcggggccccgtgagactctcgggcgagcgcgcggcgttggagccacaggcgcggcggctggacccggcgcgggccgcggaggccggagaccgccccgggcggggtgcgcgctttgttcccgcgcggggtggccggagccgagtccccggcatggcccaggcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccgtaagtgccgtgtccgccccgcgcgccgccgccgctctaccccgactccgcccgcggctgccgttcccggatctgcgccgcagccgcgccgagcgcacgggccgttttcaaagttggtgcccacggcagggtggagccaacccgcccagcgcccacccatccgggctgagcgcagccccccgtgagcagagcctgacctgcgggggctgcggcgaaacttcgaggggaacgacgcgcccgggcgctgggagtctcgcgggctcccctggggccgcccggttttcctaacaaaggccccgcggcccgcgtgacggagacccgggagtggggaggccgagggcggccctgggagaggcagaggtggcggcggccggtctggggaggggggtccagagctccctcctgctcctctccctcctgcccgggtccccggcgctgccccgcaggctaaaggtggtccgcgctgggggtcctggaccctgcctggcatgcggtccctggggtcctgacggccgcgggcctcggcacagccgggtggcagcgatggcgcgcacagcctttgggaagcgtccatctgtgttgggcaggccccgagccaggctgtgggaacagcggggagggaggtgtgagcctctgtggagggacagatggctggaaacgcagccctagacggctgacttcacttacgtggagcagaaggcggccaggctggtggcggcgactcagagccgctgggctccgaacacactgcggggctggcgctcccccgcccctgcgtccgcccgtgtgtgctggggccgcggccgggctgtgcccacccctcattcaccctgtgggctgaggccggctgacttcaggcccattccagggcccaggaagaaaaacctttcccttgaaaagagagcacgtcgcgtgctcctgtgggtgggggcttgtcggtagctgtcaggcttgtggccccagccagggtgcggcttctgtgcgtccggcccgggtgtgcgtttcctctcctggacgaggaacaggaggttcccagggcagccacctcggcggacgggtcggccggggataaggggcgggggccggtttttcgg

SEQ ID NO: 5919 - DNA, 265 bp, Homo sapiens
  source 1..265: mol_type = unassigned DNA
cgcagcctgcgaccgatggagcaggaggcgcgggtgctgagagctgcgggcggctttggccgggcccggcgcctgctggcctccgcctcgtgggtaccctgcatagtgctggggctggtgctgagctccgaggagctgcttaccgcgcagcccgcgccccactgccgaccggaccccacgctgttgcccccagcgctgcgcgccctgcgcggacccgcgctgctggacgccgccatcccgcgcctggggcccacgcgagccgcga

SEQ ID NO: 5920 - DNA, 374 bp, Homo sapiens
  source 1..374: mol_type = unassigned DNA
cgaacagcgttctgaaacgcagaaacgtgcccattcgaattgttaacgcgagcgcagagcccactgacaaagcaaaataagacaaaccgggagtcagaaaactcagcgacccacaggatccaccgtgatgtttcccacaaatgttaccgcgaaaacagtcggacttgaaaataaacgcgacctacctggttctcggaaggggagaaggatccgggcgaaaggcgtcagttctccctcgctcgccccgtagacgcagcgcaggccccgagctcccgagcggcggtttcagaacccgcgggtcacccgggagctcctcccgcagtaccagccgaaagctcccagcgccgaggagggcgggcggctgccctccccga

SEQ ID NO: 5921 - DNA, 1133 bp, Homo sapiens
  source 1..1133: mol_type = unassigned DNA
cgaacagcgttcttaaactcagaaacgtgcccattcgaattgttaacgcgagcgcagagcccactgacaaagcaaaataagacaaaccgggagtcagaaaactcagcgacccacaggatccaccgtgatgtttctcacaaatgttaccgcgaaaacagtcggacttgaaaataaacgcgacctacctggttctcggaaggggagaaggatccgagcgaaaggcgtcagttctccctcgctcgccccgtagacgccgcgcaggccccgagctcccgagcggcggtttcagaacccgcgggtcacccgggagctcctcccgcagtaccagccgaaagctcccagtgccgaggagggcgggcagctgccctccccgacctcgccccgcccgcgcggacgcccccggccccacgcggggaccaccccgggactcccgccggaccccgcgcgcccgcggccaacctgcgtgcacctgcgccccgcgccacgcccccggcgccccacgtttagccctcactgggtcccgcttcttagtggctctaagccccgccccctcgctggtcaccgcaagctccgcccctcgaggccccgcccctgcaaggcccgccccttcacgactcaggccccgcccaccacggccagcccgggtctaggccccgccccgacacgactcaggccccgcccccggccagcttcgctcctcgcgcgccccgcccagcaatcctcgctgaacccggcgcggtttccccagcgctgctccacgccgcagtccagcgcctggagtccgcgcgccccgagcccctgcccgctcatgcgcagctgggtcacccaggtgcacccacttccttgctgtcccgccgccctccctgcccccaccccgcctaggccctgggtgtcccttctccatcctccctggcgcctctgcctcaggccacctggccgtcctcctgggctccccgctcgggggcggcccctggtccgacggtgccgcagacgcgcgcgcacaggccagtcccgcggagaggctgctctcaggggctaggcggggggctgagtcagaggctggggcctgccaggagcggggcggcctggggcgcagcagcattggagctgaaggcgagggcggcccgcgccgg

SEQ ID NO: 5922 - DNA, 2358 bp, Homo sapiens
  source 1..2358: mol_type = unassigned DNA
cgggacccgctttccaagcggcgcctcctccattttccgcgaaccccccggcggggtctgtgtggaccaagggagatcagagaccccccgccgccaccccacccaggcggagacggcccacccgaacccgcacgggtccttccttctccctggaatttgcagctggccctttccgaatgcttgctcccctcctctccccacgaaagaacagtgtcctgggactcggggtgcggggcagccgggttcgctggagctgttcagtgcggggaagagccgtcgagactgggagaaggggcgctggccagggaggagacggggcagggagcggactcgcgatccgtactctgggcggcggtcctcgcgtcccagccgcgtctcccgatgacctccagccgcgaagggcgagcgggcgggggctgggctgcgggttcgggctccaggaggcctgcggggccggggaggggcgtggagtggtccgaggaccggcttggggactgggggcaggtgcctggacggacgcgggccgagcatcttccccgggggcgggcgcagtgaaaacaccttgggaggcggcgccgcgcggctgagcgctgctgccttgggaataggacggcgctcggcactgcgagctgagagcactttcataaattttgtatgggaggcgctccgtgagcgggggcggggagcggagcgagagggagggagctagagagcaagggagggagggaggaggagaggagggggaagccggggggaggaagggaggcgccccgctccgccgatcgctcggtcctgcaaacgcgcgccgggcgctttccccggagctcggcggtgcgtgcgagcgcccttttgctgcagccgcggcggcggtggtccgagggggcggagaggagggggctgcggccggccggccagggggcggcgtcccccctcaaaaccgcctgcgaagtgctccgggtggcagaagcaggccgccggctccgcggagcaagccgctcgccccggggctgagcaagcgcgcggggctgccgggcagcaccacggttgcttgcgggcgccggtgccctcggcgcggggctggagctcaccatgcccctgcggggccgggccaccgggcacgagcggatccccggcttgcccccgcctcgacgcgctcggattagctgcagctggcgcccagggatttgaatctggaccccgggagggagtgcgcctaggccgacctcggagcggcggccccgtggccaacatgcttcgcaaaggtgagttggagccgcaggggcaagttgaagttgaatgcgctccggaaagagccgcgagcccgggcgccgcccggcgccggggctcccggtctgggaagtagcccccggcgggctggtgggttttgccgggcgcacccgccgaggggctgctgctggggctcagctcccgtcagcggccagttgtgagacacggggttttctccatggatcgagtggccaggcctagagatccggcccggaggggtcagtcggagaccagagtgagcggccggtggtggaaggggagccggcctcctgggacctttgctttgctgggataaagttttgcacttgcagcctccattccctgcgcgggcacacgcccttgcttctgccgctttgtggaggccgagtccgcacggcgcccccgtgcagccagcggtcagtgaccgcgcggcccgggcgctccccgcgcgccctagctccccagacggggcccggacgcggacgtcttctctgcagttctgctctgatcgctagggatgggctctgggcacccagcggctgagggtggggagcggccagcgcctgatgtccagttcctcaaactttcattatgctgggagcggagggacgcgaaagccgtgccgccagtgtgcgcgaccggtgcacagctcaacttgaggacagctggcttcgcgaccaccgtagctagacgccccagcagcccggcccggtacggagcgcggcaaagttggtgcgggcaccggggaagtcccgccgcgcccccacgtggttgccacgcggggcgccgtcccccgggccctgggagggcaggtgatcacgccgggagcccacgggccccgccaccagctgttccagcctctgcgtctgcctctcccctcccaggcccgagcaggctgtggcgccccgccgggatcccccccgcgcctggcccggccaggaggctgagaagccgcggcgcctgcggctggctgccccggccctgcgggagcggctgaggcgggagctcaggtagccgaggggcctgatccctgcgctccacgctccagccttaatccgcccctgtttccatggcaacagaccgaggtgtcgt

SEQ ID NO: 5923 - DNA, 1050 bp, Homo sapiens
  source 1..1050: mol_type = unassigned DNA
cgggcgggcagctgcggctgctgaggctcggtggggcccctccaagacgcgtgtccgcatctgcccgccgggcgtctgcggggtgcagcgtccactggagcgcgacagcccctgggacagaggaggacagtggcctcgcttccctgtgcgatcgcccaggagctccgggccggagagtgcgagcggggaaaaggggtcctgcacctagagtggggcggacgtggcgaggaagccaggggggaccgggaagcgaggcccgcggtgcggagggcgcggggcgtggggggacacctctcggagagacaccggaggggcggaagtaaggagatggaaaggagagggagatcggggagatagacctgagagacccagaggcctgcagagagtttcatccgggacccttcagagcccaggaaagagcagatgcggacgcgggagggcgccttacgccaaagcgggcagcaccagtgaccaaaacacgccccgcttggcagccccgggacgcacctctgcctcggcagcgcaggagaggcttggacagcgcgagatgctagggcccaggctgcccctagagggctggcccgaagcgttggagtccaaagacgcctcccaccgccgccgggtggcagaattgggggcaggcgcgtcccacagaccccgaggggtggccccgccccagggccgcggggaggcgcccccgtgcggggcggagttgtcaccgccccctccccaatccccggggactgtggccccttcttaagcccgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtcagttgcatctccaggcagcccttcggacacccggcgtcctgtgcccactaacgggcaccgatcccgggagccctgagctggagcgcacggatttcgcggggagcacagctctcccggggcgcgcgc

SEQ ID NO: 5924 - DNA, 1731 bp, Homo sapiens
  source 1..1731: mol_type = unassigned DNA
cggccggccttagctgtcactcaggcaaccccggagccgccgcagacaccggatccactggaagggggcgaagccgcggggaggaatgggggacactggggaaggggcgtcgcccctgccgcccccgccctctccagtgccattgggcggctgctgcggagcccgcgccaccttttctccatcccaccccgcccgtctggccccgcctggccgctggtccgcgccccgctgcgctcgtccgggggctggtccggcccgggcctttgacgtcaccagcaagtttgctgccctcggcgtcccacgtgtggcggcggccagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggctgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcacggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgctccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccggtgagcggggcgggcccgg

SEQ ID NO: 5925 - DNA, 3535 bp, Homo sapiens
  source 1..3535: mol_type = unassigned DNA
cggccgcgccaggagctgctggtgcagtccaggaacgcagtgtttggggccagttgcggcatttacagtgggctcctccggcagcccgatccgccgggtcaccgccccgggccctgtgccccctggacccgggagtcctgcttgtcagttcagggagatggctcgggaggacgaagaacctcccgcctcccgcggcccagccaagcccttgcggccgcccgggtccagccgccatgcgtggccgctcgcagcgcagcccccgggcgcaagtcggcagccgaacctcccgggctgcgctgtccgctgcaggcgcgcggcgagggtttccacgcgacttcgttcttcattcagcgttttttagtcaatcaaaaagaacgtggcaggtggagggcagccgcctaagagactgcgtgagccttcctgtggggatttccatagcttgccccaggtgcttcaaaaccgcctgacattaagggttcagtccttttcctgccagttcctcccaacccggcccaagtgtgtctgatctcagaaaatcctaggctgcctcggggctctggcgggttccacctggaagggcgctagttatagcctgccgcctggccctggaatcaccatcccaggaggagggggagtggtggtggtagaagtcataacaatacaatcggtgacaatagctaacgattagagaggccctcacgtgcctgcgaggcaccttaccgtaccagcgcattcactcttcccatccctgcccagaacctgcattattcccactgcacagatgagagcaccaaggttcacgcgactagccaggacgtgaatccaggcgtcggactccagagaccccattcttatccaccagtgtcccgagaatgggtcacagcccgggaacggtgggaaagatgactgtcacggttggctaaacctcgagacttgggcaactcctgacaataataaaaaaccattaaggacaaaggggaaggggtaggacgaggctgggaagggagccgttttaatccgcggggtcagccctcttttattctccaacccacccaggtcccgacagtggggtgggcacagggagaggggttcagttatcttctcctcttttgttttcccaagtcttgagcgtctgtgaagctaattgggcctggaggggtgtctgaatgtcgtgctggctggggttacgggtggagaccccaacgaaaatgtgggggtcgttacctgggcccctagtcgaagacagttatcggaggccgaaatctagacctcctgcccactcgcgccttacccgaagctcgggcaacccaacagctcaccccaaagaccagcagctgcggaaagcagtgggcagaggtagtgattgtgaccccggggccactgtccctttggaacctgacccgcaacccgactcgagaacagaatttccggaagccgcgacctcgaagcaaccctcatttctcaatcaatgggccccgaatattctttgctccggacgtgtaaaagccccgcggagacacgcgtccttgctttccctatcccagcaccgagggcagggaggcggaaacgggcggcggtgcccggaggcccggacgccttcaaagcctcgcgccgctccagccggttgcagtgcgcgcctttgcccgacagggaccagcacagctccacgctccgcgcgccgcccgcccgccaggcggaggcgccgggccacccgcccggctcaccctcccgagcccaggcggctcgcgagcgaggcgggtctgacacccttggggttccggtaaccaggcggactgtaacaaaaagttaacagactctgcggcctcgccgggacgccgcggcccccaccccctctccccatctgggaagcagaagctgctctagaagttccttgagggcggagaccgaccaaaggggctcagaacattcccagcgtctcgggctccgggaggaaaaaatttaaaacgagtcataaaatacgattcgagtcggatacccccatggttagagggtggctcgctttgctgagggcggtctcagtcgctgcccttcttctttgcggcgaggtcgcctgatgaattcaagggcaccagtgctccgcgagaactttctgtgggttgtgacgagaaccaagcggagcgcaaccctcaccgcacccggacaggatgcgctgcgcaatctgccgtagtttccctgccctaccccgggtggtccgaagctgtaaccctgccaattccctatcatacgccatgtctcccttagctcagggtctgaatcgacgatggagaccctgcccctggcagggaaactcaccggtaccaagcgaggcccttgtcgtagctgcgatcgaagaaatggggctcggcgcccacggcgcgcacgtcggggtgcacgcgcagaaactccagcagcgcccgcgtgccgcccttcttcacgccgatgatgatggcctgcggcagctgcttgctcccagacccactgaaaaagctggagatggggcttggggagtccggcacctcgggactctgctcctccgggctcgcagcgccctcggccatctccttgcctgaagccagtggggtggctggcggcgcccggaacggcagcctggggggcgtcccgtccggagctgtggccagggctggcgggtcgtgtgcggcgcgggacccagagcccaggagcagcagccccggcgcggcggcgcaggagccggcgcacgagtacaggaacatatagagccagacgcagagcatggcgaagagcagcgcgagcttcctcctcaccggcggcgggggcggcggcggctgcggtaggagccggccggggacatcgaggcaagatctgccgccactcaggcgctgccccatgcgctgcccgcgggcgcggccagggacatggctcagcacatggcgtgggtcccgccgggcagtgagcgcagagagggttccccggcacgctggacgcccgggtggctcggtttattgcccccgtgtgcccgcggccgccgctgctgctgctgctcttccccaggtggcggcggcagctgtagcggcggcggctcttgacatgttgcccggcaggagctgcaactggaacggaaagtcgggacggcggtaactgctgggcgagggtctgctcccggggcgcgacgacgcgctcggggccaggaggacgttgcactctcgcgccctggccactctagactgtgcgcaccgccgcacgccggggctgcctccttgcagtcctaagaactgagcctcgagcagccccggcacttccccgcagaggctgcagaggcgaactgcgcaggaagagagctgtggaccgaggtggagtgggcggtcccggccttccagagtgacgggctgctctacctaccaaaaaccccgaacgccatgcaaatacaggcgcttctccgagagctcagcagccaacccgctcccaggacgagggggtgtggaaaggcttctgggcggtgtagggcggtcaggggttgctattggcttcggaacaaggggcgggcccaaaggggcgg

SEQ ID NO: 5926 - DNA, 2896 bp, Homo sapiens
  source 1..2896: mol_type = unassigned DNA
cgacccccggccgcgaacccaagcctgccgccttcgccgcgcccaccccccagccccctccctgccccggcgccatcccaggtcgacgtctctaaccaaaacaagcccctcccccaggagccccctccccctgcccgaggcccagggtcagcagccccaggagggacctcctccccaccccactccccccggcagaggtgcgagatttcattgtcagcctggccactcgaccgcgcgtgagactggggcgcagggcaggggggccactgggcaggctctcgtgcggggagtggggaggggtctccaggggaagtgtttgaagccactcctgcagctctgtccagatccggaagccgccgaggaagggaggaaggcgggggtggggagagcgcgaccttaagcgctggcgggcggcgaggaggggccgcagcggcccgaggaagcgcctggaggcgtcaggggcgccgagtccccagggaggccgcgctctcgggaagtttcccatcggttgcccggagcaggatcggacgcgcggatcgccctccccggtccgaccagcttcggggcgcagattgcgaacttgaacagaactccttccttctctggcatctctcgcctccccatccgtggccaccagccccgccatctcagccccatgccttccgccaataccacattcgtcaagaccgctcaccaatgctttgtggaggaaaggggaggggggaatccccagcacaaccaaactgtggccaaaagcggccaaaaaaaaaaaaaaaaaaaggaaagaaagaaattccttcttctgagaccgattccctcaaccagcgtggaaaacccccaaacatgcaaatccgcaactccagccaagatcctggcgccgcgggaggggtgtccgcggcgggcggcgaccccagcctgcagccccggactccgggcaggtctgcgcgcggcggcgggccgggggctcggggagccctggcgcccacagcagcccgccgaaaacacaaagctccgccgccaacaatacctgcgggctcctcctgggtctcccgggcgccggcgctgcgcgtctcgccgtctccctttcccccgccgtctctctcctctcgcgcacgctctccctctcgcctcttccagaacgcggtggccagatgagatccttgggagaaacaaatgtgagcgctcgcacgaatcctttctctcgccagccgcttgcaacggccccaggctcgctcctttccctcgcgctcccgcgcgcgccgcgcctctcgcgccccgcgtttccttcttagcagcccctgcgagcgccctcagtagccattattcacaggccgccgggggtcaggaggtaattagagacggccccgtggccgcatccactcggtaagcgcgatgctggcgcggggcgcgcgcggggaggggcgcgcgatgagggggcttggctgcgcgcagcccgcgccccagactcgggggaagggaggaggaggagggggcagggaaggaggaggcgggcgggggggcgagagatgagctcgggaagggagcgggaggagggggcgccggggagacgctcccttggctctcaccgcggggcctcggggtcacccgctgcgaggctccgacgcgcttagggacggggggtgtgagtgtaagagtgcgcgcgcgcgcaggcgtgtgtatgtcaaagatagaggaggggagggagggaacgctttaatatttttccagtgacttacgagcctgcgggtgaggtcttggctgtgcgtttaggtccgtgtgtgtatcaatgtggctgtatatttctggtctgtcctacgagtgaatgtcacggggcttgggggggggggtctggatacaagctagtgaatgtgtttctgggtctcagtttgactgaatgatgtggcgctgcgtggggctgtgtctgtgcgattgtttataggggggttgtgtgactccgtgaggtactgcgtgggtgggattgcgcctgtgtgcggttgtgtgtatatgggattgtgcctgcgtggggctgagtgtccagagggcagttgtgtggccatgtgggcctgtttgcgagtgggctggtgggtgtgtggggccgtggggctgcgcatgtaggggcagtgcgcctgtacggggctttgggttaacttaaagggctgtggtgggtatctgcaggcggttgcgtgtgtggctggatctgcgtggggtctgaggcctggcgggtgggggttagtcctcctggcgtcggggatcgcaccgcggcagaagagccgcttaaggcgccaacaggcagcgccggggtcgcggcgcagcgcgacgtgtagtagcggtggggcgtagagagaaggcggagaagaggggggccttcatcgcgcgcctcccctagccgcatcagagacgcagcttggagatcctgccgcttgccggccccgcggtcctagaagcacagggtttgggggaccctccccagctgggggagacgcctactggccgggaaggcagcgagaactgagactcgatgattctggcgcagcacagaagcatgcggcaaggaccgccaggagaggtgggtcgcggcccggagacagccgagaactaggccgagacaaagaagagcgggaccggggaccttggggccaaaccgcgcctctaggtttcccggcggccgaggggagcgcactcaaggccggcgcgtggagcctggcggaggtggcgcgggcccctcttcgctgcagtcccagcagccgctccagagccctgggggcacgtaattaggcgccacagggcagggccacggtgaggggggttctgagtgcagctggcgggcgccgagccccggggctgtgattgagcgctcagctggcccgcccctctcccggccgctcaccgcccacgc

SEQ ID NO: 5927 - DNA, 2567 bp, synthetic construct
  misc_feature 1..2567: note = Description of Artificial Sequence: Synthetic polynucleotide
  source 1..2567: mol_type = other DNA
gygttgggygatgagggatygttgggtaattgggggtataggatygggtttygttgggttyggggtagaagygtygaagtttygattyggaaygyggtgattttattaaygtagaagttygygtagtygagtagaggagtttttygtaggygattttyggatagaygtttttgygyggttygygtggtttagtttygttttaggaaatttttygygtagttttygttttatgygtttttatttagttttttttyggggtygttttttttttaaagtagtttttygggtttattgggygttttygtaatygggtyggaatttygaayggtttygygtgttattyggttattttggtaatattattyggyggygttyggyggtttaattttagtttgyggtttttttygagtttttygtaaggtggggatygggaygygatyggggatggggaagggggttgtaggaggtttygtttgygttgtygtttttgttgggtatagygttttttattattygyggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagygattyggtyggygtygggtgygtgtgggygygtgggtgttaggttgggyggaagyggygtttttttttatgttgtaaattaagggattttttttygtttttygtaagygggtaayggggtgtatyggtagtyggaaaggggygttygttyggagtttggagtagtatygyggttttggyggggagyggtygggtttttagggtttygygygttyggggtyggggtagyggygttygttttagtaattygggaagtggggtyggttaggygygttygtagttttaggagttagtagygtagtgttttggtyggttgtttyggygygtttttttttyggggttyggggygaggygtyggtygttgggygyggygggygygggggtyggggttgtyggggaaagttaaagtttygggtttttagygagagtttygtaggyggagttggaggaaattatagttaaatagttatttygttttttttttttttttttyggggtttyggggttgagtaggggttttttaggtttttagttgtygatttagttgtttgygggtgattttygggttygaygggygtttatagttggygggtagttggggygggagagttggggtttttggggagtttyggyggttatttygttgtaaatatataygtatataygttygtyggygygttyggggtttgtttgtgtttgggattttagggttagatggaagagggggttygagtttagagttygtggtgggggtgtttagaaagatttttttyggtaaattttgttagttygtyggggttttygggtttttttggtttttgtttggggtggtttagggtttattagagtatagttgtygtttttgttgggtaggttgtttttgagttttygtttttttgtyggggtatttatygagttygtgtatttgggtttygggttggaatygygagyggggaggatagaggtggaggyggagagtagygtgyggttttygagtttgtttattgggatgtattgygttttygygttggggayg

SEQ ID NO: 5928 - DNA, 573 bp, synthetic construct
  misc_feature 1..573: note = Description of Artificial Sequence: Synthetic polynucleotide
  source 1..573: mol_type = other DNA
gygtttaagaagtyggggttttttttggttaygygttttygggggygttygygttttttaggttttggttgtttgggygtygattttygggaygygtyggtygatagtaggggaggyggtagtagggatygtagtagttttygttttygtayggttygtygggtygyggtgagtaaggygggtaggygyggygggaggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggttyggyggatagyg

SEQ ID NO: 5929 - DNA, 383 bp, synthetic construct
  misc_feature 1..383: note = Description of Artificial Sequence: Synthetic polynucleotide
  source 1..383: mol_type = other DNA
tyggtttttatagyggtttygggttttyggatggygtgayggtttgtggggtttgyggggtgygttgttttyggatttgyggggggaggyggttgagttggyggygttygygggtttagtggtgagtgyggygtttttaygtttagttygaygttttyggagyggtygtygygtaggggtgggygygggtttttaggagggagggyggttgtgaaygygttttgtttttygygttttygtagttttttgygtagttgatgatttttataattagtttygttagttttattttttgtggatatttgggtaaggtygagtyggaygttgttaygttygtygttayggtgggtgtttgatttygtttttgtaggagtygaygggyg

SEQ ID NO: 5930 - DNA, 853 bp, synthetic construct
  misc_feature 1..853: note = Description of Artificial Sequence: Synthetic polynucleotide
  source 1..853: mol_type = other DNA
tygttttaggggtatttygtaggygagatttttgtagattttagttaggaaaygttagtgaayggtagygtagggaayggggyggggtygttggtttygtttatygtygyggtgttgggggttgggggtggttttygggattggtgtggagtttgggtttgatttattgatttggttgagtggggagattggagggtygtattyggagttgggttyggggaygttygttggtgggaagggtgtgygygygtyggaggtygyggttgattttgtttyggygttgttaggtayggtattagttyggatagtattattttgtatyggtagagtatyggtayggtgtttatygtggatttggtttygygttaygagtgtgtygyggtggtgttgtattygtygtttatttygggtatgygygtygttttttttgatattaagaygatttattgtttygaygttttttttaagtgagyggtttgggyggggayggaggyggggyggggayggaggyggggyggggttygggtygggygttaagttttattygttttaygtttttttygtagtatygagaaggtgttttagattaygtygttygtgtttattatttayggtayggaggaygaggtgatygatttttygtaygggttggygttttaygagygttgttttaaggyggtggagtygttgtgggtggagggygtygggtataaygatatygagttttatagttagtatttggagygtttgygtygttttattttttaggagttgtttagttagygygtttagyggyggttttaatyggtyggattttagtaataaggyggttttyggattttatttygygtyg

SEQ ID NO: 5931 - DNA, 1062 bp, synthetic construct
  misc_feature 1..1062: note = Description of Artificial Sequence: Synthetic polynucleotide
  source 1..1062: mol_type = other DNA
tygggatgaatgtagttayggaaygygttaatgtaggaggtttttaggatattttgagygttygggagaygttaggygyggtagygggtayggatagyggaaaggggygygatttygyggaatttttyggtagggtagggtttttgggtggtttygggtgtttagaggaaggggtgggttyggggaygyggagggaaattggggaygyggagggaaattgaggtygyggaggaygyggtygttggtagttygttgygtttgtyggtttygygtgggtygttttattygggaggaygygggttttttttgtttgtagygttttygtygtygtygttttygtygttttttttttttttttttattttygtygyggttttygtttttttttttttygttttttattgtttttttttttttttttttttatttttttttttttttttttttttttttttttttttttggagyggttggggttgyggygtygttgttgatayggatyggtygyggtygttatygggyggaggttgygyggygtagatttagaygggyggtttyggagggygygyggygatggyggyggygggtaggyggygggygyggygggygaggggttygggttgagttgygggtyggttyggatggygggyggygygggttggtygggygttttygyggttttgttgygtttygtgygtygtttgygygaggtgttygaggtgtgyggtygygatttygayggttttttgygygtggagygygtygyggygttyggattgygtttyggttagggygaggaggtaagttggttygattttagtttyggttyggggattttagtttagtttygtygttttttttttagttttttygtygggttattygygtggttygaggyggtggttttttttttaatttttttttttygtyggagtttaggatttyggtttttttygggtatttttggtttagtygggttttygtttttygtttttyggygttygtgtttygagygttaygygttaygtttagggtggtttttgygtttatttttttttttyg

SEQ ID NO: 5932 - DNA, 918 bp, synthetic construct
  misc_feature 1..918: note = Description of Artificial Sequence: Synthetic polynucleotide
  source 1..918: mol_type = other DNA
tygtygtttttatagygygtttttaatatygttgtttttgtttygygttttagagygtttttagtttttttttttattttttttatgagtggagtygggtttggggygttttaggyggtgaygatttgtagaagtttttgagaatgtaagattttttggagttttyggttygttagggtygggtttagttaggaygtttygtttagatttttttttagtttggggtgggtttaggttygtttgtttttattgttttgtgttttaggagttttygttyggagtttagattyggtgttygaagatgagagtgtygttttttttygtygggtgagaagttagtttaygtttygtyggttaggtayggtgtttttyggggygttttaygggaatttttgtgtttttatyggygttttyggyggyggggtagttttggygtttttttttygtttttggtttaggttyggttygygggtgtagttttttttagggttttttttttttttygggtygygygttygtttygtatygyggyggtttttyggtagtgtttgtttttattggaygtatagtgatygtgaygggtayggggygygagtttttattattataatgggtgtgtatggygyggggyggggggygttgtyggtttygagygagggaggggagaggagggggtgygttygtgttttgttygtttygagttttygagttygygttttattatygtagygagtygtttttttgggtygtttttttgttttttttttttattygttttttttgtttyggttgttyggagatatgtttggtggygatyggggatttagagttyggtagtygtttttgtttttgtttttgygatttttgttttttttttttgttttttygygtagygtttttygtygyggaaatttygyg

SEQ ID NO: 5933 - DNA, 865 bp, synthetic construct
  misc_feature 1..865: note = Description of Artificial Sequence: Synthetic polynucleotide
  source 1..865: mol_type = other DNA
aygtgygygttygtyggagattagggatgaggttattaaatgattgtttyggttaatttttatttygtttttattygtatygttttttttttaattgatttaattttttaattttagtttttygtttttggtatyggtttttttttaagtttttagattttaattttggttttygattygtttygttatagtttgggaagygggagaagtagygygygtttttttgyggatttttttttagggaagattgtggtgttagttgtttagggggattagggggttatygggatttagygtaatttttgtttygttttttaattttyggaagygttaatagtayggtttttaygtaatgtygggtttttaagtatttttaattygtatagttttyggggaggtygygtagatatyggggttttttatagtttattattttggtgtttgaagttattttggagtttttatygtaggggyggggattagtgttaatgggtagyggggtttggtttttttaattagtattttagaaagagggtttaggggygggggygggtggatagggagggaaygggtttgggtgaaaggggtttgtggagtttaaatttagtgaatagggttttaagtgtygtgttaggaygaaaagaaggyggaggttttgggataggagttggttygggggtygggggaygtttatttgygtttygggaagtttttagtttygggyggttttagygtagtygggygtttagygtttattgtttgttaatygttagttyggtttttaaagyggtaaggttttttygygagggggyggaggttyggaggagaggggaggtgaggagaaygyggaggtyggtataattyg

SEQ ID NO: 5934 - DNA, 408 bp, synthetic construct
  misc_feature 1..408: note = Description of Artificial Sequence: Synthetic polynucleotide
  source 1..408: mol_type = other DNA
gygttyggttgttaggtaattyggttttyggttttttayggyggttttttyggtgtgttttattaagagygatagggttggtgattygaggggygygtgygyggtygttagtttgggatttgtayggatttttttttttttagtaygttygttygggggttttttttttgttaygtygttggggttygttygttatttatagttttygtagagtttttygggtatatygyggttggtygttyggggttaaggatggggygggagygtttatttattttygygtyggtyggggtatttaagaggygygttygtagttatayggygtttygtttttygtttygaaaaagtttttgtttttttggygyggtgtggygttttygttagtttagtyggatttttttygtttyg

SEQ ID NO: 5935 - DNA, 2245 bp, synthetic construct
  misc_feature 1..2245: note = Description of Artificial Sequence: Synthetic polynucleotide
  source 1..2245: mol_type = other DNA
ayggtttyggggtttggyggggaggtttatygttgtttagagggttyggtyggtygggagggggygttgtgttttttttaygttttgttygygggtttttagtagygttygtygygttgtaaygtaatgygygttyggtttttttttgggtagygtttagtgttygtttgttttgtagggtatygtygttttttttttattttggggtttttaggtttaaagggtttttagatttagttttttgtttgaattaaagtggttaggtatttagtttgtaagatgaataaatgaaggaaagaaggaaygaatgaataagggtttattttgtagagygttygygttttagygygtattaggtatattagtgttaaaggtgttgggggtygggtttagygttyggygyggttggaatgggggyggygaggagttttttttagttagtygtagggygggaattgtttaaaygtaggtygtagttttattgggtttygyggyggtttygtttagtagggatygttttgttttttagtttttaatagtttygtttttataaatttatttgagtattttggtttaagttattttagatttttgggattttttaggtttygatttyggtygggygggaggttgattttttatygyggttttttttttttattttyggttttttttygggttgyggyggtygttattgttgttagygygtttygaggattgtygtaaatttygggygtagggaaaggggattttggyggygggatatagagagygggtygggggaaggggagggaayggaggaggygaggaggagttgggagggagtygaggggygaggygyggaggagggatygaaggggagyggaggggagagggagggggaggaaggggaggggaygagttgggygagggggyggggagtygaggygaggagyggygyggatygtgggggaggtggygggggygaggtyggtaagaggyggtygygggtygggttgygtygggaaayggyggttagattttttygggaaggggygagygagagtygggtygggtygggtygggtygyggggtygggaagygtygagtygggtatttttttattaggtagygatygaggagttyggtygtttatttygtgtygttygagttygtagtygttygtyggtttttttgggatgttygtaggattygggtatttaggayggtagtygagygagttygaggatgggagggtattygtagtttygtttygttaaggtaatagttygtyggttatttttygagygttggygttttyggtttttggyggaygygggayggggttgggttgtgggtgtgatgggggygggggygttgggagagtygtgtttaggtyggggaaggttgggtttyggggtagtttaattttttggatttttggagttagggttgggtaggtagggggagatttaggtgagaaaagaaatygtggygaagtygtygggatgttggyggaggagggggttygtttattygggtagtyggtttygygttaagaatygttttaggttttygggtagaygtttaggggaggggaggttttattttttaygttttttttgtagatttyggtttygggattggagattttgaagyggggtttttatttygttttagygtttttaaatagtttttygatttygtaygttttygttttagttttgggagygygttttgttttttttttttygyggygagttgygagttyggagagatgaatgtygttygygtttgygagtttttgattaatatygtagtttygggggaggagayggtgtttttggyggtagtttttgtttttygatygyggttgggagygygaygttygtttttygagtttgggtattygygattttygygttgygyggtygattttgygaygyggatygggygttggagtttaggaaagtagttagatygtaygtttagygtttgttygttgaagttygtgggyggtgggggyggttygygggttgtgtgagttagggaagggtygggaggtyggtagttyggttygtygttygtgttaggygttatttgtagttttaagygttttttagagygttttggttttgtagggtataggygygttygttgtagtyggtyggagaggygggtgggtttttgygttgttgtygggatatttygtttygygttagtttgggtatygttttattyggggttygggatttygtagggttyg

SEQ ID NO: 5936 - DNA, 2972 bp, synthetic construct
  misc_feature 1..2972: note = Description of Artificial Sequence: Synthetic polynucleotide
  source 1..2972: mol_type = other DNA
gygggtygtagtyggagaggaataggaatygtagtggggaygttttggttttygggtttatagtattygggayggaygygtagtagygygggtygggaattgggtattagggygggatgggtgagaggttttaagggataaggtagggagaagygtagyggggtgyggggaatygtaygttttttttttgtttttgttttttatttygaggyggtagggygggygggygyggtttygggggtgggygggttgggyggggyggaggyggggtygtagtattggttttatttagtttttttygttygtagttagagygagtygagtygyggttagtttyggygggtagggggggygttggagygtagygtagygtagttttattagttygtaaagyggatygagttggaagtygagygttgtygygggaggygggygatgggggtaggtgttatyggtygygttatggaygggtygygtttgttgttgttgttgtttttgggggtgagtgttagtyggagggggttygttttttttttygggattagaatttygagaagagtygggygtygttattaaggaaatagaatagagtattggggttttagatattgagggtgggtggtgggaaaggatttttgatgtygggattaygaaggagggtttagggttttyggagygtagaggygattttttagggtggagatgagggtaagatyggagtayggatgtyggtttttaggtatygtagggggyggtgggggagttgggaggggttttttaagagggggtatggggtttttygatgtttaggtttttyggaagaggatattygaatgtygggatttygaagggattttttttttagtatttyggtttttggagagtygtgggatagaattaaggygagagaaggagggggaattggayggggattagagatgagaggggygagttgggttggggyggggagttygggaygaygggatggaataatggaggaggtyggagggattggaggtagaggggattyggtaaggataatggggatyggttagataatgggggggaggggygtyggagggagaggttggggagygggagagaggttgagaagtgggttagggagggtagaagaggggygayggygagggyggtagagagatggaagtagaaggaaaggagatagagyggggygyggattttgaagtggtyggggtttygtttgttygttgagggatagtgagaygagaagagagagtagaggtttggatatttttagygtttgttttygygtttttgttygyggttttttttagtttyggaattggggttgyggatttaaggttgggaggggagtgtttatttygtyggggygaattygttttyggggtttttttayggtyggygggttttttygaygygygtgtttttayggtttgaagtagygtagyggatygygagggayggagygggtgtgtttttattygggttggyggtggttaygtttyggggtgtagagygtyggggygtattaggyggggattttttttggtygygygtagttttggttaygtaggygggaggyggtaggtagggggygttgyggggygaggtaagtgtagttygtygttgtttgtttgygagtttggggttgygygtygttttttatttagttgygygattygagygtygygtttatygygtttygtgggttttygygtttygaagggtygggattyggtttgagttttttttggttttyggtgtaagtygttgggtatttaaygagaygggggygttyggaygtttyggattttgtagygyggtatttygggttatygattyggtaaaggtyggygggtttttygggtggttygaygagattgttagatgtggtttgttttatggttatgaatygaatgttttggaaggtttggtaayggaggaggygtttttatttttttygttagtattttttattagagtattgygttttaaatttyggttttatagatayggagattgaggttttgagagtttaaaygatttggttaagattttatagtaagttgggttagagtygtggttagatttttygatttgatttttagttyggtatttttttatttttttagggggtagtygttgttttagttyggggttayggttgygttttttagtagggyggggggggttgatattgtttttagagttygtyggyggtagagtttgygggtgaggtgggtagagattttgttygggtgygggttttagttygaaagtttagttttagttttttggagttgttaggatttgtggttgygttyggggatttgggagygatygygggtaygtttgttgattaaygtygttggttagagaygttgtttagaygygggtgggygagygtagattaggagagyggggaggagggatyggattttagaggggtaaygatttgggtttygggtttgggtaagagygagggttttygygygaagatttaaggaaggaggggagttgggygtggaggatttgggygtttgggaaggtgtatttygataggaatttgtygtttgtagtttttgyggttttygttttygtttyggygygyggttgttyggtttgggatggttgtgygyggttygagtttttttttgggtygyggtgagagagagagggttgaaattagagygygtttyggygggtyggttggygggtygygtyggtaatggaggtattttgttatttagaygtttgtaattagagtygtygggttggttaatgygtttaatagggatggaaygagggtagtaaatgggygtgygtgagyggtygggttgagttgggtggatggtggatggggaggtagtttygygggggaygggtttttatygtattgttttagtttagtttggtttaagygtttygttttttttttgggggatygygtggggaggygggaataatyg

SEQ ID NO: 5937 - DNA, 1026 bp, synthetic construct
  misc_feature 1..1026: note = Description of Artificial Sequence: Synthetic polynucleotide
  source 1..1026: mol_type = other DNA
gygggygagtggagtgttttttagatttygyggattygaygggagggattttgtaatgtttaattagaatyggttgttatggygatagtttttaggtagygtgggttgagtttttygtaggaataaagggtgggtygtygttggattttgygygygttygttattaattttttttttagattygagaggggyggygygtttygttttygggtygygtaygtyggtgttyggyggygygtaygtttgygggagttttttttaggtaatttagtgttgatygttygtgtyggtgyggtygttaatygtttttgtyggagttttaggtttaaaagtagttttttattttttttgggttttttttaatttttttttyggtttgttttggggtatgagtagygatggtyggttgtatttttgaggagaaaatttatyggygttttttggagttatttttgggygagtttygyggatygtgyggyggyggygagtyggagtyggaattygaattygaattygaattygaattygagttygagttygagttygaatttgaattggtagaagttgaggyggtygaggtttyggtagaggaattyggggaggaggyggttayggtagtygygatggaggagggggattaggagtaagattyggagttygaggaggaggyggyggttgagggtgaggaggaggaggagggygyggygayggyggyggtagtttyggggtattyggtygtgtygtygtygtygttttagttgtygtttttgttttygttttygygatygttgttagagygtattattygygaggaggtggagggygaaagtttggatttgtgtttgtagtagttttataaatagttaagtagttgggtttggttggtggtgggttygyggtttttatygygtyggtttyggaygyggttttttyggttttttaaattgtttttttttttgtttttttttttygtattygygtttgtygtygttgaaagygttttygttgttyggattygggyggtyg

SEQ ID NO: 5938 - DNA, 10207 bp, synthetic construct
  misc_feature 1..10207: note = Description of Artificial Sequence: Synthetic polynucleotide
  source 1..10207: mol_type = other DNA
gyggaggyggtatagttggagttyggattgtggtaygtygttatygtgttgtttyggggaatttygattygttttttgygaaagygttttygaaygygaatttagagtttgtgaaygygtyggtaagttttttatttttttatygtygttygtygtaggtgggttygttttaggggttttttttgygttttatttygttttttaagttatttagtygatygtttygtttaygttttygtgattttagatatttataattaygatttygtttttatgtatatttaaygtaygayggtgtatagaygtgtatttgatttttgyggattaggtgttttaagygtatagyggttattygyggaatygyggttyggggttagtgagtygtttgtagtttttygggttaggggattttttagaatttygggaaagttattygaagtttattygggatgyggttttggttttyggtygygtgatttygtttttaggtgtagaaygaygtttttttagggtttatagttgttaggttgggttttgttttygtatttttygggaagattagggayggggttatataggtygtggttgyggagaygttttttygggttatttygygattaggagggagtygagtygttygtttttttygygtttttygttttattttagttagttggttttattttgygygggataattgggaygggagggaggygaygggagggyggyggttttagagagattgygygtttgttagyggtaatttgtttaagtggaygggaygggtygggtygttgygggttggggttatygaggtygyggtttttattttaattagatttgggatygygggggagttyggttyggtygttaaatygggttggttggygttagggtttygggaggtgyggttyggyggggaagtygtgatgggaagygattttgtttagggagtgttttttattattatattttttaygtttaggtagtgatygayggtttggyggtatttttatagygggtttatagtayggggttatataygttttttgagtttagtttgggtatattygtttgttatygagggtttaagttagtttgtagttygygtttygttattyggaygtaagttygtygttygttttgttaygyggtygtatagttygagttttttgttgtttattgttygyggggttaygtaatttyggttttgtatatagaggaggaagyggyggggattttttgttatttggaggtttaattyggggaaggttttagtagtgttttttaattttgygagaggtgayggggtyggaggayggaagggtagttaygttaggtttaggatygyggttttattyggtttaggtygttttygttttygttttattttattgttgygggaagygyggggygtatagatygygygttattagtttaagttygttygaygttttggtyggagatygtttgygagagggaggggyggtygagygygygtttttygtttgtttgygggatttggtygatgygaagtgataggggtyggagttttgttgtggagtttyggtygtttggygttagtygttttygttygygttttttttttttagtttygggyggttygygaggygtttttyggggttttttaaaggaataygtatattyggttttyggggtttygttaggggagggggtttttgggaagggggagggggtyggtttaggtgggggaggggtttagyggaggttttayggygtygttttagggttttttaggtttttttagygttagttttyggtgagtttygggtatttttagttggagagtttggttgggggtygttatagattttttagagyggttgtagtaggattttagggtgatygygggatygyggggyggggygagtggtgggattttggttyggatagagtttyggaaagttagagggaaggtyggtgttattgtaggtggggtygtygtttttagatgtagtygttgtattgtygtygttaggtttttyggttaaataatttaggtttgagtgttttaaattttttaggtttyggatttttggattagttatggatggattaatgaaatggattaatgtttaaaaygtatatatttagatgtatatatatttttataaggataaaagtatgtgtttatatatatatatatatatatatatatatataygygygygygygygygygygattttgygaatgtatttayggatttttaggtyggtatttgggttttyggttaaggaaagttgttttggttattatttggttattttatyggttgygtaaaygtgtttataaygggttttttttygagaggttatatttygtttaaggtggagttagtaggtatttgtttgtggaaaattgtagtggattttgtttygtttgygtagattgygtagttyggagttaaagattygttttggttagagaggaggtattaagagaggtgygatttagttaagaaygaggtygtggagaaaattttgtgggggyggygtttatatatgyggtgatgaggagttgtgagggttttggggtyggtttygaaaagtagggataayggtygtagaggttatattgttttygtyggtttygaattygtattgttaggagagattyggtttttaaaygttgtttttaaygtttaataaygaagtgttttgygatyggtgtgygtagtgggygggygtttgtatgggttaatgttggatgtaygygtttattaygyggttgtaygggtgggaatgttattygtggttagtgtatgttttgtttttttttttagaaaaygatttttaggaattagtttgagtgttygygttygagttygattggaagtaggtgygtggtygttttatttttttygtgtatattttgagttatagttttygttgygtatagagggtattatayggggttygatatatatatatatatatatatatatatatatatatatatatatattattattttatgggggggaaattgaggttgtyggaagatagaaaaygaagattgattatagaagagggggttttaattataggtgttygtagatattttaatttttttaygygttatttagtattttttaatttaggagaygtgygttttygagagatgagaagaaattaaaaaagtggttggtagggygaagagaggaagtyggtatttyggaagaaggagattttygttttyggtatyggatagggygaaaattygttgggtygygggtggagaattyggggttygttygygyggtgtygttttgtgtttagygaaaggtgygtttatttttttggtttygaggattygtttttttyggtygttggaaagtttagggyggggttygggtttgyggagaattttaggtttttttygagtttttyggtgaaggygggygygggtagggggttttygygtttttttagygtaaggtygygtttygttttygttygygtyggttttagtagggttyggttatggttttatttattagttttygttatttgggattygttttyggatttyggtygttygagtttttygattygttygtttatyggtttygttttttagtgtttgttgttttttttyggggygtagggatttttaggyggygttaygattyggagttgggtyggaggttaggttggggttygggttagagyggtygggtttttgggygygggagaaggagggygtttttttttygttyggggtygtgttaatgttttgtatttggggtyggygtgyggttgygggtttttttttaaggtttygggattygggtttttttygttttaggttttttyggygggttaggtyggtttttygygttttttagttyggygtaggtagtygtaggygygggygggyggtgggggtyggggtaggaggaggggtttyggggttyggyggttygttattggttaatattttattttgttgatatgtttttttattgttgaggttttygatatttttttttaggttttttttttyggtyggagtttggtttgagttgttaaaatttygttttyggagatttataattggtttaaaaagygtaaaattagtaattaaggggggtttggttygttagygtaggggattygagttgggtaggatatgtgagatagttatagttttttagagattaygataagatttaattagtygygygtggttttyggygtyggagygggttagtttagttyggtttagttyggtttygygtagagttttygtygttttygygtatagagtygggtgttttttgyggtgygtyggaygggaagtttygaggagtagttgttgygttygttattygggtygttygtttatygygygygtygtygttygggtygggggttygagtygygygttttyggtttyggtttyggttttygggygtttgggtyggatgtttygatgagagagtyggygttggyggttagygttatggtttattattygttttaygygttayggttygtygatttttttatgttygtttttttggyggyggygtagtttttttttttttyggtattygygttgtygttyggygygttggttaagtygttgttygattygggtttggygggggyggyggtygyggyggyggyggyggtagtagyggtygaggyggggttgtaygtttyggtattgggttygtattygttygtygygtatttgygtttttttaagagtttggagttygaggaygaggtggaggaygattttaaggtgaygttggaggttaaggagttgtgggattagttttataagttaggtayggagatggttattattaagttygggaggtagggttgtyggtyggttggaaggygygygggygggygggygggttggggtaygggattgtayggattagagtagagttggggattttyggttttyggttttyggttttaggttttggttttgaygttaygtttygtttttayggataattaagttgatttttttygtttggtatyggagygatttttttttaaaataaaaaygttaaaatttttygaatgaaataaaaygaaaatatattgttaaagaatagttttaatygttttgagttttagygtagaggaggtttygyggtttggttttggyggtttttttygtttygygttttygtttttttgygttygggttygttttygagttygggggaaatttagttttttttagattttgtttygatttygaagtttttagtgggatttgggtttagttaattttaygttggttgttyggtttttggtagygagtttygggttagtygagtttttygttttatygggttgggagttttttttttatygygggtattygagttttggaygtattygtygttttaggttttaaagtttgaagaaagttatagtttyggtttttttatttttygatttagttatygagaatttaggtttygggtttatttttttttttygaattgtayggttaggatgttttattaggttttgtagtttagtttttaatataaatattttttagatttatttttgggagttttygttttaagtgggtattttttttgaaygaatttyggggagattaaggagaagygagaatatttttagagggtttagattttttttttgggtattagtttttattttagattagggagaaagagggtttttagatttgagtataaggtttaaaggaggttgtttaggagagggtttgataggtagaaatgggattttttgggagtaataattataggtggggtygttygggtagtgatgagagggtagagtagtygattataggggaaatagttaggyggtagyggtgtgygtaaygaggagggataaataaaggaggagtggggttttggaatttagaatagtyggttttaatgggattttttttttttttttttttttaggyggatgttttttttttttaaggtgygagttagyggtttggataagaaggttaagtatattttgttgatggatattgtagtygttgaygattgtygttataagttttataattygygttggatggtggygggtaaggtygattttgagatgtttaaaygtatgtatatttatttagatagtttagttaygggggagtagtggatggttaagtttgtggttttttataagttgaagttgattaataatatttttgataagtayggtttygtgagtgttggggtagggtggggayggtgtaggagtttgttgatttagtattgtagttgagtaggagagtagggyggtaggattttttagggggaagygttgggtaaatttttagagtgtttttgttygggttattgttttgtggtttaygtgggttgggtttgggtttgggttttagygtttttttttgtaagtttgggaaatggtggggttagtggttggtagtttataattttagttttttaggtygtggagggttttttgtatygttaatagggaggtaggtgttgttaggattgggtttgtagtgttggattayggaggttattttgtttttggtttgtaggtgtygagtttggaagatttgtttatgattttaatttgtttattatttttttgttaagattygygtttttggtttttttttaagattaggggatttaaaagttaaattattttttttatttatttttttagtttttttaagatttttttttttttttataggtagatgtttaattaggaggagagggtttgggggttttttttatttatgtttgagtaaggttttagygaaygggggtggtgttttatagggtaaaaggaattgtttattttgaggtagggtagttggtgagttttygaaggttggaattttttttttgtggggttagggggtttattagtgttagaaaggaagagagtgttaagagtggaattgtagggttttgttttgttttattttgtttgggttttttttgtggggaggggttgttttttggttggtttttttgttttgttttttgttttgttttgtttttgttttgttttatttttgtttttaattgggaaattttttttaatggtaagagaaaaagaagttgtgaaaagagaaaagygagaggaaaagtagaagaaaaagaaataagggtgagaaaagagtagagataggagaaaatggggaagaggaagaatygatagagagagagagagagagagagagagagagagagagagagaaagtggagaggaagaggttaggtatttaaagaatagaaaagttygggtyggggttggtggttgtyggttgatttttatttttttygtagattattttaaattttatgtataagtattagtygygtttttatatagtgygagttaaygatattttgaagttgttttatagtatttttygtatttaygtgttttyggagatygattttatygtygttattgtttattagaatgataaggtgygygyggygggyggtgggttaagtttttgtattgaygttttttaataygtgtaggtttaatygttygtttatygtttttygaagttttttgtaygggattygygtttttgyggttygttttygagtatygagtttygtatttataygygtagtatttayggaagtttttaaggygtttttttaattttatygygygtatatataggtttttttggggygagygaatagttgggtygtygttttgatggagatgtttatttaataattagttgagatttygggttygygttgatatttttatattttattygtttattttttggtttaggaatgagaatgtaagtgaagagagggygttygaggtaatttgtttaggttttatygatgtttagaattyggggtttagtttttattttttyggggggagttagagggtgggataggtgatatagttttttaaagtatttttggttattgttttgggttagtttaggttttagattttttgggaggygtttagagaattattttttaattaaagggttttttttgtttgyggtttttttatttttgttttagtggggtagagtattatttttttaggtttgtgtttttgtgygttattgtygagtgaaagagagggtaygagtgttygtgtyggtygttgtggttttgtgaattaaggtgtaygttgggttgtgygtgtttygtttggggtgtgttggatatttgtggaggtatgtgaattygtttggtttygtaggygtttgttatgtttgtgtatatttgygtgtgtgygagttygtgagtgtgatttggttttgtgtgtatttgtagttttgygtgtgaattgtagtttttgttygygtttgttygggtgyggagtygtttaatttgygtaagttygygggygggtgtgtatgtttgggttggtttygatattgtggtattgttttaggtttgtgtggggttgtttaggtttgtttagggataatttttygaatgaagtttttggaggatagatttygtygtttttygygaggtttttttatyggttttagttyggggygttttattttaggygggtgggtattaagtggaygtttttygggttttttttttgyggttagtattygttgatttyggggtgttatygattaygttggaagagttayggtttgatttagygtygtttttttggttttygtagattatatagttgaagatygataataattygtttgttaagggttttygggatatygggaayggtyggygggagaaaaggtgagaggtygaggatagtagttttgtggygggtgttygygggagtagygagtaggagggatggagggatgggtttttygttgatttggtttattygtttatttttaggaagtagttgaygttgtygtttttaygtttgtaygaggagtattgtaaattygagygygatggygyggagttagaygtttygtygtgygatttttttttygygygggaattatttattttttygggygtagygtttagttygttgygtttgtatygggttygaggtgagggtyggatyggaggagggatagggaggtggyggyggggggtttttaggtygttgggttggttttttgttgagttattygttaatttgaaaggttaggaaggaaaygtyggygagtgtttgggatggggttttygtttygggatttttttaygagggyggttttyggtagttagaagattyggtyggatttygagtttggttttttgggygtygtgtaattttatagttgtagggttttttttttagggttgggttttttttattgtaaatttggggttttggattaggtgatttgtagttgttttttgttygattttagtagttttttygatttggttttttygagagtagtttttttygagtgtttttgattttgttygtyggttttygtttaggtttttgtaattygygygtttttttttygtagttgaggagaagtygtgygtygyggatagygattyggagtttgagyggttgagygaggagygtgygggggygtygttaggtygtagttyggttttagatagygttagttttattygtttgatygaattygagygygttygggagyggygtagtttygagaggggtaaggagtyggtygagagyggyggggayggttygttyggtttgaggagtttggagaaggagygygtygaagttyggaggaaggaygaggggygtaaggaggyggtygagggtaaggagtagggtttggygtygttggtggtgtagatagatagtgygttttttttgggygtyggatatttgttyggtttggttttttttagttatttgtaygggtagtagttttttgggtygttgggagtyggttagtygttttttttgtattttggatagtttattatgggttttggygtttttttygttatgggtatgggttatttattggtttyggtggtaggyggyggtaayggyggaggtggygggtttgggatygtygyggggttggaygtaggygggttgggtttygyggttagygtagtaagtatygtygygtttttttygttttattttttttagtatatgttggtattttaggtaaggtttgtgatttygyggtagygttagygagggagaaggtttagggagttggyggygaggttagyg

SEQ ID NO: 5939 - DNA, 2392 bp, synthetic construct
  misc_feature 1..2392: note = Description of Artificial Sequence: Synthetic polynucleotide
  source 1..2392: mol_type = other DNA
tyggattttttgttttttyggtgagtygttttttttttgtygtygggttttttttttttttttttgtttagttaaaattygaatttaggygttaggggagaggatygtygttttagtttgttttattgttgggggtayggagtttttgtttttttaaggttayggttttygttttygyggatttygttyggattttttttggttatygggaygtttygttttttttttttygtagtaattttttatattygggttgtgaagttyggggtatttttaggtyggygataaataatttatagggaaygtggtattaggtttttttygygggaggagggggygygagtagygagagttatygttattygyggtttaaggatattygygatgyggyggyggyggyggyggyggyggtttygggyggggattygygttaygttttttggyggttaagttgagtattaygtattyggygtttttygttttaygttgtttttygtyggygttygyggtttyggggtttttatttttatttttttaagttgggtygtgatttygagtttygtagtggggggattaagttagtttggtaggyggttttagtattattttaggttygttygggggttttgggygaatttaggtgtttyggatttgtttatttgtttttggtaygtttttatttttygggagtttagaaataggtttaaagttattagtatygttaagatttggaygggttttgaaatatagttagyggaatggtattttttttaaataagtgttttttttygatttttttgtggttyggggttagggattgaattaagataaygttattattygagggttgggggatygagttagaagtttttttggaygattagggttgggaaatygagtggaygaatggggtgggtattagggtttggygggaattttygttttgtttatttagtagttttttgtagggtygygggaygtatttgggggtttaggttgtygggtgtttttgtttygygtgttttygttttgttygygtaggtaggaaataggagattyggggtttttttttttygtygtyggggattttgggygaagtttttagagatyggygtaggyggttggtgygtagttagggtttagygttaggttttgttygtttagtgttttttttgtttatttttttttttgygttttggaagttygggagtygggtaygggttagtatttgtaagatgttattattttggaagtttatttygatttttttaggtygtaggaaggagagagttaggttggggtaaaggagatggggtagagttggaaggggaagaagygggattygyggygggggaaggggtttgggygtygaggygagtgygtagtaggtgtttagtagatttagggaaattggggtattgggttggggagtygtatagtttttttttattttttygatttttttttaatttttygttttggtggattttagtttyggtttttattttyggttttgtttttygtttttygtttyggyggtttttagtagtaatagtttgggttygyggtagtttagatttttttggtttygyggtgttgtygygttaagygaaggaggaggagggttyggygattttggggaygaaygttttggaygtttygttygygtttttttttygygttygtygygygtttgtttgttyggtttttttttygtttttttttyggtygttygggttaaaatttaaggttaggtttttgagggttygggttttttagtygttttttttttgagtttygagagttttgygtgggtttaatttttygggtgtttygtttttgttttygtygtttttgttygygygtygygggaatttagttttaagttggyggygaagttggtgtttttygttygtygttygttatttatygaggggaaggggygttgygttygygaygagagttygygtyggtygtttttttygyggtgtttgttttagagtttyggtttyggagggttggygygtttagttttagtttygygggygtyggagttygggygyggtggggygggggygggggygggtggygyggtttggttygttggtttygattygtttttgygtttygygattttttygaggttygtayggygttyggtttygtttygggttgggttgygtatygygttttttgtttttagagttygtagtygattgtgygggagtttttatygtygttygygagggttygtttygtyggggttygttattttygtttyggttyggttyggttygttgtttttygaggtttttttygtygtattttygggtttttttttttttttyggaatygygtttttagatttgatattyggggtaagtgygtttyg

SEQ ID NO: 5940 - DNA, 564 bp, synthetic construct
  misc_feature 1..564: note = Description of Artificial Sequence: Synthetic polynucleotide
  source 1..564: mol_type = other DNA
tygattttttttygtggtygttagggtaggggtgggaggaatttggaagttaygtgygatgttyggagttgygttttttgttttggggygtgggttygygagygtygygtagtttttyggatygttttgagttgttgygttyggygttgtttttttttttttagtttygygtttttttttygygattttttttttgttttttyggttttggaagygttttaagatggggtgggggtatggagggagagaggggaggagggagttgttygggggtagtgtygttaggaagtgggayggggattttggygtttttttaggttgttgygygygggttggggatygtgtatygttttgygygttagaygatgtattttttggaayggtagttgaggtaatgyggggtgtgaagtggyggygggtagaggggttygtaggggttgggattygygtgtttttttttgtttyggtgyggagtaygatgtgttygggygggggygaggaygttygggaggggttgggttgygtaygttygyggggtygtygtagatgggyggtttggaggyg

SEQ ID NO: 5941 - DNA, 3277 bp, synthetic construct
  misc_feature 1..3277: note = Description of Artificial Sequence: Synthetic polynucleotide
  source 1..3277: mol_type = other DNA
gyggttgtattgttgyggggtgtaagggygggggaaattatatygttaggygaggygyggggatygtgttggaaggttygyggygyggttttttttgggygattgygggggyggtttggtagggagttggggygagtggtygtygyggggtttygtaggygyggggaggtatyggtygggtattygygyggttgaggygagggygggggatgtttggtygggtagggaayggggtgggggagggtagaggggygagygagtyggagggggaatyggagtygagggygygygyggatttygaggttttttaggygggttttgagygattgtaaagtttgttygagttggttgagygtttyggyggtyggtgttygggataggtygtttatggtgtttttgttygagtygggttgtttgyggtygtygttygttygggtttygtyggtttyggggtttagygtgttttggttttygtagyggtttagtttggyggttagttygyggatggtttttttttggtttaggatggtttttttttgttgtagtatygtttygyggagttgtagtaygttgtttyggagtttttyggygtygtyggyggttayggaygyggygtatatgtyggygtttaygggtatygaggtgtagatgaagygygtyggttygaaattttgggtttyggygtttaggaggtagagggygagtagygtataggtgygygyggygyggtyggtyggtatggttgygggtatygggygtttygggttyggttyggttyggttggggttyggtttyggttgggattyggttygggttgtggtttygygagyggttygygttttgggygtygygtttttyggtygygyggtttatatygtygygttattaggtttttattgtygtttgygttgyggagttygygttttttatgtygtygygggaggggtttygagtygtygaygttagygggggaggaatttygttttaattgttygyggttygggttygyggygyggygggggttttaygagygygttatyggggttgttttygttygygtttttttygtttttttgggagttgtygyggtttttttttttttygttttygtttgggtyggygttgttgtttygaaggtttygagagtttagggggaaggaagtygggtttyggtttyggattygaggatggattatttgygtggtgttttygaattttygayggggttttaggygggygggaaattatygygttygggagatagaattyggttyggtttttttggttgtattgaatatttttgggtyggggtygtttggagtygggttgggtgtttaaggatttaggtygttaatattygagtgttyggtggttaayggttyggagtggggtttygyggygttattaagtttagagygggggttatygggtygtttygygttttttagatgttygtgtgttattgagaagtygtygggtagtttgggtatagggattttttaygggtyggggttttyggygtttttttttttttagttttygggttttgtggattyggtttygttttygggggattgttagtttttatttygtgygggyggggygttggggatttttyggaggtagatttagttgatygagttttttttgttygyggygtyggttygatygygggtaggyggygtygtyggggttggaygttygtagyggygtttyggaagggggtttygygggagtagtygttygygtttttagtagtttttttttgttaggygtygygygygttyggtattttygggtgtttatttgtgygtggggggttgtttttygtttgtttagtygygtttattttttaggtttaaaggttagtaggaagggtttyggaggtggttgggggygtttatttgagaagtttygttttygtttagatattttattyggtattygygtattygygtttttatttggatygyggggttyggttttygagatygyggttygggtttyggygtygggttgggggtttaggattagggttggygtagtygtttygtttygtttygtttyggggttattagagyggttaaagtttyggaaattttttygtttaygttttygtggtatagagaaggaaattgaggtttygagattgyggggtygggttatagtygtggtttttygattttttttygtygttttyggtttttttggtttttgygttttgtagtttttttttgygygtagtygggggttgggggtttttagttagtagggatttaygggtagtttygggtgtygggatygggygttygtttttygggygggagtagaggtyggttygatggagatttttttgagaaatggyggtttttattygttttttagttttygagygttygtygtttgygtttagtattttagtttttaagtttttttgagtyggggttgygttttygttgtttttttyggtygtygttttttggygttagagggatttygyggttygtaygggtttgttttyggtttygttyggagggtgtgygggttttygtttygttggtttygtttgtttattayggygygtttaaatttaygyggttygyggttttttgygtgttttgtygatttygggtygtaggaggggttagtttygtyggtttttaygyggggtttgygtyggtagygttaygggttggaaygygtttygggagaaattattygygyggggtygyggygttttttgttttaattttygtagggagtygttaggygggtgtttttttggttttagygttttggtttygtygttttttygtaygygtttagtggggaggtygygttygttaggtttggagtyggatygtgtttagtygagagygygygggygygggagaggagttttgttttgtttagggtaggttgtttagayggggygggaatttttagtttggtttygygtttttatttttagtagtygtggagtttttttagtygtttaaggttagggattttgtttggttttttttttagggtagtagattttagyggtttggtatttyggtatagaggagygtgtttttttttygtagaggaagggagtggayggygttagaaagggaggggagtttggggyggtgtttggggttagygggatttttgggtattgtggggttttaggagaggagattttygggtttagtttgtaattgttgtgtaggaggygttgggygggatatttgtaggygttgtatatataygygagggttattatgtygyg

SEQ ID NO: 5942 - DNA, 5692 bp, synthetic construct
  misc_feature 1..5692: note = Description of Artificial Sequence: Synthetic polynucleotide
  source 1..5692: mol_type = other DNA
gygygttttygtagttygtyggttaygtatygtaygtaygygtttttttygygyggggtggyggtyggygggagttaygtggagtagtygyggtgttttyggttaygtttggttttygatgtygygaagggggttttggggtaggtttygtttttygaagttgtygttgyggtttttgttagtygggagaygaygaggggaaggggtgggtygygttgggtttttygtttattygtttttttttagttttgygggggttaaattygtttttaataaatttygygaaaaagtygagggggggaygygtygttgttggagaataggttagaagtgatagtagaatgggtygttgagattttygttttygtttyggtttttygtyggtttggygggyggygaygtggggaggggtygtttagaagtyggggtygttygggtyggggaattttttygygtygaygtttattttttaygggtygtattygtygaggggtygaaaggggttttagtggaggaygyggtgggagttgggtttygttttagttgtygaygtyggyggtgttygggttttygggagygtagtttttggtataaagtagygtygaagattttgtygggtgtttygtygyggttgtygttgtgttygygtagggtyggttygtgaatgygtgygggggttttygagggygttttttttattttgygygttygggggagttgttyggtygtygtyggtaggtagaggtttygggttttatgggtgttttygagatttyggatygtgygttgagaatgtygaygttttaaaygagttagtagagygggtyggagttttggtygggaatyggygtygygtgygtattggtyggygaggtttttggttygtyggggaaggagtttagagygtttgttttttyggtagaaattaatatatataaataattattygtattttttatattgggggattgggagtaaggagtaaggataggggaggggataggatttaattygttggttttttattttaaaaattatatattttatgttaygatygtttttygttaagattataaatatttaatttggtttggygtaataaaattagtyggagtttttttaaayggagttatttyggtgaattaagttgtgaaatttaatttattatatttataaaggagaatgtttttattgtaaatttaggttataaagaaattatatttgggtygtyggtttttttttyggatttattatttgaaggtttattaaattattttaaaatgttgggttattttttttatattttatggtaataaaaattaaaygtggtaatattttttttaatagtaggaaaggttaaaaataatygttataataaggggatataatttttaaaagatatttttttttatttygggatgtttttttygygtttggaagygttttttttatttttttaattaattygagtttttaaaatatttaaaygygttaygattttttttaggttttttttygttttaygaggygtttgaggygtagttttyggatggatygtaygtggggtygtagattttgggygttyggaygttagtyggaggygyggggatttygtggtttygttgygaatttgygttttatygyggttygtatatttgggtygagtyggggtygtttygggagtttttygttggtttttgggygttttattyggtttagtaatgttygggttagataaaggagtygttagggaggggttaattygttttttattttttttygttttttttttygttttttttttaggyggygyggaggagagaagatgyggtttttaataatgtgtttggtttaatttgyggggtgtgggtatttgttgygtttttttgggtgagggttgggtttttttttttttatttttttttatttttgtgtatgatattttggttggggtttggggygttttgygttggttagaagttagggttattagggatttttygttttygttttygaagaggggatttgygyggayggygaggaggatygatgygtttttgagtttttagggaaaygaggtygyggttgttgttaygtygygaggaagatttatgaggygygggtygagtatggttyggttyggyggaggtygttygygtatttaggttaatttttgatttttatttgattatttttttttttttgttatttttaagtyggygttyggaaaggygaataaagggaggaggatgggggatgggggygttaagyggtggygagggttyggttyggtaatttttttttttagtgggggtttttgggygttttaggttygygtttaatgyggggtttaggagggygtagtttgaaaggtgatygggttggggttgtyggagattygttttgyggggtggtttttttagtygttaggtttaygataggatttttagggaggggtttttgtaaatgtttttgggygaagagaggayggaaagaatatttttttttaaattgtaattaagggtgtgyggggygggggtgtttggggggtgttgyggtaggtygggttygtttaatyggaggtagtagtttagttttgggtygataaggtygagggaaaygggatttttttgtttttygtayggaaaagatttatttaagygggtaagagggaagygaagtttgtattttttatgttgaaaaaaaaatttaaaatggaaaattattttattggttattatttataagtaaattaaaaatagggataattagagtgtggggatttggagggattataaatttgyggygttttttttattggaattaggagtttttatggtttgttgttttattttgagagaaatgagatttttggttttggtgtaggygggtgtgygtttygagygtttttyggygggggggaggggggagtaggaggggygaggagatttgygtagttagggagtygygaatttygagtttyggttttygaaggyggtaggagaaatygygygttgtgtttygatttttttygttttggttaatygygatttgggaygagttggaggagtttttttygggtttyggaygttygygtygaaaatygggttatgggtattaaattygattttaggyggttatttattttgtttttatttaaattttgatgagttatttgggagtgygyggggattgggaagtgagggatttttataatatttttttttygatttyggttttygagtttattatttattttgtttttttygttttygttttttgttttaaattggggaggggggaggggggagagaaaaggatataaaattatygttttttygttaaatttttaaatttttaatttttygtaaaatggtttggaatttattttattttataggggttttattttttatygggtggaggttagttttttaattttttatataagtaggatttttttttatttttgaaagtttttaaatttagttattttaaatgtaaatatygtgtgaaattttattaattaggtaagaaagtagggagagttttgatttagttgtttttaattttgggaggagaaagagaaagtgagttttttttttattaagtattttaaaataatagygttttttttttttagttygttttaatygtagttttgtttttgttgaaagatttttgttttttttaggaaggggggyggggaggataggtttatatttygaagagttttgtttttaaaattgttygaagatttttttgtttgaygtgtatatgggggaggggaaggagttygtttaggttattyggttttttyggatttygtttaggttattyggttttttyggatttygtttaggttattyggttttttyggatttygtttaggttattyggttttttyggatttygtagaatatttttaaagtttatgggygttttttaatygtgtaagttyggggtttygggggttaggaggggttgttttaagataagggaagttgttygttagattggggttaatatygggtttttttaatttaagtttttttygaaaataatttttttaaaattgagtatttttattagaaaaaattygtattttttaggaggayggggtgggagagtttyggggaataaagttyggtttttttagttttgaggtygaggtagggygtatttttttttgggygaatttaatyggagttgtagaagagataagtatttttaaattggtattygtttygagtttaaggtgagggtggagaagggtttttggtggaagttgtaggaatattttgggtyggggtttatttygygttyggyggtttttygaatttygtagaaagataygtttgtagygaaaggtttttatatattagtygggattttattygttttttatygagagtgygttttgggagygygggaaataaggaaaaygtaygtatttggyggygtttygagggyggtttygygggtttttygttggygaaggtttttagaagttatttttygttyggttgttygttttayggttagttttttttttttyggygaygtatttygtygagttagtttataggaagygttaggagtyggagatttggttygttttttygggygttgygttygttttygatygttagggttygygtttttttttyggttayggtttattagagggatttygyggygggttttggttygggygygtttttttgygttygagtttttaggttttyggtygagttgyggagayggaygyggagttttyggggaagaygaggyggyggyggtygtygttygggtaggagtttyggggygggaggggtgtagggyggaggagygggygggattttagygtttygygtttygyggtygtygtttttyggggygtttagttttatttaygtggaatygtttygttttygtygtttygtttttaygagggaaggtattygagtttygtygtatattygygtttttyggtttygggttygaaatatygygttttttttttagygtygtgtttttygtttttttagygygyggttttygttygattygygygttygttygattygtttttaatttygtttaattatygtttttygyggttgttttttttgtttgagttttyggygtaggttaatggaattaygyggaggygygggyggtttggttaatggaaggtttagggggygtggttggygggaggggttgygggyggtygggttttatgygttgagattygagattgygtygtyggygggtgygtttaggtygtttagttagagtyggtaggatttygtygtygggttgtgggtttttgatttttttttygttgtygggagaagygtttgagtggggagggaggtgggaggaggtggtttygygtygggggtgyggggagygggayggyggtttggatggatayggttagtttygggtyggagagggttyggtttagagtagtttgggttttgtttagagttttattgtgtaygttttygygaggatttgyggagagaygtgtaggygaygtaggtttygggaaggaaggagggtatttgggttyggaygagygataaygttgtgttttgtgatttygtataaayggattttggagtttagggaaagygttttaggtttttagttygggtagggttygtgggattggygttyg

SEQ ID NO: 5943 - DNA, 7937 bp, synthetic construct
  misc_feature 1..7937: note = Description of Artificial Sequence: Synthetic polynucleotide
  source 1..7937: mol_type = other DNA
gygtygtttgygaggggygttttgygtggattyggggtttyggggygygtttatttattygagttaggagagattgggttttayggtgttagtttygygttygggttygygygtygtttttagttygygttttttttattttyggagggtttygygggttttyggygaygggtttttgtttagggttygggaattttttttttttttttttttttaagygttattttttyggagtygggtyggtygttttyggtgtaygygggaagygggtagttttygtttgtattygyggggtygggattyggaggtattygttttttygatatattygttggggtygttgttygttgttttagtttttygaggttayggtaagagttygggggtyggygttatatatttttagtyggygatygygtttagggatttaatttaatygtttttagtttaatgaatagtygygygttaatyggattttygygygtttyggggatttaygtttttyggttttttttttygtgtttygyggttygttagaygtygttttygaaggygtyggtttggggtttggttaggggttyggtygyggggggtttyggtygtyggagtygggagaygtyggagaygggagtygggttygygygatygttattttygagttagtyggggtgggtttygygttttgttttgygttttyggttyggttygyggagygtyggtgtttatttgygagtttygggtttttyggagttttttttygggtygagtygttygaagygggygtyggygtaggtttygatttaggtaggygggaaatttyggagttttygttygyggttygtagttttttattttaggtyggygtggtttgygggggggaaggtyggtyggggtyggtygttygttttttttttttttttagatttttttgattygygggtttttygtygtatttyggttttygggttgtttyggtyggttygyggggattttggaaayggtttttagtttatttttttttattaagyggttttgggtygttttgaaatygyggagttagtaattgttttttttaggaggtttagtgyggattggataatagttaattagygttttgtttatattyggtgatggatagtttattggyggagtgttaattaattttagyggtttygygggagygggagtgggggyggggaaatagagagataataggttttgagtttaattttttygtgtttttgtyggaatgagayggtggagaatttygaatgygtgtgaatttgttagttggtttttagtttaaatattttttttttttttagagggggaggtagagatttatatggagaaagaggagtaaaaataaatgtatttatygttattaagatattatttygattttttgagaataaatagtatttgggtgggaaattaaattttaatagaaatatttgtttgyggaatattttagaagtggtttgtatttgattaygataaaaattgtttagtggtttgttttagttggagtgaggatttagtagataggtagatagggagtagtattgagaaatattatatatggtttattatattatattygttttttttattattaaattgaaaatattttttaaatttaggtgtagatgaagaaagggtaatttttgtttttttaataaatttttgatttttattttagtagttgttttgttgtaaagtgtggtagagggagataaaattgagagttagtaatgtagayggttggagatttagaatttattttttagggtttgatttttaggttatggggaggagagagtyggaygggttatttaaagtttttgttgtttaagtagygggygtgygtgygtgtattygygagttygggttygggtaggtagtagttttagagyggtagatgggttaggtaatttggggaggtttttgggtttggaggtttggtttatttgttatttgttagatagattttagggagaaaaagtagttatttttaaggggtggtggtgtttttttttttggttttttgtgyggtagaagttaaaygttagatttgttggattaaatatatatgtgtgtgtgtgtgtttgtgtttgtgtttaygttttttttttygtygggataygygtattygttygttttagttttttttttygttttgygttattatatttttatttagtagtaatgatttgygtagaggagttgygtagtygtygggtttgaattaggygttatygggtttggtagtagtttygttgttttttgattggtagttttttggttyggygttagtttattgggaggtttgtttaygtygaatgagtggtaygagttttyggtygtggagggttgygyggttaattagygygttggttgtttygggttgagtggtaygagtttattagtatgtagggttygtggttygtygygttaggttgtaggtttgagagtygttttggatgggttygttagagtygttgttgtggaagyggtgtatttatagtgtaatagttagtatattgaaaatattaataggaatataaaataaagttatatttattgatttaattgtattgtatttagttgtatttaggaaatagtttttagtaagtaattgaaattgtttttattttttttttgtttttgtatttttattattattttattttttattttggttttggggttttatattttttttagtaaaagaaatttaggattgtgatgttaagaagtatatatttttttttttaataaaattygttaaaatgttgaggttttttttttttttaaaaaatatggattatgagygatttttttttttttgaaaaattttatygatyggtttaaaattattttygtaatgtatttttgttttgttttgagygtttgttgtttygatygatatttagtattaaaaataaatattygaagataggatagggatygttaggttgygtttggygygagtygygygggtggtatygggyggatagtaggygaagttygggygtygttagygtgygtttagttttgggtgatttaygaaygaattttaatattygtttttttattttgttttttttttyggaatagttttgggttggttttgttyggtyggttygyggygaggggaattggtygggtygtggtatttayggtygttgttttgaggggtttttygggtygaagttaggggtyggggaggggaatggttatggygagtttttygggttttygtttttaatttagaatttttttttttyggagaagtgggggtggaggagggggatygagtaaggtyggygtagyggggygtttttatygygygygttygggayggygygyggggttygggttayggttygtgtggyggggttygygggttggtttttttygggygygggggttaggygygattttagtttttatgatttttttagggagygggtgyggttgtttygtagggagygggttttgyggygayggtygagttattygygttttaaggygygtttggttttagttyggtttgtaggttttatygygttygygttttyggagaygaygtyggagggaggtagaygggttagagttttggttttyggtaggygggygaggagagagygggtttttagatgtaaaagtaggaaataaagtaaatttgtagaagttttagattttggagygygttagttaygtttggggtygyggtaagagggatyggyggttttagggttaygttttgttttttygggagggagttttgtgtttttaggtttagtttttttygaaatgttttygttagygatttttygttygttyggggttttttgttygtygttatttttygttttatttttttttttattttagttygatttggygttgyggygtygttttygyggtttttyggygyggttttttttggagttgggttgggagtgggtttygggtttyggtattyggygggtggyggygtygtygttgygggattgtgggatttttagttygggtygtgtggtygttttttttygttttattttttggtygttttaggttttttaggttttygaagttyggygygggtagaygyggaggygyggygyggttttttttygggaggagagaatataaagaaaagttttttttaattyggttagagtygtggyggygtaggtaggygatagtaatttattttttgtttgtttaaaaagtygagtaggttggtgagaaaggaataatygggtttgygattygttygtagggggtgggagattaaaattgttgtttygtagtygagttygygtttygagaatygtyggtagttygygtttttttaattttgaaattttttattggagagaaaaaaaaaaaaaaaaataattataaaataaaagtatagtatataygattttttggaggtygttaggaagtttggtattttygygtgygtagttttyggttttttttyggttttyggygtttttgaagttgtaggtttttgatttttttttttttttttttttttttttgtttygttyggygtttttyggggttygggaggygtyggtyggggttgggggtttttaygtttttagtttagttygggtagttttttttttgatttttgygttygtagttttttygttagagtatttttygggttttggyggtygggygttygttttgtaggtygggatyggggtttgggagtygagttatttgttagattyggggagagagttggygatttttagagggaagggagttttaaaygtttttgtatgtagttgttagataaagagaattttttgtgtagatttatttatttataatgtaaaagtttttygaataaatattaaaaaagtttattagttgagtaaatatgtatttatttaatatattatgttttyggttatagattaaattaaatataaaatagtttgtaaataagaygttttagaattyggattataaaatatygtaatttaaaaaggtatttagtagatggaaaatattttaatygttttgttgttatggtggaatggttataaaaatataaggtttttygtaaagtttttaattaggaatattaagtttatttattttttttttgttggaggtgataaatattaaaataataygtatttagaagatgaggagtaatatgtgaagtgygtttagggagygttttyggagggaygtttgggagtayggtggtgtaygtagtttttattattggtttygatttttygtatttagagtttaaaattgtttttaatttygtttgagtggatgtttygygttgggtgggggtggaagaaaatggaggtgagggttattttaggtggtygaggttygggtagggtttgttggtagaaggttgtgttgggtygggtttatttttttyggttagagggtygagttgggygtygtagatttygygtatttaggtygttyggtattgttyggagyggagatyggtttttgttygyggttttyggtaggygttgaaggaagaaattttagggtygatttgggtygttgagagagagtattttgattttgaaagtattttttttatatatatttttaagtttttaattygtagaggaagattttgggygaatttgattggggggyggggtgattgttatagttttaataggaagttttyggtttygggatagtaggtygggtattgyggygtggyggtttaggtgatgtyggtggyggttgygggttttyggggttttgaggagtyggtttggggttttagygygatgttggggataggagttggtttygttggggttggggaggggggattayggtggatttagaagaatgggtygaaagatgtatgagggggatgggagtggggagaaaaggaaggttattaaaaaaaaaaaaaatttttgagttataattaataaaattattygtttaattagtatggttattyggttaagyggaatgtagtaaaagttggatttyggtatgaggtggggagagggggagagttagtgtggattttaggttttttttttygagatatttttgggtagygggggaggggagagggtgtgygtgtgagtgtgtgtgtgtgtgtgtgtgtgtgygagtgtgygtgatggtttygtagatttgggtttttattatttagtagagttagtagttttttygtygyggygttttagttgtagggattygyggggaygagaaygggaggyggygagtagtgyggttgggttttttyggttgtttygggttaagygtggtygggayggtgygtgygygygyggggtttygggtgttgggttgygygygygtgyggyggggagatatygagygtttyggtttygttattyggtttggtygtygttygttygggtyggygggggtggggggtggggggagtgggtgagygggyggggyggggattttygggygagtygagttttttagttattygtgttttttttgtttttgtttttatagattatggattygtatagyggtygttggttyggtgygyggtygttygtygagaagtttagttttttygygtgttgatyggtttygtygttattatygtttgtgatttyggaygtygtygtttttgygtygttygygygtygagtygttttygggtttyggtygygttgtttygaggaagyggyggyggatyggggtyggggttyggtatggatggtygygattttgygtygtygtygtatttgttgtyggagygygggagtttgggttatygtagygtygttgtygtygygygtttygtttyggttgggttygtygygtagtttttygtatatttttagtygggaaagtatttttygtygtygttgtttatggtttygtatataggttagtgttyggtyggggygggygygggaygggagygttygagagyggaatagggygtttattttttygttttygggagtagagaagttttggttttatttttyggtttyggtygyggtggttgtttgggygttgagyggggtygygygtttygttagttttttaagttgygtygtygyggtttagagaggtttttttttggttattttttttygggggtttyggaggggtagtttyggagtyggttgaaattaaagttttttygygtttygttattttttttygtttttttttgtagatttaaattttayggaaattttttttttgtattttgtatttatttttttaagaygtttyggggttgggataaygaggygttttttgyggaaataaaayggttgttgtggyggggggaggggattagggtaygtygyggtttygyggattagagtggtgtgtgygtygggygagygttaatagggattgttggtgtaagaygagtaaattttgtttttatataaagttttaaagtgttagggygagaatgggtttgtagggatgtatttgttttaaygagtgtttttggtatttygttaaagtyggataaagygtggttagagtgyggtttagttttttagtttgyggttyggggaggagggtagygygggygygggttgggggtggygyggggyggygtttaggatttyggtgtaggygagagtgyggyggatttgttttaagaggagagygaggyggatttgttttaagaggagagygtggggygtygtgttgggtttygtagggayggattttttygggyggttttttttgattttttgttygagaggattagtttttggtagagygggtttaggtttttagggtagtttttttttyggtggttttgatatgagtgtygagggaggttagggtaggggtagttattaygtttgaagttttagaggttattaggyggygygggtagattygggggaagygygtagggttgygttagggattygtyg

SEQ ID NO: 5944 - DNA, 1408 bp, synthetic construct
  misc_feature 1..1408: note = Description of Artificial Sequence: Synthetic polynucleotide
  source 1..1408: mol_type = other DNA
tygaggtttttygaygtggatatttaaygtttttggaaagggagtgaattggtaggatattatygtttyggttagtttygygggagttgttttttagaaaaaaaattttttagagttaaaagttattttttaagygttttggggtttttygggygtttttttyggayggtaattttagaagttaaagygattgtatygttaggtttgtggyggttggaagyggggtgatygyggttagatggtatttygtatttaygtagggttgtgttattttagtatagaattagtaatttttataygaagttttgtgtaaatattaygygggtttatttttgaaygattttttgatgttttygttgyggttatttattttatatataaattaggatttygttgataaattttygtgtttttattaaatagaaggttgttttgtagtttttttygtgtttttttttaaagtaygataatatttgatatttttataaatyggtttgtagaggatatygygtagggggygattaattagttgaggtgtgttattttaaaatattagtgggtatattttaaggygggtaygtggaagggaygyggaatygagggtaattattttttagtyggtgaatttgatggagaaagatgttaaatgtatttttygagttagttgaatttttygggtatttaattattgttagatgtggygagggygtayggagaatatttttagtttyggagaaaatattyggtygttagygyggggatygttygggtygggaaayggttagaggygggaggagagaggattgggygagygtggggagygttgyggygtggaaaagygatygggagggatggygatgtttttatttttttyggtaggtttttttaattaaaaagttggaaaygggaattygtaaataaygatttagggttttaaattatttgtaaagaygygatggggaggggaatatttgygygttttaaaattttaatttygaggtttttagtygygtttgattygggagtygggtgygtttttagtgttygygtaygaattyggygttttggtagtttygatttttygggttygtagtttaagggaaggttygygygggaggtattttygtggtttttygygygtttygaagttygtttttttygtttagagtttygyggagttgtygtygttttattttttatggtgatygtggggaygtatygtyggtyggggagtttygygygagygtygygtagtygaggaagtygtttygagyggttgtttatygtaygtttatggtagtygygtygygygtyggtygtttgygttttygttttttttygtygtygtyggttygygtttttygygttttyggtttygygttttgttgtttyggggttgtygygygyg

SEQ ID NO: 5945 - DNA, 208 bp, synthetic construct
  misc_feature 1..208: note = Description of Artificial Sequence: Synthetic polynucleotide
  source 1..208: mol_type = other DNA
gygggygtgggggggaaggggaagaagttyggygagattagaggggaaattygaaaaagtaagtttttgyggtagtagttaggaaatattygttaggaattggttgygattttaattttagyggttygaagttttagtttttttatttttatygyggtagagtygttttygtagatatttttygaggagaatygyggtttygagggyg

SEQ ID NO: 5946 - DNA, 805 bp, synthetic construct
  misc_feature 1..805: note = Description of Artificial Sequence: Synthetic polynucleotide
  source 1..805: mol_type = other DNA
tygttttttgtttttygtattttttygggggaggggtyggttygygttygtttttagttygaggggtaatttaaaatatggygtttygggygggggatttgtgtaaattggyggagaagggaygyggggatygagtygttttttyggttagggattttagggaggtttttaggtyggaggtyggggtttaggttttgygygtyggtttagttattattgygtygtggygggyggagygggyggggggygyggygygtaggttyggttyggtgggggtttyggygagygggagggyggttggggatttyggtygygtygggygyggggttygggattygggagatygygyggygtygaagttaygygttagttttattgtttygygygtttygttttaggtttygggtttttttttygtatttygtaaagtygagattttttygtagttttttatttygagaggyggaaaagttatttgggattagtagggagttygggygygtygyggygtggggattaggttygggygygygttttyggyggyggtgygtaggagattygggygtggggaggaagtygtagtttagggttgttygtygttgtttttttygttttttgttgtaggagatatygaggtttygyggagttgyggygggggtttaygtttagagatygtgygaggaaagttaatttygttttgtttgtttttttagtygygggggagggggttatygtagtattttaggatagttatatgggtatagtttttttygttttggygtagggttaggtttygyggaygayg

SEQ ID NO: 5947 - DNA, 2462 bp, synthetic construct
  misc_feature 1..2462: note = Description of Artificial Sequence: Synthetic polynucleotide
  source 1..2462: mol_type = other DNA
tygyggtttagttttaatttatygtattttagagggaattaygagggagttgyggattggygggggygggggtttgtaattaatattaggtgtttgtgagagagttttaagggygggggtagtattttttggttgggttgggttygtttggtttygtttygttttygggatttttggygtttagygtygttttttygttattgygttattygttagagttyggygttttttttttttttgttttgtggaygtygtttttygttttygggaggatttygtttttagtattttaggtttttttggygtaaaggtygttagttygagygagtttaggyggyggttttatttttgtagagggaaagygaaagaygyggtyggygggtygagggggyggtygaaygygtygygtggttgttgttttygaattygtagyggyggygttagggyggttatygagttttgyggatttyggtttaatttttagygttattygggtgtttygagttygtygtagttttyggygygttttttagtygyggtaygtagtttttgaygygttyggggygttttttygtagtattagttaggttattttatttttygygtygygttttttygttagtygtyggttaggagtttttyggtttttgagtaggaygygttaaagggagttgggaggtttagtagtttttagygtygttttttygggtgaygtgaygttttttttggagygygggttygttttygttaagtttttatygtaggtttttatagtygagttaygggaagatgtaaygtygggygaggggygtttttyggattttgaaaaatagttttattygtttygggaaygtttygattttttattygtattttttggttagatgattttaattttgggatttygygttggtygtgggggtatygggagttggagttggaggagaggagtyggtagygyggagttgtyggggtgtagttgygygtagttggyggygaggggaggyggtttttgyggtttygtygggttgggggaattggtttttgygtttttgtttttyggaggatygtattygtttatttttatatattatatatatatatatatatatatatatatatatattgtygttagygttttttaygttataagtyggaatgyggaggttagagttattgtttatttgaaagtaggaaagtaggggttgaaaygttgagatggaggyggaggttttggttttatttgygaggttygtattttttyggaaggtttttttttttttygygtttttttagggygagtaaggtttagtttttgagatttygttttttgggttagyggttygagttgtaggggggyggggayggattyggagggagtattagagagagagttygygtttatttttgtttttttygtaaagaattggttagttttattygygtttagtttataattaggttgtygggatyggggagttagattttaggtygttttaatttyggygagggyggggaggggagtgatagtagtaattagygygygttggtaaaagtatagagtttyggaataggttaaayggtyggygyggaggggtggaggtaagagggggyggaggaggagttgttygagyggagagggatgaygttttttagggttttgggtttygaggaatygaagattggtgygttygtygggtttygygtattagttttggggttygtagaggygtygygttyggttttygyggtagttttaatatagygygtaggyggtygatttyggttagtttaaatygggygtaagttttttgttttttttaaagtatttttttgttygtttttagtttttaggtgttygtttgagagtttttgtygttttygggyggattyggttaggtagttttyggtygggttagtttygtttttttttygtttttttttttatygatttygagttaagggtaggyggttygtattygygtttttgtttayggggttaggyggygttttyggtttaygttyggttgttaagaagagaaaggygtttatttgagttatygaagtttttttttggggtttttttyggagtttgttygtagttygtaggtataattttttttggagaaaaaaagtagygtaagggtagagagaggtagggttgtttataggttttttygtaggggttttttttttygaatttttyggggtttagtttygggttyggyggygggaaagagtttttggaggttggaaggggtygttagattygggtttttttygtagttgyggtggyggtatttttaagttgttatttgtagygygtttygggygtttgtgatagttygygtygtttagttttygygggttygtttttttygttygttygttggttgygttyggtgttygggyggttttygygttttgtttygttttgagttygttttttagtygygygttyg

SEQ ID NO: 5948 - DNA, 990 bp, synthetic construct
  misc_feature 1..990: note = Description of Artificial Sequence: Synthetic polynucleotide
  source 1..990: mol_type = other DNA
aygtggtgtgtgtgtgygygygygagtgtgtgagygttaggggtygttygttygtygyggtttttygtgggttggtygggttaatgagygygyggttgtaggggyggygggyggggagggggygtygagttttgyggatggaggygygggtagygyggygygtttatttygygygggygttgttggyggggggyggygtagttattggattyggatyggggtygygattyggggtggygggtggygtgggyggygttyggggttgggatgygtygggggtttagtggyggyggyggygttggyggtggygtyggyggttgtagggggaygagttagygtygyggygttgggagttagttgagttyggtyggygagyggaggyggtagygtaggtagagyggyggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgygttttggattttggagatgttaattttagttyggatatttgggttgtgttattyggattattygggtygtatagagtatgyg

SEQ ID NO: 5949 - DNA, 2274 bp, synthetic construct
  misc_feature 1..2274: note = Description of Artificial Sequence: Synthetic polynucleotide
  source 1..2274: mol_type = other DNA
tygtttttygtgtattgtttgyggttygtttygggtttataygggatatygaggtatgatgaggaygtagaatagtagaagygygttttgtttttygggygttagtgttyggggttagyggygtgtattyggygggttyggtygggagygggttggygatygyggggttyggygttttyggttttygygttatttttyggygttygttaatttygtttygttygyggygtagagaagttygtagtttttyggagttttagygattttttggttygtttttttygtagtygtygagtagygtaggttyggygatttygggtgtagttggttttgtgyggtgatatygtygttyggygttaggttygaagtygtttggtygygttygyggggtygtaggtygttggtttygttyggtygygtttataaattattygyggttygtgattygggataaatttttggyggyggygtagttttttttatagttattttttttagagttagttattaaaatagaagaygyggtyggggygaggaggtgggyggggggagttyggtggtygttttttttygygyggttgaygttygtttyggyggyggtagtggttgtggtygyggggtygtttttagtygagttttyggaggygttygggygygggtyggyggggtaygggygtttaygttttttagygggtygyggyggygtygggyggtygtgaygtgagygttttttttagtyggtttgyggggtatygttagttagtyggggagtaagagtttygygygtagtyggygygggttyggttatyggygygtygtygttyggggttgggtttggggttgtttgtggagaggyggygggyggaaygygygyggttayggttayggttatygttayggttayggttggtagttygggtttygggtttygggtaggggaaggggagaggyggygagtttagtaatyggaatygagggaagattttggtttygygggttygtttttygttttttttgttagyggygttagaygtygagtggggttagggataggggaggaggatttaggattttgtgttygygtttttggagtygttggagttyggatttttgtaattgttggtattttgggggtttggtttagygttttgttgtttattygttttttttygttgtttyggaattaaagttttyggtttttttygttttygygygtttatttatygtygtyggggagyggttyggttygtatttagtattatgaggggatttgggatttgtttggygattttggtyggatttttgttaattgyggygggygagaygtttttaggtaagygggatygtttttgtygttttygaggygygygggtyggygygggaygttygggaygtygatagttttttggtggtagagttttaaggttggygtyggggtygggyggggggygyggygggtyggatatygtttttgtttgtgagtygggygttgggygaggggtygtggggttggtaggtatttagttttygggygggyggagyggayggatttygagggygagttttttagtygggattgttagttyggtygtygttttttygyggtttgggttagtgtttaaggttgggyggtttgtatttttgagtttttggtyggttgtaaaaggaatagtagaaaattttgtttgaagtttttagttgtagtygtygggtygtttggygtaggygttgygyggttttygtygatttygagtagyggtygggtttaggtygttggtgttyggttgygttygtagygatygtygggaattggyggtygtttyggyggyggygatttttyggtgttttgttttttttgtygttttttgttyggygyggttggygatttygggaggttttygyggtygtgtagygtttgyggagaggttggggggagtttttygtyggttttagyggtagggtttggyggtygyggagggaagygggtaggtttttaggttttggttayggttttgygtttygttgggttttttttttttattttygtttttttagyggagygtygyggttagttgtaatttgtttatttagttyggttgttygggggttttaggtgggaaggagaggtattggyggtgtgygagtaagygtgtgagtgtgtgygygtgtgtgtttgtaygygygygygggggygttttaagtttagaggaattttttayggagaggatttgtggatyggagtygggggttyggygtgggggygaattyggtayg

SEQ ID NO: 5950 - DNA, 882 bp, synthetic construct
  misc_feature 1..882: note = Description of Artificial Sequence: Synthetic polynucleotide
  source 1..882: mol_type = other DNA
gygaagtgattttttaygtttggataaagygttygaaagtttaggttygygggttagttttagtygttgggtttgataggggttagggaggygggtyggttttatagttaagttatagttttagggtttggtygtatttgagtagygyggtttygggttgttgttggygttgtaggtttygygtttgattttttagtttgygtagygggtattyggtygggaagaatttttttagtaggyggtttagtattaygtttaygygttygygttygygttygygttygtggtygygygggttttagttttaygtagygtttatagatygtgagttygtagggtagtgttatyggtttgtgtagtagtttygggtagttaagtaggtygyggggygygtygggygttagggtyggttttttttagttttgagttygtygttyggttttttygttaatagtggtygttygygtaggtygggatatattaggtygttygttagtttttttagttttttyggtygtagygtttttagtttttyggttatayggaaygygtttagggttatygggaggyggtyggygygggttagagygttttttagttttaggtatyggtygyggtygggttgygttagtygggttagtatggagyggaagagttygattgttttttggtattygttygygyggaaggtttygtygtttttttttaagygttgggygattggtttttygtagtagtagttygttattggggyggyggygggatyggtttagtgttgattttygyggggttgagatygtgygggtttggagygaaggygyggagtaggggygatgagttgttgttgggaattggtyggygggagygyggttatagttttyg

SEQ ID NO: 5951 - DNA, 4359 bp, synthetic construct
  misc_feature 1..4359: note = Description of Artificial Sequence: Synthetic polynucleotide
  source 1..4359: mol_type = other DNA
tygtgttttayggaaattattattatygtatttataggtttygaggggyggatataaagttttttgggggaagtggggtygtagatttttttygattygaatatagattygtatagggygygtttgggygtagtttyggattttaygtygggttygatttggttgtttttggggaggatgtaagtgttttttagygagggyggttgggggyggtggtggtgggagggatgggtgggggggtggtgggagtggtgtygtgtygtttygtttagagtttyggygtagtagttttgyggggygggygagtttagtttggtgttaatgttygygatgttgttgagygtggygatggagayggygtygatgtagtggttggtgtaggttttggagagtttggtygttttggagagtatttgtattygagtgtttagtaagtttttgtygatggttttgttttygtattaggttatatygttttygttgtagtggtttyggggtygttggaagaaygttttgtagagagggttgygtttygataggtatttgaygaagttggygtaggggtagaattyggtgttygttttatatatgyggggtaagtttttttygtygttgttttyggygygttttttgttttaygaygaygagygygatttgtggtagggttygagggatttgaagtagaygaatttgygatygttttygtttatggttagtttaaaagagtttttttttaatttaygttggttttygyggtygygggtatagaagtatatgtaygtttygaattagattttgttgagtagttygaagggygtgttggtgttgaagaygttggaggtgtatagtttgygtaggtyggygygygtgatggtttgtttttgtattatyggttyggygttttgtttttygagtttgyggatgatygyggttagygttaggttggygttgygtagttyggggtttttggtgaggtygagygtgyggtagtaygggggtttattgaggtagyggttgagggagttgyggatgttgatgagygaygatttgttgtagagttggtygtttttggagygggtttyggtatagaaggagygtagtaygyggtatagygtttttttgtttatggtttygaagttygggttttgygttttttygtttaggtattttyggaagatgygtayggygtagygggtggttagtygggtgttttygtttagtygggttygttyggggygttgtagtaygtyggggtttagttyggagtygttttygggyggtttatygygggttyggggygttagtagtygyggyggygtttygggttttagygyggygttttggtttatattgattatatggatyggttygggttttagttttttttyggtygagttttygggttttaggggttygttttagtttagttttattttttttttttttttttttttttygtttttttttagttttttattttygttttttttttttttttygtttttygttatttgtattttttggatttygtttttttttttttttttttttttttttttgttygygttgtagtagtgyggayggttgtggyggyggtygyggtttttygygtygygttygttttygtttygttttttattgttttyggyggyggyggyggtagygttggygttgtygttygygttggtgttatagttttygttgttaggtattttygttatattgtygtttttttgttagttttygggtagggygtatgygttatattggatygtagygttgagagtttttgtgtttaatgatttttagttatygggaggtaaagtygggtttttaaaggagtygygttttaattgttattttygagygtagtttyggaggggtagyggygygtaggggatggaggggaggggggagggggggataagttagatyggagagatagggtaaaggayggaggttgattagatttttttttttttttattyggtttttatttttaagaaaattttgaaggaaaaaaaaaaggaaagggagggagagttgtyggtgggggygaaatatttttaatttattttttggyggagaattgygygggttygggygggagagagggagggtyggygagagggygggayggtttygtttttttaagtaatgttygaggagtagtgttttttttattgtttttttattgtttttyggagtyggggggtyggggyggyggttgygtygggygggtygygggtgttgtygygggaaattygtgtttggggtygttyggagyggagyggagtaggtaggttaatgagtagggtggaggaggtayggygaggtttygtattttttyggygttygyggttagggygtagygggygaggtttgggagygggatggggttggyggyggyggyggtttttttatttatttgttggyggygaggygygggggtttggggttagtygygyggtttttaatttttttttygatttttgtaaaggagygaaataygttttaygttagttatatttttttygatttttttaatagttatatttaagttgttattaaagatttggggygtttttygtaggtttggggtaagttygygtyggtttagttagtttygggaaggagygaggtagagaagattgggaggggtyggtgggaggggagaygagggaagaggygtttgggattttaggggttatagggatttttttttattygtttagggygtygttttttttgtttttgagtaaagtgatataattttttygggygaggygttttattaagttggagttgaagtttttttaaggtttatygggtaggyggaaaaagygaatttgtgtttyggtygattttgtygtagttataattyggtaattyggattyggagygtatttttatttaaagtttgttaatygttattygttygtttttygggttgygttgttttaggygygygggggygggtatttyggaaattggaaaagtagttaaagagttygtygggtttygtttttttataggagatattgttttatttttagttaaaygttygttttyggygygtttaggtttygggygygtttttgygtygtygtttttygttttttyggtttaggggtagttttttagagtygtyggggatttyggttgtttttttaggaggtatagtttaggttattttyggagttygtgttgtattttaatttttattttttttygtagttygtgtgtattttggygygygggttagttgygagtttttggggtgaggggataygagggagttaggtttttagtagtgygtttyggtgttaggtygttttgttgggaggtagtttygtttgtttttygggtgygttttygaatttatttttaagttygaattttyggtagttaggttgtgagagttatgttaattgtttgttttttttttttttggtttttttgttttgtttttaagggaagtattttaygtattaattgaaatttatttattaatttgtattttttttttttaagaaagaatgaaagattaggttttagggtagtgtgggtttttgagtgggagttgaygatgtttttttttgtagygaaygttgttggtttttygygtgtttgttyggttttggaygttattygagtttyggggaaatygygttaggtgtgaaataagttagagtaagtttttgtttygygggtygttttyggttttttagggaaatataagatatatagatatatatatatatatatatatatatatatatatatatattaygtttttattygttyggtttttygyggagaatygttygggaatygttttygaggtgyggygygggaggtggtyggttttgtttataatgtattgttygtygtattygttttggataygtgtagaaaggygtgttygttttttygaggttgyggtgagtagttaagttagttgtatattgggatttttatataygagttggtatatattagttatatayggttaattttagagggttggttttttgttttgggaygtttttaggttttygggtygyggtgyggagaatttaggtgggtgttyggtaagttatttattaggggttgttttttygygattttygttataagygtagggattygggggtygygttggtttygggttgygtttttggtttggtaggggattaggtttaygttgtagtttgggagyggagtygttttttaggtttttttatttttgygggyggyggggtttattttttttttattagtttttttttttattgggygagttgttttgaattgttygtagtttgtyggaggyggtgtgttgggttggaygtttyg

SEQ ID NO: 5952 - DNA, 2762 bp, synthetic construct
  misc_feature 1..2762: note = Description of Artificial Sequence: Synthetic polynucleotide
  source 1..2762: mol_type = other DNA
aygattygggaggagagygtggagtygggtagggataggygtgtygtattatggygtattatggatagggtttygygyggyggyggtttaygatygtttaggggttgygggagaaagygygagagattgyggaggttagtttygtttagtttttgttttygttttagtagtatttatttttyggygggtyggagygygttaggttttgattygtgaagattayggagyggggtaatttatattatttgtttttattttyggagtaggtattttygagttgygttygtatttttyggggttgttagttggtagtagagtatttttttttttgtttygagggygataggtagggggatttttygtggatttttttgtttygyggygagggtgggtaygtttttttttygtaattttygagggattttayggtaggyggagatygatttgggattagggtattgtattygtttagttagagggtttyggtygaggttgtgtgaagtggtttttaggtttgggttggttggtygggaggagtttgggggtattttygggttggaggyggyggaaagttgggttgttttygggttgggaattygtagygtgtagtggygagggaatttgygttyggattggagtaggtgttttttgtygyggaggagttttttagtagagattaaatgaaaaggttygttggttttttttygagggtatgaaaagtayggaaggttttaggtaaaggygttttyggggygtatatagggtataggtagtyggatagagaaaggagtagtygygtaayggaatttttygttygggggagatattaggygtgagaggttagattygttttataggtaggygttgatyggtagagattttttygggtaagagggttagattttttttttaggtgggaygaatatagaatattgtgagggtaagagaagaagaaaaggaggtaattttagattgggataaagataataggatagtagagtttttgagtatygggaggygtaygggtgtagggtggggtaaggtggaggtaagtttygtaattaagatattagagtgagaatttttattgtaaattygygatttatttttgtagaaataaataaaaaaattggagtaaagtattatgygaggggygaaaggtatagaaaattgtaaaatttgggagttattttgttttatttttttgttgtttggggatatttttygygagtttgttyggtttygaagaaggagtagaggggattygtaatttagtttttagagtttygttaggaaaggygygagagatttattggtttyggtaattttgtttyggygttyggayggagttygatgtttgygtagttatyggttgygyggygyggygyggygyggygtggtattttttttttygggtgygtagttyggtttygtagyggygyggggaataaagggattyggygtygttygttttatttygttygtggttyggttygyggggatygtygygtatttgaagtagggtygttagtagyggtagtagggttygtagygttttygttattyggtatatggaggyggagaggggtygagygaagagtyggaggaggyggyggyggyggyggyggyggyggaggaggaggaggtagyggtagtattaatagyggygyggagaaayggttttaggtagtttttattttttttttttttttttttttttttattttttttttygttgtttttygtttttygttaatggagagygagttgatgataaatagygggtygyggagttygygggattygtattaggagtaataaaatagatttagagattaaggagttggggagggggygggggaatagggagggagagygtgtgagygtttgygagtgtgtggaggyggttgttgtggtagygtaggyggttyggtttyggttyggagygtagyggaagtygygagggatgtagyggyggggattttggtyggtggaggatgtggaggtggaagtggagyggatggygttttttaagagtttygttaygygaggtttygggttygtggttttgtttttttygggttttygttttagggtygttyggygygaygaagaygtyggggatagygtygyggggagggygtttygggtygtgygtgttgtatttataaagagtagtagtttygttatttygygttttygttgygtgggggtygaggggygtttttyggttttttttttyggtttttyggygagttggagattgtttttyggtttyggtygtaagggggtgaggygaggggtyggygyggtttttttygtygyggtttygtttygygtagttgttgtygtagtygtttttgttgttygygtatyggtattygttygtyggttttygttttgygtygtttattygygygygtygtttttygtygtygatygygtatttygttyggttttygttgygygatttgggygagtygtygtygtttttttygygttygttttaygygttgtttggttgygyggttygttttttttttttatttttttygtygtygtygtygttttygttttygtttttttttttygttgagttttttygttygygtygtggttaatyggaggttattaagttgyggttgtagtyggtyggattygyggtagtygttygttttygtttygtygaagygtttygtattttgttgtagttygyggggggtygtyggagggaagtttagagtgygtygagtatygtttyg

SEQ ID NO: 5953 - DNA, 338 bp, synthetic construct
  misc_feature 1..338: note = Description of Artificial Sequence: Synthetic polynucleotide
  source 1..338: mol_type = other DNA
tygygggagtygygtaggygggyggttagggggagtgggygtygttyggtagygtttygygtygaggtataagygttygygtygaggtataagygttttygatttatyggtttygygygttttttygygygtttttyggattygygtttgtttattttttyggttttgttgyggtygaggttttaagtyggttatttygtgtttaggtaatygygggggyggyggyggyggygtgaggagygggyggttgttgtttyggggttttttggttygagtttttagttttygattttyggygtttyggygttygattagygttttaggtygttttygtttyg

SEQ ID NO: 5954 - DNA, 1435 bp, synthetic construct
  misc_feature 1..1435: note = Description of Artificial Sequence: Synthetic polynucleotide
  source 1..1435: mol_type = other DNA
tygyggtaaygatttttgggagtgatygaggtattygggttgtttygtgtttttygggtagygatttaaygataaaatttgatagtgttttggggaaaattttatatttatygttagygttatattygggttttatgttaataaggagatattgtagattatygattagattygtttgtttttagagygtgyggtygggtttttagtttggtttttaggygyggtggyggyggtgggataygygttaggygtttagagaaggatatgggataatggtttagttygaggaygttagaygtygtygttygattyggggaaggaagtttttgtagtyggttygggaattygaggyggggagggaggttagttttggaggtgygttgtygttttaaaataaaggattataaagattgtatagtggggaaaaygygtttggttaatgygagtggggaygatttggggagggggttgaggaaggtagggggtataygagttaayggyggtttayggttttttttttttttygtttttttttttttttttttttygtygggttgtttyggtagataaataatagaggaaggygagttatttatygtggttttgataggtaygtagagtatttgtttggygtygtygtttttttygyggatttygttyggttggtttagttggaagtttttygatttgatttagaatttaaatttggygttgttygtggagttygattyggagttattgaggagttggaygattygttygtattttttaygggttatygttttggttttgtttgagttttygtaagttttgaggtattagttttggaattggyggtatatgtygygttygttttttatgtttttygygttyggtygttggtyggatgtttttagygtatttygtatttgtttattttaggtttatgaaaaatgtagtttyggttaygttgtagggatgygaggtttyggtygtagygggagtttgttttgggtgggggaagggatgggaagaggggaggagggttyggttgggtattagtaattaatgtttygtgttattaagtttggtttattygtaattgtaayggttgtttyggaygttttttttgtttttttagyggtyggtttttttaatattttgtgattaggattattttaatattattttggtttagaggagttgggtttttaataattaaaattttattttttggtttattaaaaattttaatattgaattggggtggtttttagaygtttygttttygggttgygttyggggttgggtaggtggagygtagygtygttttttygygygygttttagaagtttttttagttattggtttygtggtttaggagtgagggttgygtttttttygaaagtagtygttygtttagygtttttgagtttygaagggtataygggtttyg

SEQ ID NO: 5955 - DNA, 510 bp, synthetic construct
  misc_feature 1..510: note = Description of Artificial Sequence: Synthetic polynucleotide
  source 1..510: mol_type = other DNA
tygaggygygatagtttattaaagaygagggttggttttttaaataaatygyggtgattttatttgyggygtttttttttaygtyggttttttttttttttattagagyggttygygtygattygatgggyggattygatygygtaygyggttygygggttyggyggaggtagttttygtttyggggattygggaygygtygttttttygttttaggttgttygygtaggaattttayggttayggttaagtggggtttttgtttyggatttygttgggttyggayggtygagagtttagggatttgggggggygygygggttttygagtttaggyggggyggygggygttttgtygtttttttttygygygtygygtygtygttyggtttttygaagtygttttttgtyggygygtyggtygtttgygttayggygggygttatttatttygggtagagttttttgttygtgtagygygttttgggtttttagygttgatttaygttyg

SEQ ID NO: 5956 - DNA, 2722 bp, synthetic construct
  misc_feature 1..2722: note = Description of Artificial Sequence: Synthetic polynucleotide
  source 1..2722: mol_type = other DNA
ayggygatggatagtattttyggttttyggtyggttaggagttygygagttygttygtttagygttttgggttygatyggtgtagttttttttatttttattttttaggtygttgtatttaaaaatttaagtttygttttttygattttttttttttttttttttatyggygttygttgttttttttatggtatygtttttattagtatttygtttaaaatttagttttgttttagygaatagttttttaygtattttagttttggttttygttgttygagygtttttttttatygygttygttygaggttttttttygtttagttygtygttygttagtygtyggtyggtyggtyggttygttagttygtttttgtttttyggtaaagttgggagggaaaggtgtatttatttttgtgtatgtttgtgaatttgttttttagaatygtaagttygtagattttgttaaatttttygaagaggggtttgaggttttttttatttaggttgygggggatttgtttaatgaatagtttgatggtatygtggttttttatgggaatggtygaygggtttttygggttgtggtttaattygtttatgtgttyggtattgttygggttgttgtygagttygttggtattgaggtttgygttgttagtttgttygtttgttaaygtggttatttttatatatatagagaaaattttttttttttttattttttttygtttatattttttygtttttttttttygttygttygygtttatataygtataygtatatatatattygggttttttttttttyggtttttttatatttygtttttygttygttttttgttttttttttttttttttttttttygttygttygygttygygttttttttttgttttttttttttttttttttttttttttttttttttttttttttttttttttttttttttttttttttttttttttttttttttttttggtttgatttgatttttttttttttttttttttttttttttttttttttttttttttatattgaatagataggatttttgtttttttygtttaaataggttggatyggtttaagtttttagttagattaggggtgggggtggygagtgtgygygygyggaggagggygyggggggtygggaatgggygygttgtgggggttygygttayggygggyggyggtygggggtagggyggygtggggyggyggttatygygtttttttygtyggyggtttygygtygtggygatggtatagttygagayggttttyggttataaatagygttaggygtatggtttttygggaggygttgagatttygggttyggyggtygyggggagygggtgttygtgaggagtygggtagtyggttttttttttttgttttttgggggttttttttgtaatagtagtaggtgtaattttttgtattttaaaaatagtgatttttattttygtgtgggtatgtaggggggttttatttattaagttatgttttattagggygttaggygggygaagtaaaggtagggatggygggyggggyggyggyggaggtggaatgggygttttttttttttatttggttttatttatttatttagattagaaaagygagtyggtttggagggagttygttyggggattygagygygtatttattagtgtygagagaaaaaaagttatataaatatatattatgtggataaatttatagataagagttttttygygygygttttttttttgtttttttgtgtgtgtttttttttgttttttttttttttttgtatttttaatttgttagagtagttttatatttttttttygttyggtatttatygttatttaagttatttgttaggatggggttgggagttgtygggtygygtyggggggtagagggayggggagtagagattyggggttygattttygttttaattygttttygaaggyggaaggtgggggttttygtttygggyggtttttttygtttyggagagygyggttggtttttyggtggttggygggaggaaggtaggagtygggygtttttgttygttygttygtyggagggggaggaaggygttgggygyggtggtyggtgagttagygygggggatggtttgatttgttttygtttgttttaygggtttaaatagaatatatttttttaattattattaaaagaataaagtttttgaatygttatttgggttgtygtyggatygagattygygyggygtgygttgttttygygggtttygttttyggtatttatagttttygaggtgygaggttgagtygtttttgtygtggggatygggggtygagtygttyggttyggatttygtyggatttttygttaggtttattggggttggtatttyggttgygygggaaagggagtggtaggygyggagtygggagtagggttygagyggtttygtttgtaggggtgaatattggtggtgaatttggttggggtagtagatttttaygttaatgatatttatttgtatttygtttttttttatgtttgtttttttagggtagttttttygttttagaagtttggtaaattgaaataaygygttygttttttygygggttgyggggttggggagttggggyggyggggttgagyggttggtttaattttygtyggttttyggttagttattttyg

SEQ ID NO: 5957 - DNA, 1133 bp, synthetic construct
  misc_feature 1..1133: note = Description of Artificial Sequence: Synthetic polynucleotide
  source 1..1133: mol_type = other DNA
aygaygyggtgygttaggtagagagtttggggagtgtgygtgttttatttgtgtttgtatygtgtgttttttttgtgtgtttttgagaatgygtttttggtaygygttttgygttaataaggygtttggtgtgtgtatgtttgtgtgatagtgtttgggttttgtttgyggttgtttgttygtattttagttttttttgtgttygtagttaggttttataygtgygttagttttygagygtaygttttygagtgattygtgygyggtgtgtagggattttagggtygtgtgtattaagggygttygtgttygtttttttgtattaaggaaygtatttttatatgtttgagtgtaygtttttttttatgtgtgtaygtttygtgtttaygtygtttatgtttgtgtaggggygttttaygygygtttttttyggttygygggyggttagggattygygttgggttttaygtttttygtggggttgatttttttttygygtttygtagygggtygtagygattggtygtyggtttttttttagtygttattttttttttttttygttattygygygttygyggttttygttgtttttygyggtttyggygaggtygygtygygttgygtttygtttttattggttgygygygtttttgtgtggyggtagttgyggttttagygtttttgaatgtygagaggggtygggaagggagtttttttatgggttatttgttttttygttagtygtygttttatygtygttygygtttygygtttygtttttygtttyggyggttttygtagtttygtygtygttygygttygygttttggagtygygttataaagggttygygygtagtygtygtygtygtygtygtgygaggagttaggatggttttggtttaygtyggttatttygtgtttttagtgtttggttttgtgygaaatagaggtatygtttttttttttyggggtttgtttyggagygtggatygtygtaggtatyggggygggggygggygtygygggyggtygggggtttagggtatattygygaggaygtagggygagyggtggtttttttttattttattttagggggattttygagggtgggggyggtygttttyg

SEQ ID NO: 5958 - DNA, 2401 bp, synthetic construct
  misc_feature 1..2401: note = Description of Artificial Sequence: Synthetic polynucleotide
  source 1..2401: mol_type = other DNA
tygaaggtgtygttagttttagtgtyggtgggygtttgtattaggaatagttaaagtygaygatatttagttatttygagygttagggaagaygtttygygtaaaatygyggttttaggyggattttygttttagtttygygttgttggtggtattttyggggatttaaagtgggtggtttgggggtaaaggaatagaggtygaagaatttggggtatgttttattagagtatttaagggayggagtgggaggttatattagatatgygatttygatatattttaaaagtggtagtttygtgggttatttttaatagtgggatggatttttttaatttttttygtttttygaagtttttttgttatttygggttatgtttttttttygggatttttttgtgtaaaattatttttttttttgtttaaaggattttttttttttttttgattttaygaatttatttttttaataggtttttaaagtatgggyggatgtgttttttttygtttatygttaggagtygagtttyggtaggtgagyggtgtaaaataygtatttagttgtttttagtttttttygttttygttgagttggttgtttttatttygtattayggtattygagtttgtgagttttygatttyggttttagtygtagtygttaataattttataataaataagaggataggattgagygttygygtttyggagygtattggttgggggtaattttttattttyggygygtygttygttgtttygattygagagtatygggagagtygagggaagggaaggyggygaggggaaggtaggyggggatggagggaggtayggygyggygyggagygaggaggtgggttgtaggggaygtygagaagyggtggggttggygtagagggygggygttyggggygygygttattttygttttgttttygtagtggtagtatayggtttataggtatttgagygttygttagagtaagatgatgaagaggttttygaagaaagttattatggaggaggttaggaaagtttattatatgygttggtttyggttgtygtayggtatttttatggttatygggatgatgagygtatttattttgggttygtggattgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttygttygggggggagggggatggagtgygygggtagtttttttttttyggttygygtttygttygtttygggttgygttggtttygagygtygagagttagggggygtygygggtygttygygttyggggtttgygtygttttygggttygtttyggtttygygygyggtttygggtgttttyggygtygygtygttygtygtgygttaygggtgtgygttgygttyggtyggtgattttttttttygagygtttttygygyggttaaygagtygtttttygtttattaggtggtaattygttaataatggataatyggtttttttygttygggygtttttgygttagtttttttttttyggttgygttyggtttyggttygtygygttagtgygygttyggtygyggtaggtttatygygttyggtygtyggttygtggtygtttgttagtttatgttttygggattttttagttttgtygttaygtygttgagtttttyggttttygttygttttttttttttgtygttttygattttttttygttttygttttygtygtttaagttttttyggygygygtttygygtttttygtagtygttagtagtagtagttgtagtaattggagygggygyggatttaggaygatttaggygggaggggaggaggttygtygygttggttygtttgggtttygggttgggtaggggtgggtagggtttttyggtagyggttyggtaagygtttttgatttttagggygtaaggtagagygtttttagtttaggygyggggttaggygtttttttttaaggtgttgygtttttagtygagagyggtggggtatattgggaggayggyggggygtttyggttaggtyg

SEQ ID NO: 5959 - DNA, 769 bp, synthetic construct
  misc_feature 1..769: note = Description of Artificial Sequence: Synthetic polynucleotide
  source 1..769: mol_type = other DNA
tygggaaygaaygtgygtggggtagtttaaatttttgagtttagatttygtttttygyggttagatggtgyggtyggtggggttygagggatgygtatagttgtgtttgagaggtgttgttttttygttatygaagtygttgggaaattttgttgtattgagatattttaatgtyggatgttttaattttgygggtaaaaaaaaaaaaaaagtttgaattaggtattgggtttttgttayggtgaattttattygygtttygygtygtttttttatttatttaggygaggtggtttggatttgtatttygttgaagaagttttttatgygatattttygttagtatttygygyggatttggttgggyggyggyggggagttagtttgttatygtayggyggtygggatygtagtttttgggtgygtagtgygtttttygttgygtttttttagagygygggtttygtgtttgtgttyggygygaygygatttttttgttagtygggtttygygtgtttttygygtttttygtagttttygygtagttygtagygttttttagtttygtttygyggtygygggaattyggygtttgtagtttygttyggaatygatygttaggygttgttgtygtyggttaygtaaygyggggtttttgtttggtattagttttaggtgttttgtttygggtygtgttgtygygygatattggggatttaataggtygtyggttatttagttggtttygtagtttttttgyggtttagyg

SEQ ID NO: 5960 - DNA, 1169 bp, synthetic construct
  misc_feature 1..1169: note = Description of Artificial Sequence: Synthetic polynucleotide
  source 1..1169: mol_type = other DNA
tygtgtttttttygagtggatttggtttyggttttaaatttagtygagggtyggttygtttttggggattygyggatgtygygagggggygtygygttattgaaggttgggaygggggyggtgygyggggyggygtyggagttygggatgtyggttttagagaygtygygtttygtttygaggaggtygtyggtygggtaagyggagttyggagttygyggagtttggatygtaggtaaagttgagygygtygtggggtygggggtggggggttygyggygaaggagtyggggtygtagtgggyggtggggyggggggygygggtttttgtttgatggtttygygygtagtttttttttygggtgygyggtgygygygggygygggagggtygaaggggattttggaatttttttgttygggttaagggggygggggyggttyggggtygggyggggttggtgtttttttttttygtttagygtttagagttygggagtygaggggggygtygggtyggaggygttygtyggtttggtygygtygygygygtggatggaggtttyggtygyggatygtttygtttattygygttggttttgygggagttygggtgagtygaaggygaggaaggggygygggtttygggaaaattygattttttyggygttygtttyggttyggttgggggygtattyggttygygyggagagygggyggggtgtgggygaatgttyggygygttgygtttttttyggtttttttttttttyggagatgaaygttttattttygttyggatatayggtygtatttttattttgtttttttygattagtyggggygyggttygaattgggggagagaagatttagttttygtagtygygaattttgtaaattyggagtttatgygtttygtttttyggttyggggagtttttagttttgttygtygagygtagttygggttyggattgtggttattggggaygagaagggttttttttgyggggttttygggttyggatggayggagggggygttyggtaggtgaattgggttygtttygygtttygaaygtttttttaaatttataagtttyggagattttggggtattttgygatttyggagtgatyggtggagttttygttygygygtttggttttyg

SEQ ID NO: 5961 - DNA, 6036 bp, synthetic construct
  misc_feature 1..6036: note = Description of Artificial Sequence: Synthetic polynucleotide
  source 1..6036: mol_type = other DNA
tygtatagtttgattatygtgagtaaygygtgyggtaygttttggaatttgtyggttygtagygttygtgattaggagttgttgtgggatttgggygtygtgggtatgttgygtaatttggtgtattttaagtataagatgatygttatgggtagygtygtygttttgygtaatttgttggtttatyggttygttaagtattaggyggtygttatygtygtgtttttaggtagttgygtgtttagtttgtaygtgygtaagtagygggygttggaggtygagttggaygtayggtatttygygtaggygttggagtatttggagaagtagggttygtyggtagtygaggtygttattaagaagtygttgtygtttttgygatatttggayggtttggtttaagattatgttttygattygggttgttttgaygaygaygatgtatygttatttttggttgyggtygyggttatyggggagttagttagttttgtygygttgtttttttttttgggtagtttttttttgtaggggtaggygttggttygtatttygtttattygtygaggyggtaaggaggtagagaaggatattagtggggaggtagtygtggyggttaaggttaaggttaagttggygtttgtagtggygygtatygattagttggtggaggatattttygttttgtatatttygttygaygatagttttagttttagttttggagattygggataggaggygttaygggagggtygygtttagttttgttygttatgtygyggttyggagggygggyggygagaggtaggaagtygggygtattygttgttgyggtttaaggyggtttaygttagtttttttaaygatagttttaatagyggtagtgttagygaygggtattgtttaygygaatatatgttgttttgttygttggtygtattggtttygygtygygaggattttaggtgtgggtagtttyggtttagtyggtttgattttgatttgttyggttgttaggtygagttttyggttygygaggttattttygtygaygttygygtgygtattattaagttgtygtttatttattagtaygtgttattgtttgagggtgttttaagggygggtgtagagtttttygyggggtttggaatttttttaggggttyggaagtaggtttggttgtyggtagattatttgagtaaggttttygagaagttggyggttgtttygttgtttgtggttagtaaggtattgtagaaattggyggygtaagaggggttattttygttgtttygatgtagtttttttttttygttgttttyggtyggtygtttaggttttagygagggtggtgatttggatgatagtgatttttttttggaggggttggaggaggtyggttttagygaggttgagttggatagtaygtggygggygttyggggttatttygttgttygtagttatttyggtttttyggygtaatygaggtyggggtttgggggtggaagaygttaygtygtttagttygtyggagaattaygtgtaggagatatygtttgtgttgagtygttgtagttttgtgagttygttgggtagtttygagagttygtttatygttagttttatttttagtgaattttgtagygggtagggtagyggtattattagttttagygagttgttygatagtttyggatagattatgttttttagtyggagtaagaygttatygttggygttygygttatagggttttttygaggttatttagtttagtttgtagtgggagagttaygtgaagygttttttggatatygtygattgtygggagygttgtyggttgttatttgagttggaygtaggtagygtgygttttatygtggagaagttagaygagaatttttygtgygtttttagttttagygygttggttttgtaygagtattaygtgtagtaggaygtggagttgyggttgttgttttyggtttgtttygagygyggygggggygtygggggygtyggtttttattttgtagggtatyggyggygggaggaggggtyggygtttaygggttttygttttygyggygtygyggattaggagttggaattgttgygggagtgtttgggagtygtygtgtttgttyggttgygtaaggtggttttygygttggtgttaggtygtygygtatttttygtgttygtttatatgttggtgttygtttyggtttyggtttaggaggaygatttttgtattgatttygyggagggtaygtyggttaatttttttagygtygtttygtttagygaygagaygttgtagggattttttagggattagttygggggattagygggtaggtaaagatttatyggtygttttatttttgttagataggttatggggtatyggtataaggygggaggygtyggtygtagygyggagtagtttyggggygygggtaagaatagagtagggttggagttgtttttgggtyggttttygagygttttygtagataaggayggtttaaagttyggtyggattygyggggayggggygttttagtygttgtgttttaygaygtttattgaggaggtygtgtattgtttttayggtaaygattyggaygaggagttttyggyggtygygtttaygttaatttatyggygtatatyggttatttttygygtttttaygygggagygttygtagggtyggaaggaggtttttgtttygtttaaggttgtattagttgtttygtygttygttyggatttagtttagttttattgttgaygagatttygttttgttattttttgagttttttygttagtttttttagygagttygagttttyggagtygtyggtygtttatttaygaggtygggagttygyggttattaaggattygggtttaggaggyggaygygatagttygtttagttygygggtygyggaggagtttttgtagyggtgtattagttyggttttgtttaggygtyggtttttygtgtttggtttgyggygtygtaagtttygagttattyggttggatgagyggttygtagaggggtttygggaaygyggygaggaggtagygggttyggatygggttttygatttggatagygtggagtggygygttatttaggagggygttaatttaattgttaygtggttgtattaggtagtagttgttaygygggaggtttygttygagttygattttattttgtttttygtattygggttgttagtgggatttattttatagttttttaagtataggaagggaygataggyggagggagaaatgggtagtgttyggyggttagagaaaaggggygtagttttagttaagattagygggagttttygtttttttgtaggtttygagaagttaygtggtatatagaagattaygttyggggtgttagttgtgtttyggggaygaatagtgatttaygtttttagttyggtatttygtgtttagtttaaagggattttyggttttygygttatatygyggaaggtggygtttttttgtttggtatagttygyggttttagttaaagtttygagtttygggtagtagyggtygyggagtttatatyggtttgttaagatttyggagttggygaygttgagttagttttttagaagygttatatygttygttygtttygttaagatttttttttttagttttttttagatttygttygttttttagtttttgtttagaaagygtttttyggttatttaggttgttggggttttgttyggtttyggagttttttyggtgtttaaaaygtyggygygtatttttttggygaagtagtataagaygtagagatygttygtgyggatttygtttatgtagaggtyggttyggygtgggtygttatygttggttygggtagtttyggagtygggttttaggggtygggyggggatygaggygggttygggggygygygggggtygtttgggtttggtgygtgtggttttagttttttttagyggtagygagtttttygatygttygggttttyggygatagttaatttttattaaggagtygtygggtttgyggygtygtygtttygagttgttttyggtygagttygyggtttttgttttttagggygtttygtttygtygyggtyggttygygttgttygtygtttttttttgtttttygygttgygaagagtttygagyggtatttyggtagggttyggtttyggttyggtagyggtttttygyggttygatttagttttggygagygttttgttyggtgtattattttygagagttygtttygtttgtttgtgygygygttygtygttyggtyggagattgttaagygttaygygtygttgtygtatattagygtggttygtaggttygayggygtygttttygyggtttttgttttagtygaygtygygygtygtagtagygayggggagtttyggtygttttttagggtggtygygtygggtaygatttggyggygtattygagatgaggaygtgttttatattttgygtagtaygtttttygttayggttttgttattgyggggttttaygttygaggaygtttyggtygggttttygtygygtaagattagygaygtygtggtttagatygaggaggtygtygtttttaagattaattttagtaygttttygagtttggagattagggagtttttyggggttttygtyggyggttagtttttttttttyggtagygaygtggayggttttagtttygttaaggtttttattttygtatttttygtgtaygagggtttgggggtygtygtggggggttttttygttagtyggtayggtttttttagtygttyggttygagtatttttttttaattatgtgtttagttttatggtggtygtagttattatygattyggtygyggagaaagtttyggttattgttttygttatttttttggaatagtggtttaggtyggttttttggaaygttttttttyggttttgyggygyggtttggttgttttatgggtttgygttgtagaygttttttataggtygttttagggtttttgtttattygagttttattatttttagaattttygtttagygtayggygatttygygttttatyggaagattttgtttttgtgtygyggaggtttaggaggaaayggggyggtygttaggttttaagtttygatygtggagygttggtaagggygttttggtttagttttgagygygyggttttttttttgtyggaagtygttgtttgatttygggygagggaggyggtagttttygggttygggtttgggtttgggttygttgtttygtagggatagygttggggaggtgayggygttygtygtaggtggggygaggttgggggagggyggygtygyggygggtttgttagttgggggtttttgyggygygtaggggygaagtttgtaattattgtagtygtyggtaattygttaatgagggttttgtagggattgtttttatttttagttttagttgtgggagtgygggtgggggtgtggtygagtttyggtaggaagtttygtttagayggtgtttagggaattyggagtttaagygtttyggyggagtttaaaagggtgggggtgggaggggtagaggttaayggatttttttgtttgtygtattttttggygggagaygggaaggtagygggttgygtaygatgggattttggtgtagaygtygggtyggttgatatttggattttattttagaggagatgttggttattagttggggygattttaagggtygttggagttagtatyggttyggygtagtygyggygggygaggttaatggaaaggagattgaggggagtttyggtagtgagttygaggttttgggatttggagttygygttggtttttttttagyggagtttgtaygttayggagattattatatgtgggygtggttagtgtttaggatygtatyg

SEQ ID NO: 5962 - DNA, 3400 bp, synthetic construct
  misc_feature 1..3400: note = Description of Artificial Sequence: Synthetic polynucleotide
  source 1..3400: mol_type = other DNA
gygtagaattagtggygatgggaggaaggggatyggtagagyggggttgggtaagtttttatttagtygggttgagttttggttttygtagagtttttgtttttttygagatattygttatttggtgttagyggtggatygttttgygggggtttggygyggtttygggttggttttgattttgtagtttygyggagagggtaggttygygtggagagggayggggagtygggtygattgttttygggtttttagtttttgagttagtygygtgtttatttatygtagattttyggttgagtatygttyggttgtaggtattgttgttyggygaygattatygttgttttatayggatgatttyggttttgtttttgttgtygyggttygagttygygtygttgtttgygtayggttagttggatatygtgtttttttygtygtttaggtgygygtaggtatygggatayggggtaggagygggygggggyggygtggtttygtggtygtttttaatttttttaattgygggttttaggttattygyggaattygaggagtygttatttagygtagatttttttttggagaygtttaygygtttggtgygggygttgygggttttttyggttygggttttygygtygygtttggttttggattyggaygygttggtyggtttttygtagggtttagttaatttgtyggatttygyggygttggagygtttattygayggygaggagtygttgttgttgttgttgaggtttattgyggttattatyggggattttgygtttttgtaygattttaygtyggygtygtgggttayggttttggygygtygygtggttgttgaattgtaagyggyggttgtygagttgygaagtttttygggtttgttttyggttatagtttygttgttggygygtttgttygygttttgtttaggtggtttyggyggtttyggygattttttgygagygttgttgtttttgaaggygttgtagggtttgygygtggagtggygygggygggattygygygggtygggtygggtatagygtagygygggggttatygtygtygaygggtygtgygygttgygygagtttagygtagattttygygtygagygtttygtatttattttygagatttattaggttaataattgttagggygtgtgyggttggttttagttygatygtaattygygttayggtaattaygtggtgttgttgttgaagatgtaggttygtggggtygttttggygygtttattttgttgygtgtttatygtttaygygggtaagttgtttattagtttgtyggaggagygtattagygygtattaygtgtttaatatggtggttatygagtgtggttgtyggtgatttttgygtygygyggatttttgtttygagggttyggaygygttttagttygygtttttttttatatttattyggattttaagtatygttttaataaagattagtaagtaatyggttggggtgttygtgygtgttagggggttygtgggattttttttgtygttttttttygygtayggttygggttygttttgtagygttygttgttttttttttgtttgaagygttttattatygttttttaggtttyggatttggtgtygggtttaggygtaaaggagtaggtgattttgyggtygtagtattygttttatttygttagagtygyggggygtttagaaggggtttttggatttyggygyggggtyggtttagtttygttttttgtttgygyggagtttttggygatttttaggtygttgtttttygtygggaygtttyggggatatttaggtttgtttttttttgggttyggygtttttggagtttygtgtttayggtyggtggtttttttygygtgatttttagygttggggtagggtttttyggggttttttggyggttygtggtttttttttttttygyggttttttttttttaggtttttttttttttygyggttttttttttygyggtttttttttttttygaggtttttttttgggttttyggtttgygagggttatayggttttttyggayggttttttyggtggtttygtygggttttttttygtygttttttgtagtttttygattttygggaattttgggtttgatttttgtttyggttyggggygtaggyggygttgatggaggygtttgggtttygaatttaggttgtaagatagagtggggttttggggtaagygtttatttttttttyggttygggttttttttttttttggggatgaaggttttaatgttygyggttagtggaaggaagtttttattaggggygaygatggttttttyggggttgagtttggygggatttagggttygggtataygtgtttggagtgttgtttttttagggayggygtttgtagygatagggtygggattygagttagttgggtygaggtayggtttatattgtttattttttttttatttttagagtttttttttttggatagttggagtggggttttttyggtayggttgagattaaggatgttttygagtygtgggaagggatttygggatttygttgtygyggygtttttttttygaatttygtttttttaattggttattttttttttygattaygggttgtaggaggtttttagtaagggaggggtygtaggagtgttttyggggggygtttaygagttgagyggtttttagagagggygtaggggaaaggyggtagaaygttaygaggtaggaggggttgtataaggtttattyggaagttagaatttattygyggygaggggaatgggtttygtaaaaggtttatatygggtgagaggggygygtaaggttygttatttaaggggagatgtataaattaattttgggggygtgtaagatttagttttggagaggaggtttttagattttattttggyggtatagygtttttttttggaggaataggygtataggtggattttagtttygttttatttttggggagtttgygtttatygyggtatagttggaaagtygagtttagtagygttattagygaggygagtattaggtatttgttgagygataggtttttttagggtagtttttygtttagggtygggggyggyggyggyggttgtaggggyggygyggtttgygtttttttgygygyggggaygtttygagggtttgygggggtaagtgygygttgygttgtggttattggttttgtgtygttttttttttygggygtaggggataagagataggtttgtgttttgaattyggttttttttgtttgtttgtgyggtttygggygtaggtgaatttagtttygggtgtttygtagttgtayg

SEQ ID NO: 5963 - DNA, 1143 bp, synthetic construct
  misc_feature 1..1143: note = Description of Artificial Sequence: Synthetic polynucleotide
  source 1..1143: mol_type = other DNA
tygatygttagtggttgggaagtgggyggtgttggggggtgagtttyggtttttttaagatgygttttttatgaaattttttagttttaygtgtatttataygtatayggatgtatgtataygtatagaaatatatagggttyggatatagttgygygtagataagtaaaggattaygtttaygtggaaataggtgtgygtataygttttygygtattygygygtataagygttttatatttgggaaygtgygtatttgtttttygttttyggtatatatatagtygttttatattggaatatttgggygttagygtygggttattygggtaygtagggygttaygtagggtygygtataygtttttyggttataygygtatagttttttaygtggaygygygggtatataygttyggggttygtagtygygtatattygtatttaggaaattttagttattattaygyggggttygatygtttttgagtatttttygttttagtygygtattygttgygygttygggaygygtatattygygtatatatyggttttttttgygtaygtttygggtttattttygtttagagttttyggggtttttttttatttyggtttyggggtttttttaygttttttygtygaygtgtttatttgtttagggggygttttygagtygygtttygygttygtttttaggagggttttygygagtyggttgtatatttygaggyggtttyggttgtataatttggagygagttgtttygtttttttattttgggggygaagaagggtyggggagtgggggaaagygggaggygtygyggtttgggaggttttygygggttttagygtyggtygtattgyggtttttttygygygtygtygtygtygtyggttttttttygtttygttttygyggttttyggygtttttygygygtttygggyggggtttyggggygtaygygggttttaygtttggttttgatttggttttgtygggygtgtattttttatttattttgggaagyggggtttttggagygtggaaygggygtygttagtgygygyggyggggatygggggtgagggagagtgagttgttygttyggggagataagtaaggygttaagttyg

SEQ ID NO: 5964 - DNA, 220 bp, synthetic construct
  misc_feature 1..220: note = Description of Artificial Sequence: Synthetic polynucleotide
  source 1..220: mol_type = other DNA
aygtgtyggtgaygtttygtggagttggygagtttygtttgtttygygattgagtttgyggtygtttygattttttagtagattttggygtggggtatttgagattttygttattgaaaaggygttatagaaatgtaaggaattatgattttaataaaattgttttatttaggagygagtttttgygttgtttttgtygtyggagttygggtttgttayg

SEQ ID NO: 5965 - DNA, 1860 bp, synthetic construct
  misc_feature 1..1860: note = Description of Artificial Sequence: Synthetic polynucleotide
  source 1..1860: mol_type = other DNA
tygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgyggaggtggaygatygggygtttaagtaygaattttttygtygaggtayggttgtygggtttygttttgagggtttggggyggygaggatygtyggggaggagggygygygagtyggaggttagagtygggtygggtagggygygtttaggagtaggggagayggygattygggtygaggygggayggggataygttatttgttygtggagygyggggaaggggtgygyggyggyggyggyggyggagtttggygtagagggtagyggtagtagygggagtatyggttygttyggggtyggttagtyggggagatyggggagtagyggggtygygggyggyggggtygaggygagtagtatygggggaattaygattttygygttgagtyggagtagttyggtygagttyggtattatttagatttagggyggyggyggyggyggttttgygtttatyggttagaggagaggttgtygtygtyggggttgttgttgttgtagttgtygtygtygtygttggaatttggygttygtttgtattttatattttygygttgayggyggyggygggggyggygggygttygagatgttgggtyggyggyggygyggtttyggagygaatttatttggtttygyggygyggtygttygtttygtttttgtttygygygggaagtttttttttttttygttygygtygtygtygttttyggattyggttttygtttyggttttygttygttygygttttttttygtyggatttygtttygttttygygtttttyggttttggtyggggtttttttttygttgygtttttggattygggyggtygyggaggaygtgggtgggagagggtygagggygygttyggttgggttttygtygatgtyggttttttggtggtttttggttttttgggatttagygtatygygagggaggtttygggtttygtatttaagggtaagyggaagtygaggtggyggygtyggagttaggtatgtttygttgtttagygyggggttgagggygtagayggggatygygygagtygttttttatttggttttttyggagtttagggygyggagggtattgggttgyggattyggygtaggyggtttyggaygttgttaggygygggyggatttttgttgtataaatgggttaaataggttygtaaggttttygygggttttttggttyggaagttgagtygygggtgtttggtttgaagtttygygttttatagtggttygygggtttyggyggtttttgttttaygttttttaaggtattaggtaggtggttttagggtttttgtttaygatattttttgggtggggtaggattatttttttgtgaattygttttggatgtttttaggtatagtttgtattttttttttttttagtataygyggtttttgaygttgtaygtygagttttttgggatttaggaygaatygggttttaaggattttygtttygttyggattataygtaggtagygtyggtygagtygagtttgggttygtattggttaygygtagttatygttagayggygttagttttttttygttgtagattttgtttyggaggtygttagttttttttttatttygggtttatagttttagtgtagtttttggygaygygygttgatagttgggtagagattttygtgyg

SEQ ID NO: 5966 - DNA, 441 bp, synthetic construct
  misc_feature 1..441: note = Description of Artificial Sequence: Synthetic polynucleotide
  source 1..441: mol_type = other DNA
gyggggttttaaaygttatttaatyggggatattgggyggggggtygtttaattaggttygtagttggagtagatagggyggttttygggatttggygyggtttttgtttttygttgtygtygaagttttaattttygtttgtttgttttgtgttttttgtaygtagaagtttagtttgtgtggttttgygatttgygggtattgggagatttatagttaagaygttagggttttttggaagtttagaaatggtgagagtgtyggttygatatttygagagagggaayggggttggttggaatyggtgggaagyggttgtggygggatttaggttttttygtagttagttttataatttgygtttagagtttttgtttagttyggttttagttttttttagttataygatggyggtygygttgatagtyggggtttyggyg

SEQ ID NO: 5967 - DNA, 5587 bp, synthetic construct
  misc_feature 1..5587: note = Description of Artificial Sequence: Synthetic polynucleotide
  source 1..5587: mol_type = other DNA
gyggtgttttygggaggttggtagtyggggaagtaggtaygtgaatttatygggttgttttattttaatttgaggttagagttgaggygtaggggtyggggtaggggtagaggtgtygaaaygtattagttggggattttygggggaaggagataggagagatttaaggygagttttaggattygtttttatgattatgattaygygttgygttygaattatatgtttatttygtatttgttttyggggattagatygygtttttttagatggttggggagggagtagatttygggtgaaggttgggggaggtatygggatgtygagtaygttagagtaggygggggatgggtttyggttttttgtygtttyggtatttygttttgtatygggtaaagaaggggttaygatyggygaagagygygtggagatatagggattygygatttaggggtaggaatttygttttttttyggaaatttttygggttttgagtygtgttyggygttttttattttattttattttygtygtttttgtygttatttayggtygttgygggttggttagygtgtgygtttttygygtygtaggtatttgttygttgggygttgtgygtttatttttttttygygtattgtagattttyggygttgtygtygttatttagygtagttttyggttgggtatagygtttygtttttttygyggtttygggygtttatttattygttatggtttaggtttgggttaaatagyggggtagttggttgtttaaattggggtaaggagttgagggttgggagttgtagagaggatygagggatatayggggagtagggatgagyggtygtttygagtygtgtagattgggaagaagttagggagagtttgggtgggaggatttttaatttaagygggtgyggggyggggttgtattttaattagaaagayggtggttttttygagygattttygaggagagagggggagygttttggggygggggyggggygggttgtggtaggagaggggagggygggggygatgtagyggtggaggyggtttggygtttagttattgatygttttttttttttttttttttttttttttttttygttttttttyggtttygggttygttaygtyggattygtttttttygygttgygttgggtyggaygttaggtttgygygtygyggttgagygtttattygttttgyggaaagagtygyggaggaatyggygggggyggttgygggagtygaaggaggtggtaatygggagtagaattagaaggagatagggaggtagaagttygyggtttygtggtaygtattttttyggttagggatgggtttyggygyggtttagtttttgttyggttygtygggtagagattgaatygyggatttttatygttttgtggaygatyggatagagagaggtattgatygatygttagtagtttttyggtgggatygygttttttgtatatttygygtagygtttttygtyggagtygtatygggtaagtyggygagggagyggggttgattggyggtygtyggyggttaggggagggggygtygygyggggttatggtaggttyggaggygttttagttygagtyggagtygattygagtttaygyggtygtygttttttygttttygggttttygtygttatygygtttttygygggagatggaatagyggaatyggttyggtgttttyggatatttgtygtttttgttgttgtatgttttgttgtttttygtggtygayggtgagygygggaattttgttgtygttgtggattygggggggtttttgttggggtygttatygagaagaagaagaaagagaaygaatygggaagtttygyggtttttagtaatttygttgtgtagtttgggttyggaggggtagggagaggygagyggygaagggtygtygtagtagtagygtygygttygagtygtttttagtttygtyggggtttyggttgyggaaaggatgtttgyggggagygggagtaggygygttttagttaggttttggyggtgyggttaggggygggggagaagtaygagtygtttttgtygtttygttttattyggagggaagtagtaggtagtygatggtyggtttttgtttyggttttgtagtygttttttygaattttgttagttttttyggtygtgygttagggagtagttgyggggtggggggtataaggttagttagttagagatygattgtttygttttaggttgttttaggttttygatttatagttggttaygtttttttttttttttttatttttagttgtatttatagaagtttttaaagatgtgatagtaygggagggagaygatatygaaatgttttgygygtttygggttagyggagttatttygtattygttggagatttagtggtggtattttaaggagttatttygggagttgttgtaygagttggygtttagygtgtygggygttyggagtaaggtaattygtygtttaygyggtatyggygygygttyggttygygttyggggyggygaaggttaatttagggagggaagtagygggttttattygygtagggygtygttttgtggygtagtttattttttattttygtattttaaagtatttttaaagttagtagtggttatttttaaatttgttaattattttgatagtatygttgtttttattattttttagaattttatttaygtttagtttttaaagagttatattttagtttggtygtttgttygtgttygttggttgyggttttttgatgggtgttgggtagtgaaggaagtttttttggttttattaggtttttttygttttttgttattttgaggattttagggtttttayggttgygttttagaggttattagaaaatygagtatyggaaagtyggtaggatttttagtttttaggggtatagaggggttatttttttgtggtygaaaataggtttaygttgtttgtttgttttaaaatttatatttttttatatattttagtgtgttygygtgtatatatatttatatatatatttatatttatatatatttatatttttttagggttttatttagagttatttttattgagtttttygttgggtgttgtttagatatagyggttttttttttagttttttayggtttttagtgagttgggggaggattttgagttaygyggtagggtttaaggatgtttagagggaaggagaggggtttttttttttattttggtgtttatttagtttttttagtttagtyggtaggtgtgtattagggtagttattygttggttaggtattatgttagttttaaagttygtttttttttgggaaatttttggaaagtyggaygttttttgtgtttttaatttttatttttygggyggtttyggttttagtttgtyggaggagggtgtttttgtttaaaggyggattygagtttttttagttagaaggtygygagttttaygtttttttttttttttttgtattttaggtaataaataaggatgtaattaaaattagygtaagtgtggagtttagygygggtygygggagattttttttggtygtttygggtttygtagtttttttttttagtaagtygyggyggtygygtatgtggggtygygtaagtagggtagygatygtagttttgtatyggtggttgttyggygtgttygggygttatttgtygtyggttgtagggtygggtttttttttgtgtaaattaagggtttaaggtttgagttttttaattyggttyggygttgatttgtaaaattttttttggtyggattgygygtttagggtttttygygtttgttagttttygttttgygggtattttttttagtatygggagygygyggttgttygttttygtygygatygtggygttagtttttygttttttttgtttygttttgagtatttgttttgygtttttygttgtaattttttatttttygtttggattgygggtttgggtgyggggtgttgtaggtttgtaggggayggggtagggggtggttgtgttaggttgygaggggttygggttatggggttgttaattttgggaggagatgygtttaagttttttatttggagygtagaaaggtttggagatgaygaagttttttygtgggttyggtttagaggtgagggttttttgggtgtttgttgagagtygtagagtagtatttttygaagtttttatyggggygtaggggaggagtatttygttggggggtttttggagatttygyggaaaggygggttggtagtaggtggttagggagttaggtagtagttttagygttgtttgtttttttaagaaagtatagtgttagttgtaaagggyggggttyggtgatagggtggttttttttaggaagygattygggtaggtttttygtgtttygggaggtgaggagggtyggttggggygggattgtyggttggagygygtyggggygggaaagaygtggggaagttaaggaataaggaatttagtttggggttttttgaaggtgtaggagggaggaaggagaggtggattttgtttttttgaagygttagttaygggaagataagtagtgttggtttgtatgggyggggtagatgtaaggtgggygtttggttaaygtgatggggaygtggggatatagtttaaagagttggttgtttggygtttaygtagagttggaagttttatgttattgggtagaygygggtgaaagggaagtyggatygtgatggtgggtaaattaggattygggaagtgttggggtgygyggatgagggggygygayggttagggtggttagaagagtaggtttgggagttgtttagttyggtttttaattttgtttttttgtagatygtaygygtttagggtaatgatattttatatyggtttyggttgtttgtygtgyggttgtaggaygagggygtgtaygagtgtygygtgtyggattatagygaygaygataygtaggagtataaggtttaggygatgttgygygtgttttygygtttygygtygtttaatatgtaggtygtygaggtygtgttttatatttagagtagyggttygygtygttayggtttagttagygtygttaaygttaataaygygggygtygygagtygtattattttygagttyggtygyggygataagagttygtygttygggagttttttygtygttatygatttygtagttttygaggtygyggtagtttyggyggtttataygtttattattatagtygyggtagttgttgttgtttygttagygtygtygttatygggataggyggttttgttgygttagaggtayggttygggtaagggatygyggagagggggygtaygygyggggatggygtagggttagggttgygtygggaygtttyggggggtttyggatttaggattygttttttgggygtatttgtatatgtatatttttttttagttaggtygggagygttttttttagggtttttttttygyg

SEQ ID NO: 5968 - DNA, 3643 bp, synthetic construct
  misc_feature 1..3643: note = Description of Artificial Sequence: Synthetic polynucleotide
  source 1..3643: mol_type = other DNA
ayggggygattttgaaaagaggttgatgaaaatygagttygttttgtttyggttgggttgggaatagttygtagggttttgtygagtgggygagtgaggygygygagtagggygttygtttttttttagtttyggaaaatgattaagttaatygtgtgggtatgttttattatttattgaatataattttttataaygtttygtttaygtgttygagtttgtttttgaygttygygttttaatgtttaaggtaaggaaaataaaggtgggggggggattgyggggygyggygyggtgyggggggygyggygygggggggyggyggygggtgggggggtagtttyggygttygggaggtggtaaagtgagtttggatttttggygyggttttttygttttttttttttttttatttyggygaggtttgtygttyggttttttttygttttatygygattaaaaaatayggtttaattaaatattygtggttgtgaygttggygagagaagttgttagygggtggggggtggggggaaagaagaggaaaatygagtyggyggttgyggtygggtatygtatggygttagagaatttyggyggygagygggatttgygtttgggtygtygttttttygttygyggtttygggatygttattttgaaaaggagtttygaggtttggygttyggygygygatygggatttygygtttagtttyggggattyggtyggygttttttattygygagyggttygygagttatttttaggtttygggaaatttttaagagggtttggggggtggggggagtaaaaaggggagggggtaggttggggtygyggaaatttttgtttaagtgattttttttatttttttttttgtttgggaygggggttygttttgygttttttttttggttygygtttattgyggggtttyggttttttygttygtggagagagggtaatttgtaatttttttttttttttaattaaagttagttgatgtttataatgtgttaaatttgygggygtygagagtygttgagatttgttattttgtgattgtatyggttttttgtgtttygggagtttggttaggttgaggtyggagagttggttttagggttgaggtgttagggttygaattygygattttaggaaaggtygtggygtttgtaagygtaggyggygttygtagtatttgttttagtygggtttyggtttgggggtttagtygggggttaaagaggaaataaataaataaataagtaataggttatggagggaaaagagtyggttagttttaggttggagaaatgaggttaattagagygaggaagtgygggygtgggggttttggaaggtagaggagaggtagggtttgygyggygtttgggaagagtgtaatttggggggaygtttttygtttttttagygtagatgtatgattggggtaggaatgatttttgttgataagtttttttttgtttgttttaagatattatttttygaagatgaattgaggaaaatagtygtaggygagattyggggtgtattttaggtaaaaaaaaaaaagttagggttgggggagagtttttttttgatgagtaggaaagtgtttagatttygaygygtttatttgttgtagttttgtaaataatttaaaatatagatatttttatatagayggatgtatgtgaagtggaggaaggtygaaaygyggggaagttagggaaaaagaaagaaaaagggttgggtagagagagatttgtgttgtttattttttattttgyggagtgaatttyggtagggttttttttggggataggtggaaagttaagtttttttttttttatttttgtattgtgagtggtttttattgtgtgtttgttggagaatatgtttatygttttygagttaggtggaggattggaatgttggggggyggggagygttggagttgaggaygtagtggttaggggttgggggtygagaaagagtagggyggggttttagtttygygtgygggtggtagyggyggtygggttttgtttgttagatattgttatgtttaaygggtgtttygtyggagaygtgatttgttagtygttttygtttttattttagtagaaaatayggtagttgygaggtgtttyggtttgyggggttygggtattyggtgygttttgggggttgggtygtgtgygygggtgggagtyggyggtyggyggggtyggggygaggggygagygggaggggyggagtgagygagygygyggtayggtttttyggttttttttgygttttttttyggtagtygtygtygtygtygtygtygttgtgtaatttagtagaaattygataggggtygygtttgttgagygtattyggyggtygggtagttygagygggtygtygggtttggtyggtyggtgtagaggygyggagggggtyggyggaggggatyggyggggatgggygygggaagtaygtttgattagagtaygygtygttttttaattttggtgttttyggygagttgggtagtttygygygttttgattttgaygttttagtttttagttagggtttaggtgaatttggggtggggtgtgygtgygtgygtgtgtatgtgygtgygtgtgtgtgtgtggaaggggtggtgagattgggaaygygttgtttttttttttagtttgatattagtaattggatttttattttaagatyggttttgttttttgttggggttgggagggggggygatttttttttattatttatatttttgtttattgtttattgagtggaaggtaggygatttaaagagaygaaagagaggaaaaaggggtgagagayggagagaggaaaaagaggggggyggttagaagagggaaggagaggygtggggatagggttttygttttygtyggggtygggtttgatggtgaaatagtaaatttaygtayggagggtygttaggaaagtggatattatygttttaattaatttygagatgtttyggyggygggatttggygtagtygtgaygygtttttataaatttgttyggttyggggttgtttygagaattygtatagtagyggygttagatttatttygygttttttagttyggagtttatttgtataattggattttttttttttgtttttttttttttttttgaaatttgtttgaaaatttaagtgaaaatygygaygatttgtatatttaaaagtaagtgttaagtaagtgttttgyggtggtttyggygygtttyggggtgagygygtaaagtygggagygaggtgtygygagttgygygtygtttygggtyggtttygygtgtgggyggttgggyggttgggyggygggaggayggttttygygggtttygggattgttyggttggttgttygtataattttttttttttttttygtttgttgatttttygggttaggtgaagtgtttgggttaygygtgtatttgtggygagattygggaggygattttggggggygygyggtygtagttgggtattttgtttgggtygggggygggtagtyggttttagtggtygtygttgagggtagagttgygagygagyggggtyggttgttggtygygtygygtyg

SEQ ID NO: 5969 - DNA, 808 bp, synthetic construct
  misc_feature 1..808: note = Description of Artificial Sequence: Synthetic polynucleotide
  source 1..808: mol_type = other DNA
tygggggagttgygaggttatttttagtyggygttygggyggattgygagttttygygggttyggtygggggagyggagattggtttttygttygggttggggygtttgtygttygygagtyggaagagygttttatttaygagtaggtagttttggtagagggttaattgaggattattgttgttggttttaggaggagygaagygtttggagatygggygygygggygyggttttgggagygggggaaggtgaggggaaatgggatatgatggtattaataatygttattaaagayggtgggagtaataaaggaatgygttttygagaygtygtttagtttyggggtgttttttggygyggtygyggtgtaggaaygygagtttygtygtygagtttttygtygtttgygttygttggygyggygttyggyggtagtgttatttygaggtygagygttgttttygtyggttygyggttgttagtyggttttgttygygttygggtttygygagyggtygtattttattttayggaggggagataatgagattaattagaggygtygttatygygtyggagatagttgtygtygtatagtaattattygygggttgggtgygygggggtttttygttatttgygygtttgttgtttttattaygyggtatygattygggygygttttyggtttttgttygtagtttatagttatatygygtattttatattttttttgygtttttgttggggagtttattttttttattygtatagtgygttgyggttyggggtgtgggaggtttyg

SEQ ID NO: 5970 - DNA, 3415 bp, synthetic construct
  misc_feature 1..3415: note = Description of Artificial Sequence: Synthetic polynucleotide
  source 1..3415: mol_type = other DNA
tygaggggatyggttygtttattygttygygttttttggttyggyggatattaggtagtttttyggyggtyggtygttyggaggaygyggaagatgtttyggggaatttaggtgatttygttygttatttatagaaagagttaggtyggggttgttttttattttttttgtagtyggagagttgaggaggtagggatttggygyggtttagygygtttygygagyggttttttaaatgggtgygagagggaagagggtagagygyggyggggygttyggggggygttyggtattygaggygggygtaygtatttaaataggagagyggygttyggagttatttagtgygggtagaagagyggggygaggagyggggtygygttygttggaggygyggggygagtggaggaagaggaggaggagagtagaaggaaggggaagyggttygtatttgttgygygtyggggygtttgttgtttttttttyggtatgatgttttttyggygattgttattgtygtygtygtygtygttgtygggttgaggatagggagggagggggyggygggttygygggggggygaggygggtttgtttttagtttttttttyggagagyggtygttygtaggatgttgttgygtttaggtttttygygtttttttygygtygygtttygtygygaatttygaaygtgyggagggaagaaggagggygggygagggaggttyggggagggaggagtaygggggggaggaggaggtagaggaggaggaggtggaggaggaggaggaggatygygttgtyggyggaatgggaagtttgataaatygttttagaggttagaggaggagggggyggggaggagyggyggttttgttttttttygtttygtttttagaygaggtgygyggggttyggggttggggggyggggagagggygggtagagyggtgggaggaggagygygggagyggttyggatyggtattgtttyggttttygtttttaggtygggggttayggtattyggggggaygygtagtygtygtygyggttyggggttyggyggtttagttttttgttygtggygyggttggagyggyggygtyggtaataggtaagtttaaaggaaaaggagatgatygtgttaatygttygttygygggggygtygygttttygttttyggttttaggttygygtgggattttygtttygttagygaaaggggtgtygttttttygttttygtttygtgygtataygygggggygyggygttagtttygtygagttygtttyggggygttygttattttttatttttatttttatttagygttygtttttagttattttttagttgttttattyggttygtatttttttttattygtygatttyggagtttttagygtggttttygggtyggggttggygtttttyggggaagttagagtttaygggtaggttttttttagggaggaggygggygygggtyggggygggtgggggtagtttttagatttygygttatttagttttttttttaggattygtygtagttattttttttaatttttttttttyggataaatttttttgggttygtttygggggtyggtgtgggagggggtttttttaagtttttttttttgattttgggatgattagggtttttttatttygtttttygttttygggagtygggtygygttttttatttayggygygggtygattttagggygggaygggggygggagaaggaaatygggtttttttgtttatttttygttaggggtttttttygagagtttagggggtygtygygtygtgtttygygttyggtttgtyggggttgttggattagagggattgattattgattggtgatyggggtygttgaggtttygggtyggttyggtygattggtygyggtaagaaggagttggttgggyggygtgggyggyggggygaygygggtttatttaygggyggyggtgagggygygggtgggtyggagtttatgygggygattttygggyggyggyggttgagygggagtyggagttygagyggygygggyggyggygtatygatgygttgygggttygattgygtttttttgggttagtttttaggtygggaatggggyggtygygtyggggtyggtttygggygttgtygggyggyggttgttggagygygggggyggttttygggtttattattttygaggyggttttgygttygggygygtyggttggggttttggygttttygtaggtttygaggtygatagtttyggygagggygggygtttygygttttagtatyggttgtttgagygtttttggagtagtaaattttagatttttttttttttttttttttttttttttttttttttttttatttttttttttttttagtttttttttttttttttttttgttttgtgttttttttattttttttttaygattgtttttgtaagtttgttttaaaagtttatagtatgttttttttttttttagatygggagatagtgattttatttatayggtaagattaaaagttttygttygtttagtttgygggtttgggttgggtttagaygttttttaggatgtagatgygtygtygttggttttttyggttataaagtygtttttagygttttttygygygtaggagygttyggagttgtggggtayggattttaggyggggtagggagttygaggygggttgyggyggggttttygggttggyggattygggggttgaggygtygtgygygttgggtgttygyggtygtagaggttagaatygttatttttttaggtyggggagaygyggtygtggagygtgaaaygttttttgtaagygaggaaayggtgagttggtygatatygtyggyggttttattattttggtggtygygttgagtttttgtygtttggaggygggttgygtygtayggggttagttttygtyggtttttagtttattttygaagtttttatttaggygygttyggtgyggygtgtgtatagygyggggygtygtatayggaagygtgtagttttttttggtygygtttttttttttttttttattttttygttgtttttgtaaatttttgttttttyggtttttttttattgygggtygyggtttgaattygggttttygygtagtyggtygtygtygttgggtygttgtttggttttttttygtttaggygtygagygttgtgygattygttttaatatttgttygtttaattattggygtatttattagtgttaatgggttgtatattgtagygatagttygttaygtataataygggttatgyggagtgtaygtagtaattatattgttatgtygggataygtaaaaaggttttyg

SEQ ID NO: 5971 - DNA, 3415 bp, synthetic construct; identical to SEQ ID NO: 5970
  misc_feature 1..3415: note = Description of Artificial Sequence: Synthetic polynucleotide
  source 1..3415: mol_type = other DNA

SEQ ID NO: 5972 - DNA, 1592 bp, synthetic construct
  misc_feature 1..1592: note = Description of Artificial Sequence: Synthetic polynucleotide
  source 1..1592: mol_type = other DNA
gygaagygatttagygygaggattagtttttaattaattygtttttagttttgggygttttttttagtagttagatgggggttttagaggtyggtgygyggttatatggtttygggttaggtagggggtygtggggaygtatttgygttaggygtatagtatttttgggygygggaygggygaagygtygtgggttttaagttgagttgggtyggttttgtagygtyggagagtaaggyggygtagggaagggagatggggygggatgtggggaaagttgtygattgtttggattttttyggttyggatggygttagttgtttttagtttagtttgyggaaattygagttttttttagyggttygayggttygggygtttygtagattttgggtttttttygyggtgttttygtygttygtttttgygttttggttyggtttttaygttttttygaggtttyggygtagygyggtygtygttattttttttatattttagaggtygtagygtygttttttttttygtatttttgttttygtaaaggagttttttygtttygygygaggtygyggygaggagggggygyggttyggygtttgggagtttatattttttygtygygygygtygtygagtagggygtygygtttttyggttygygygtggtygtyggaaygatttyggttyggygtyggtttygtttygtttygygtttaggggtttyggggygggtttygggtttygggyggaygatgyggyggttyggtyggagyggyggygggaagyggaggyggaggtgaygygttagggtyggygggtygggttatgtagygttttagggygggygyggaygaggyggttttatttttggtygggttggttttgygggagttggagttygggtgyggttttttyggtygggggyggygggggtygyggtttgggtttggagaygaggyggygttygygttgggtygtagagggaagggtagyggyggtttygaggtyggggyggayggattgagtygyggggagyggggttttyggygygyggyggtttyggagtttagygygtagtttgygggtagtttaygggttagtttggyggggttygayggyggyggyggtggyggtagygttygatttagyggtattagtttgggttaygattagygttayggtagttygygtttyggtygttyggattygygtttyggtttygggtygttttyggtgggtagygttygttttagygtttttagtttyggttttyggggttyggtyggygtttaygttgattttttttygttyggygtttgtttygygttygttygtttttyggagtttgyggggtyggtttttttttygttgtttgtattttygttgttttttggtygggagggyggtttaagygyggtygagyggyggttggaggygtttattygggagttggagygggygttygaggygygtayggygygggattatttyggtgagttygttyggttyggtagttttttgygygtatggttggggttyggggtttygagattgtttygggtaggyggtyggattagyggaggagagtayg

SEQ ID NO: 5973 - DNA, 903 bp, synthetic construct
  misc_feature 1..903: note = Description of Artificial Sequence: Synthetic polynucleotide
  source 1..903: mol_type = other DNA
gygattttagaattygttttttatttygagttygtttttygtygttttttygtttttgggagggyggttttattaattttygygattygggtygtttttggyggttttgatttygttatttygtttygyggygggggtttgggggtgaggggygygttttggggtagaggattgygyggtagggtttgttatagggtagaggttagggtttttygggaaaaaggtaggygtatatatgtttttttttttgggaaaagayggggaggggggttttttttgggagattttaggtttygaaatttttygttttttatttttyggttttygtattttttttttttttygttaygtatttttttttttttttagttatttgttttatttygtagygtygygataaatayggttttagttygttttygtttttgtttagttttttttttaagtttyggggagtgggggagtgagtagaygttttttttttaggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygggttygtttttggttygygtttagtttttttagattattygtaaattgaggatttyggatatagagtgtagagatttyggtaagtttattgaaagttagtygaattyg

SEQ ID NO: 5974 - DNA, 1592 bp, synthetic construct; identical to SEQ ID NO: 5972
  misc_feature 1..1592: note = Description of Artificial Sequence: Synthetic polynucleotide
  source 1..1592: mol_type = other DNA

SEQ ID NO: 5975 - DNA, 382 bp, synthetic construct
  misc_feature 1..382: note = Description of Artificial Sequence: Synthetic polynucleotide
  source 1..382: mol_type = other DNA
ayggattgttygtttagtaatatttgattaygttttttattggttatygttttyggaagttygttttttygttttyggaattttygtaggygttgggtttgtagatggygtttaggtatatagtggygagtgtgatttygtagttttgggttgtttggttaagygttygtyggatatggtaygtygaagggttatyggygtggagttttygtttttagygttygyggttgggaaatyggttatygttayggygggaattgggattygggttgygtttyggtttttttatatyggtttatygtattygtgggygttygtattggtgttgatataattttttgatttttgattygtattgtttygygattaaaggtaaaaaayg

SEQ ID NO: 5976 - DNA, 665 bp, synthetic construct
  misc_feature 1..665: note = Description of Artificial Sequence: Synthetic polynucleotide
  source 1..665: mol_type = other DNA
gygtttttaygaaattygtttayggataygatttyggggttatatttagttagaygaatgtttggtaaatgatagttattttaygttagatttttatagttttttataygttatttttattgttttagggaattataagtataggtatygtttygttyggygtttttttttaaagattggggtattaggatygygggtttttatttttatttagtataaagagttyggygtttagagttagyggtttttygaggatttattattaagttygyggatataggtttygattttatatttaaygttgttaaagtggtagagtyggygygggttgggatagaggyggtattgaggtyggygttgtyggtggttgagagygttataagtttyggttygttatattaggggygaygttttttagaggttttygyggtttattygggygggattggttttattgtttgygygttttgagaagtagattayggtgttttagggtttatagtttygygtaggggagtttagtttaggttttgtaygagyggtttttygygagtttagttttgagagattgggagygtaatttggtgttgagaagaatygaatygtttygttgttttttgygtygaattatattttttagaggttttygyggttttattttttyg

SEQ ID NO: 5977 - DNA, 764 bp, synthetic construct
  misc_feature 1..764: note = Description of Artificial Sequence: Synthetic polynucleotide
  source 1..764: mol_type = other DNA
aygygttattagygygtttttaygtataaattttttttttgyggttaatttgygatttttaatttttygttttggttgttaagggaggygygtagagygtttgtgtttgygtatttttatattagttygtgtagtgtgaygttgggtttygtttttgtgatygggttaggttyggagttgtagggaattyggattttygggttttttggaaggtyggggagaggttagtgtgggaggatttggtggggaggaggtygtgttataaattttgygyggagttgtatygttgttgttagatattgygaygtygygattttttttatttyggattaygttttttagyggatttygygggagttgggtyggyggtttttttgtgtttttygggggyggaggtagttgaggygttttttttygggttygtaagggttgggttttatttaattaagggtagyggtgagattygagtgtagatttttygagttttyggggtaggaaggagattttttattagttttgttttgtaggtygggagtgggttgaggagtggygtgtgggttttyggaagttygtygtaggttatttgtgtgatttyggtgygagtggaggttggtatygtttagtgygaggttgttatttygtgtgtttgtttaygttttgtgtgattgggtgygaggaagttaatggtatygtggaatgtgaggttgtgagttgaggygggagygggygattgttygttgtattttgttgggtygatattygyg

SEQ ID NO: 5978 - DNA, 1394 bp, synthetic construct
  misc_feature 1..1394: note = Description of Artificial Sequence: Synthetic polynucleotide
  source 1..1394: mol_type = other DNA
tygygtttgggttygtagtttygggtaygttgtagtttygtattyggttgtttaygttygggattatttattgtgttttttyggaattgtttagygtgtttttttagattttagatatttattttaaatttaggttttagygttttgtaggggatttttattttggggygtttatttttgattttttttttgggttttttygttayggtygagtttaagtggttgaagygyggaygaggatgygyggggtttyggtttttaattgtattataggtygtatttaygaatttggttyggtatagttattatygttygggtttttaggttttagggttgtagaagtttagtttygggaaaaaaagtatatyggtttgaggttttataggaattttttttttattttggttyggtttgtaaaatttggtttatttygygttttttttttttagaaaagtagyggttatagtggygttyggtttttagttttagttttattygatttagaggatagtttagttttgggagttagyggygttagaataygggagagygtttgttttygtygygaatgygttagygygygggggggyggaggtaagtttygtagttgtttygggtygggaggggygygtggggtygggtttyggyggggatagtygggtyggggagayggagttagaggggtygtagtgtttttygttttaggtttttatttgtaatggtygtttygtgattgattagtgttattaaagataatttaggtttgtttttttgtggatattgyggtttaaaatttaaaaaaataatatttygtttttttattttttatttggttttyggttyggagataggyggaggttgygagtttygtttygtttttagygaygttttatyggaatttttggaaatyggtttttgtttygagtgygtaagygygyggggggygaaygttggggttttttagggagtaagggagaagtgtggggtygtatttgtygaggggtygggaggtttggaggagggtggaggttggttataggatttygatggggatggagtgtttaaatttaggtttgtagtygtgattttggygtgagttggatggaggaaattttagtatygygagtttggattaaggygyggygygtgttgtttgtggtgtttgttgagtgayggtygtygygttttygygtatttggatygagtgtttggtygttggyggagtagtgttttygtgtayggggttgttgygtgygygtgtgtygttttttagygggggattaggatggtgtygtagagaaggttgygyggtggtgtttgattttgaygttggttgtagygggtttttggggtttttgyggtttgtgtttgygtttgtgaygtatttgatatyg

SEQ ID NO: 5979 - DNA, 949 bp, synthetic construct
  misc_feature 1..949: note = Description of Artificial Sequence: Synthetic polynucleotide
  source 1..949: mol_type = other DNA
aygtygtgtttygttattttaaaaaagaaaagttattttygttaggtttttttttttttttattttygtgtgtgtttygaggtygagatgtagagagtaagaaaaaggagygaaggggatttttgygygttttaagtatttattagygtttayggtgtgagatgaaggygtattttttgggygygaagtttttaaagtatttgtttagggagatatttttgaagttgttagggttttttttttgtttttttttagattygggttttgtataaattttggagggttagygggygaggyggttatygtagyggtygttaaygagtagttgtayggaggtgtagaagaaggaggttattgttatttttttgataagttgggggygtgggaggtttygggagttygaagtygtttygagygggggtgggyggtgagyggattttygggtgttgattaggtgtttggtggtagagtagggaaggggggaayggaygtygattttagggattttttattygtttaygttttttggygttggttataygtygtygttttagtattaattggaggtttttagtggaygagtagtygttygagggtagtygtttgagtyggtagatagyggttagttggggtagyggttygaattgttttygtaataygttttttagtatttyggtttgyggggtgtttaggagygygggyggygyggygyggggatttaggaygtygggygyggggtttatggtagggtygaggtygttgaggtygggtttttatttgygtattyggggtygtaygaggtttgggygggggyggggygggggygggagttggattatttgtaattatttttyggttgygtattttaatttyggttttttttttggaggttgygtttaggtatygygttgaataagtygtataggtgtgattygggagygttggagyg

SEQ ID NO: 5980 - DNA, 1365 bp, synthetic construct
  misc_feature 1..1365: note = Description of Artificial Sequence: Synthetic polynucleotide
  source 1..1365: mol_type = other DNA
tygygyggttttaggtgaatttggtygaggtttttgygttaaggayggygygggttagttgaggttaagatygtaggtattgttttatygttttttagattatagtttygtttttgtaaggtttyggggaaaygggtattttttttttagtgagtaaaggagaaagayggagttyggtggttgggtgtttygtttaggattattagygagtttagagttttttttaygatygttttagggtgggtatttttaaaagyggaggaagggagggaatatattttttggtgttgtgtttattttgtttygtatagagygggygtttataggttttgggggtttygttyggatygtagtggggagaggtygttttatgtttygtttygttaaatttaagagttttygtygagygttaggaggtttttagataatyggttttgttygttgttttttgtagaatttttttatttttttygagtttttttttttgygttygttygggtaayggtygygttatgtttagttttaggtygygaggtagttygttattygttttttygggttttygggttygattttygygttttggtygtttttyggygtttaggttttttattggttygaataygtttygygttttyggaygtttygagttttttttttyggtygaggttattttggygaggttygatttttgygygtyggyggttttttagtygtygggtttygtttgygtttattyggttttttggatygttgtttttttgtgygttatygggggtttgttttgggtttgttygatatygtggttgttygtttatttgagygtaggtttttattttgtgttagggtygygygtggttttygtttgyggtttgttgggtttyggygttataggtattgyggtttyggygttygtaygygggggattgggygggggttggagagtttaggtygttattgtyggygttttagtgtaggagagggtattgagtgtgagaattatatayggttggagtgggaaggggttttgttatygtttattttgtagttgaagtygaggatygygatagttttgttgaaaaagatttyggygygaggtttttttygtaygttgttgaggtgggagagggtgggtgtgagggyggygtagygtttgaatgyggtgggtaggaggttagygttggggttgtaaggggatttagttttgttttyggttttygygttttttgattttttygtatatttyggggtagygtttagtgatagagaygttttttaaagyggttttygattygaattaatggttttgttttttttttttayggggtagggggaagtggaygtttygggyggtgttgttgagyg

SEQ ID NO: 5981 - DNA, 2638 bp, synthetic construct
  misc_feature 1..2638: note = Description of Artificial Sequence: Synthetic polynucleotide
  source 1..2638: mol_type = other DNA
tygggggtygygttggaattttataggaaaaaggygyggaaagtygtygggtatttttyggggttttatagatgtttttagtgttttagttygtgtattagttygygtattyggagggattttaggtagggggagggtttygyggttagtatgtgygttygaggttttttygtagggggtagtgtygttygttygygygtygatayggtgggagggggtgggaatttgygyggagttttggaggttttttgggagaaagttaggggatgyggaggggtgggygtaagatttttaggattttagggaggtygtggggagggtygtygagggtgtagtgtgaggygtaggagggggttgggggyggtgtaygttgtagggagaygtagtttttggaagatgygagtgtgaatgtgtgagtgtgagtgygtgtgtatgtgtgtgtgtgygygygtatygtagtttttygggtttygygaggygygygggtgttagtttgtagtyggggttttttttttyggtttttttgtttagttyggyggtttttttttttttttttttygttygttttttttyggygggttaggggttgggaygtttyggyggagtaggyggyggyggtggygagttggggagttttaggttyggygttgtyggaggggttygagtygagtygtttgygtttyggtygggtagygtygggttygtttttygyggggttaygttttgttaaattttgttgyggyggttagygtagygggttygtaagygggygggaggggygtygggtygggtygggtagggygygggyggttaggggtttygagagyggyggtttyggttygyggttttattatgttttagttyggyggygggggyggyggyggyggyggyggtagygggggaggyggyggttttagygtyggggyggtyggyggaggggaygatttyggggygaaygaygagttgatttttttttaggaygaggggggygaggagtaggagtygagtagygatagygtttyggygtagygggatttagaygaggttaagtygtttttggttaaygagtyggagaattagagtagtagttyggattyggaggtaaggaagtatygyggttattttygggggatttyggttttgygttygtttattygtttttgtttttgtgtttttttygtaggyggagaggygttygtagttygttygggatattttttagaagtygygggattatttygtygaaggtatgtgttygttgggatagttttttattttygattttygttgygtttygttgtttagttygggyggtttatygttttttttgtttgggtggaygtatttttgtttttygtttttattggyggtagttttygtggggygygygtggggggygttggggtttttagttttygtttygagttttttgtygyggygttgttagtttygggggtttgggttttatttygttttggttttgttygtagtgagaaggttttaggatagygygttttttaaaggattttygtattttgggtatttttttttgatgatttyggatttgagtagttygtatttttttaayggatttttgtttttyggaggagygygtatygtgagtgttygtygggygygtyggggagggtgggaggtygyggttygtaggatgygttttygggtttggttatggagtgggggatggggttttttgygtygattttaagtagaatttgtttgyggagttgaattattttttggyggtygagygygaggttgygttggttagtgtttggatgaaagtaaagttattttaatttttttttttttgygggttgaggttttggagtttatttttgggattttttttggtttttagaatttttygtttgtatygaaggaaatttggatttgtgttygttttgggggggtttygtttttttttttggaaatyggttagttttttttggtagtggggtaaggggtttagggagttgggttggygaygttgtttttygatttygggtttattgggyggttgtaggttggtttttaagaaatttagttttygtggygggttatttatagttttygtttttatttttagttttygtatyggggttttagtttttttgyggagttagtttygaattttaaattygygtagatgatttygaggygatttaaggtattttttaagttgaggaatttggtttttttttttttttgtygtttgttttttttatttaaagygagygttgygatattttaaatttgttaatgggygygtattgtgtgttgttygttggtatttagagyggtgattaagtaaattgatygggttttagaygaygtgtaaatgagggyggattttttygttttttttttttggttttaaattttygtttttygygttgygaggggygtagttgggggttggygaggtttttgtgttttttaagtygttattttatttttaggttttttgtttaggtgttgggttygatgatagatgttgggtgaaygtttatttattgtgtgttaggttttygygtgttgttgtttgggygygatgtgaatygtagtagttttttgtttttygtttagatttttattgtttgttatttygttgtygayg

SEQ ID NO: 5982 - DNA, 1531 bp, synthetic construct
  misc_feature 1..1531: note = Description of Artificial Sequence: Synthetic polynucleotide
  source 1..1531: mol_type = other DNA
tygtatatygatttttgygtyggtttttgygattygygttygtttttttyggttgggaagtatttgttagyggtttttatttgggtygttttygtygyggggtatttttttgaagtagtygttgagygataggttgtggyggatggagttttgttagtyggttttgttgygttggtagaaggggaagttatyggygaygaattggtagatgtggttgagagtgagtttgygttygggygygttttgaatggttatggygatgagygtygaataygagtagggyggtygtattatttttattaggttttygyggttggttatggatagttagtttagtttttygggtttygygggygyggygggygaggygggygyggygggygygggttgygygaagggtygttgagagtagtygaagtgtyggyggtaggyggtggttgtagaaagggttyggtygyggtttyggggggyggyggyggyggyggagygtttaggtaygyggyggyggttgyggyggyggyggagggygggttttttaygtygggttygttgagttataggtaggggttggyggyggyggtyggyggygyggygtagtyggttagttygtaaggygttttggttgtygggggggygttyggggyggyggyggtggyggygggygggggtaggtygggttgygaatatatttygaagttgtygtygtagtagagggttatgtyggyggtygtgggyggttgyggygyggtygyggygaggggygagyggggttggtttygtygttygggygagagtatttttttgggggttaattttgyggtttygtttttattygygttgggygttyggtgtttygggtyggggtygggygggtgttagyggagygtttgttagtyggttttttataatygagttyggygyggttttttttgggtyggttyggagyggggyggtggtygygggtttgggttttttaygttttygttaygttttatttgttygygygtttaaattyggagttygttygtttygtttttatygtttttttgttygggttygggagygtttgggaggtyggygtttttaggtttygggtaaaaagtagtattttatttttagtttaygttttttaatattataataagtaaagttaygaatattaaagagaagataattygaatagtaygaatgatttttaaaaagttaatttggggtggtygttygggttatttgtttagttatttttttggtttttttatttttttttttttaattttttgtgatygagtygyggaatttaygtttagttttaatygatyggtttttagtygaaaataatygatgtgatttataaygttttggggtatayggtagaggttattaataggttygtttggygtgttttttttttttyggggattttgtgattggaggaayggaaattagtgttgagtttttttaattaaattgtaggttygtttatattygggaagtatttattygttttttgtgyggtttgtaygggttttyg

SEQ ID NO: 5983 - DNA, 2045 bp, synthetic construct
  misc_feature 1..2045: note = Description of Artificial Sequence: Synthetic polynucleotide
  source 1..2045: mol_type = other DNA
gygaaayggtagaggtyggtagttygyggtttaygtgtatttgtttagggaatygttttagygaaatttgattyggatyggaattttttygtagtatagyggtygtgtttatyggaatggaaygttataagttgttatttgtattttttttttagttttgatagggaataygygttgtttttaygtttatatygatattyggatttttatttagttyggttagagttttaggggttagggattagtgtagggagaaggttttttattttagtttttaggatttttaattatagtttattygtttttattttgttyggttttaggtttagtygaatttatatgttttygtagtgtygagygttattatttatagtygttttttaaattgtgatttttatttgggagattyggaattatttaggattttggtgtggggggtagtattttttatatttgtttttygaaaattgttatggagtagtygygtttyggygggtaggtgagggggtygagtttattagygtygtagtttygttgtttattttttttagygtyggttgtygttttygggtagatatygtyggttttgattttggggttgatatygttaaagggtagttagtgttygtttaggttatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygagatatttttgttagggaagaggagygtttyggttgtttttttagagttttttgttggggggatatygtttttatgaagaaaatttttaaataaattttagtttaggaggaggttataygattatgttygygggttgtyggtyggaggggygaggaygygygggyggaggygyggttgtygtgtttaggtagggagtygagtttygggtgttygtygygygtttttygtyggggttatgtattttygtttgygttygatatygygggttggaggygagtgtagyggygatagttygttagygtygyggttygtttygtttygggttygtttttttygtttygggygttttgygtyggggttygttttygtagttttttttagtttttttttagtttgggtttttttagtttygttttagtttgtggygygtttggygggygtttttttatatatgttagtatatyggttatyggttgattttttyggtttgtgatttygygtgggtgtagttygtaggagtttatyggtttgtgttaygtaygggggtttttagtgtayggataygygtttttttygttatttgtttatttttattagattttattttttttygygtygtgttygyggyggaaggygtttttgtagygygtgtattygyggagyggtggygattttagtttgagtagaggagttgtagtgatttttgtttygtttttagyggattgyggagggaattttttattttattttattggggatagggtggtaygtygtagagtgtygtagttgtataaatttggaagtttatagtatygtttgattttttgtgtaatttygaaygttagtttgttygggtaattttgagtgggtttttgtagtyggttatgttagyggtttttgtatatttgtattygyggttttygttgtttgtaggttgtagagaygggggtattttaaaygtgaaagagtaatgaaggaaaatgtagatagagygaggaygtyg

SEQ ID NO: 5984 - DNA, 476 bp, synthetic construct
  misc_feature 1..476: note = Description of Artificial Sequence: Synthetic polynucleotide
  source 1..476: mol_type = other DNA
tyggttygygygggaggagtgtgatttaggtgtygttttttttygtygtygagggttaggagttygggagygygattttttttyggttyggtttggttyggtttggttagttttygyggtttttgttygggttgaygtttaggaatgtggtygaygagaagttttaatagtayggygtggttttttagtttyggtgagtattygtygtggggaagggttttggggatttattggaggtygyggttygtagtagttaggggtygagttayggttayggaygttttggtgtttyggttygtgtygggtttttaggyggaggaggygttygttgggtttagattttygattttagtttyggtttttyggygtttgggttgygyggagtttttgtttygygtttyggatttttaygygtagtttttaygygtttygagttggagaagtygttagttygtttttttagggygtgtygttyg

SEQ ID NO: 5985 - DNA, 455 bp, synthetic construct
  misc_feature 1..455: note = Description of Artificial Sequence: Synthetic polynucleotide
  source 1..455: mol_type = other DNA
aygygggyggygttyggggtttgygggtaggtaggyggtttggtygyggaggttttttygagttttgygtttttttagagagggaggggtttatatyggttggtatagttattaygggtatygaaatttggggaygtgttygattatgtttttttyggtggttygggggttatttygtattgtttagaagtttygtttttygttttttttttttggtttagtttattattttttyggtgattttgggtatgttaygtttattttttaggttttagtttttttatttgtgttgtgaggagtggaaggaaygggatgattaggagttttttaagatygagtattygaggtttttttyggtttygyggagttaggaggtgttagtygagatgygygtgtygygygygttttttagtgttyggttttygtttttgtayggttttygttgggtaagggyg

SEQ ID NO: 5986 - DNA, 749 bp, synthetic construct
  misc_feature 1..749: note = Description of Artificial Sequence: Synthetic polynucleotide
  source 1..749: mol_type = other DNA
tygggyggygygtttaggtgtaggttygttttgyggaggagggygggggtygggtaagtagagggygtttagttygggggygtyggtttgggttgggygtttagagtttatttyggygygygggtygygggygygtggggtagtggtttttttagtygggaagttgttgtttaygtttyggtggttgttgyggtttygttagggttgtatyggggtttygygtagaygttttttygygatttgttgtagtttaggyggtggyggtggyggtagtagyggyggyggtggaggtggygygggygatagttyggttyggygyggtttttgaattgtttaatttttgttygygtygggtttaagygttyggtygttgttttygygttgagygtttgygtatygggtttygtttaggtgaggggygtgtgttyggagttygttgggygtgttyggttyggttyggtttygtygtaygttygtttttttggtttggttgaggatttyggggtttggaygtgttaaygttattttygygygtygaagttgtgayggtttattaagtagagatttgygaggtatatagagagggaatgaggyggaatygttygggggttygttgatattgtagagtttttygtagtatygttgttttaaatttygtttttttaggygtgygygtatagygagttagaggaggtttygtttygatttggggtttttygyggtttttagttygggggttygggttttyg

SEQ ID NO: 5987 - DNA, 1134 bp, synthetic construct
  misc_feature 1..1134: note = Description of Artificial Sequence: Synthetic polynucleotide
  source 1..1134: mol_type = other DNA
tygaaaaataygttttaggygtygggattttagatatttgggaaatagagtgtaygtagttgttgagaggtttygygtttggttttttttattattgaggygtagaggtgttgtggatagtttagatttatayggygttygaggtgaaatagaatttttagtttttttatgaggttattggtattttyggttgtttttagagtttttygatttagagttgaatgtaaagtaagygttygaaatgtagaagtagtyggggtygtttayggtatttgtttygttyggggygagagaagaygttaggttgaggttttagygattttaggtattagtttygaaggagggyggggagatygtaaaggggaagtgttyggagggttaayggttttygygtattttgygtttttttgaagygygtygttttttygygtyggggattgggatttgtttttggggaattygtttagaagayggyggyggattggggtygggtattttttagggttgttaggttttttttagttttgtatttgtygygtygttttatttygttaggaagttttagagatttyggggatggggtgggagygtttttttatygygggtttaaaaagaaggaaggaygtttttaggggtygtagaaggaggattagttttaagttataatttttttyggatttaaggtaggtyggttggggtttygygtttatayggtttttggygggggttygygygtttygggagtttygyggttyggggaggaaagaggagataagagataggygaggattayggggttgatttagtyggggtagggattatygtggaaaaattttggygaggtggggggaygyggaaagagagyggttygygttttgtattttgygtygggtatttygygttagtgtttygtttttagtgtttygygtttygygtttygygttttgtttttatttygggttagttgtatygygttygygtygtaggaatygtggagttggaaagtgggggygtygyggttggggggttgttttagttgygtttyggttagygatyggygggtygggtttaaatttagttaggttgggtaggyggtggtygygygattggggatygggygtttygtttttttyg

SEQ ID NO: 5988 - DNA, 1645 bp, synthetic construct
  misc_feature 1..1645: note = Description of Artificial Sequence: Synthetic polynucleotide
  source 1..1645: mol_type = other DNA
tygygtatygaattygagttaggtttggttttagggtagatttaattatttatttygatygagttttygaggtyggygttttagtttttatgtttatttttyggagaygtttygtggagattttggygtttaaaattgygggagtttatttattgygtttaggtggttagtttttgagttttttttattygtggttttttgtyggtatgtaggtatgtataagtatatygtygagtaggaggatttaaygaatttagtttgtggatatgttttaatttttattttygttttttttaggtttgtttaggtgaggatgatgggagggaaaagyggtgtatagtygtaatattggtattttgtaagagtygtyggggtattgatatagagggatatygtattggagatgyggtgtttayggagatttattgygygyggtgaaatattttaagtatygygyggaataattgggtttagtttttttatttyggattttttttaggattataygttattttttattttygaatttaggggtttttttaygttgygtttatttgttttgtttygtaatgattattttagtttggtggyggtggaatttgagttatagaggtyggttgtataggtagaygtgggtayggaagttagaatttggaatttttaggttttttagtttttygtaagatttygtygttgyggttttagggtayggttygtagagyggagttttttggttgtattgataggtgttygggtygtygttttygtygttgttatygttygygttattgttygtatyggtttttgggtygaattgygttttttygggtgggtatatagtygyggggaagtygtyggggggtagtatggagtygtaggggtagygygtttygttaggagtygggtatataggttygtggggygttttagtygtygtttggtaygggaagagtgagtagggygtagttagtttygatttttgaggatygggggattggaggtagtatygttyggagtttaggttgtttatggagtagygtgtagtggtygtagtygyggyggyggyggyggyggyggttgtagyggyggagggtagtttttttttttygtagggggagtttttgyggtygttygggggtttyggtttggttattgtygtagygttggtaaatgygttttyggygtyggtgttattaagtatggtygygggggtttttgygttggyggttgygggtttttygtttatygtttygtaggagagattgtyggaaaattttttggaygttttgtttaagtttaatttttgaggagagggggtygygttggggaggtggttagygttttygtygttgtygtttygygtattttttagygggtagaagtgygygttaggtaggtttattgagtttattaagagttgtttttttaattgtatgttttgtaaagygtagayggtagttggttgttttttttttttyggtggttttattataaaggtaggatgggggagttagygttttttttygaggggaaggtaattttttttttttttygygtyggggttatttatttgtygattygygggtygttattgygygtattggygygttttgaatttagygtttttttyggaaggaaagygtyg

SEQ ID NO: 5989 - DNA, 4698 bp, synthetic construct
  misc_feature 1..4698: note = Description of Artificial Sequence: Synthetic polynucleotide
  source 1..4698: mol_type = other DNA
gygtttygggaaygttttttygttgtattttataggaggtygtgggyggtggtttaatagttttagtgtagagtttgaattttatygtttagaaggaaaggtgagtgggggattygggygggaggtgaggtttgtyggtagyggtttttaggygtgttgggtagtayggttagtagaggyggygtttggttttggatgttgtagyggagaygttaaggagattgaatgtagggagygaggygtagyggtygyggagggtggggtygttyggaaatttaggyggygttagttttgtagtatttgtaggtygggggygygtataygaggggtaygtgggtgtggaggaatyggygyggyggggttttttttttgtagygtygyggyggtygagtgttygtgttggaggaayggygagtggggtgtttgtttygygtaggyggtattygtygttttagtttygtatatagtaggtayggttagggatygggatygtggtttagygtttggaggygttttttaygygtatttttttygatgtyggggygggaagtygagtggttttgttyggagatgttaggggatgtgggtaggggaygaagaggttttttaattggttaaattttggtttgaggaaagattgaggtggttattgattygtgggagygttttggggtttygagggaayggtagtygagttygggagattggtgttgggtattygygggggtyggygggttttaygtgggtggatttygagttgagggtagggtagggtygyggatygttgatttatgagtttttttattttygtataaggatatttgtatatggattygggtttttattygtttttggttgggttggygtygggagygygtaggggagggayggyggyggagtgyggggtttggygggtgaggtgggtgaggtgtggtygygggggagggggygaaggtattagaaggttgyggtygygttgtygttgttgtttttatygtyggygyggggygyggagggggygaagaggtgtttgttagtygtattgyggtttaggggtgaaaggaaaagggtttatgtaaaggagaaagggtaggtagagatttttgttggtgttagtaggtayggaaggatgtggtygyggggatttggagtttagagggtaaygttgggtgttataatgtyggagatgatttygggtgtagaggygattttagttgggtagagttatagagaaygtggttygagaaggggagtttttttaaattagatatattttgtgttgttttaaatttagtatttatttttttttatttygtttttataatttttagggttttagyggagttatttaagygtttagtattattagttttattttaggtaaaaattaagattaattttgtattttattaattttttygtatttaagttattayggggtagttttttatagttttaaggygtggttattttaagtttatagygagttgttygtgttttyggtttttgtttygtaaatttyggaygatgttatyggaggaygttgaaggtaaaggttggtggggttaggygtyggygagattgtygygttagtatagttttygygggagtygagtgttgaygggtttygygattttttttygagggtaaayggttyggttttttagggatatttggttagtgttattttttttttatygggtgtygygtatttttttaatagaaygtgatttygtagayggatgaattyggaatyggtaaaattygtttgtttttgtttagtttttttgttttattatattattgttttttattgyggattgygtygtgtgygtttygggatygtttttgtatttttgtttatagttttttattattaaggtagtyggaggaagattttttygagttatttgttttaygttagtagttatatygaggyggtttttttygtattattttttaagtgtagagtttttgaaagttygaggtttttgtgttaygtatttttttttttgyggggygatttygygtatgygtgtgtgtgttaygygtttaatygtatagagtaatttttagaygtgtaagataaagtattttaagtaaagatggtttagagtttaaattggaaagtatatttygaggygttgaatttgttttygtygtttgtttyggtttttggggygtygtatttaggagaagggttttaattttttgttagattygttyggaattagtttttttggyggtgtagtaataagtggtttygtygttttttttgtgtattyggagggattatatttttttttttttttagtttttagtttaaaygggagtaggtaatggyggggaaagggggaggtgaygagagyggggagaaggaagtatatattttttaattgtgaaattgtttgtttgygtgttgtgttttgggatttttttgttttaattaattttaattttaaygtggtygtaaygttaagattaagatttagaaatgaaaaygtatttattttttttattataaaggtygtttgttgttgttgtttttttaaaatattaagtaattttttttttttttttttayggatttatattttgtttatgagatttttttaattttggtggtttggagaaatgaggtgggggaggggaggattaagggtagtaagaygtttattaygaaaataagatatttattaatttaatagggtygtttttttttatataagatgtttttttattttttattaatttataataggtaaattttgagtttttttaaagtttygttatttagygtttatgttygaagttttaygaataaattttttttttaggtaaatttgtttaatttttgttttatgtttagygaagtttaggtaygatgggttaaggatttttggtttttatattgtttgagttaygttttagttggaaaggttattttgggygagggaygtgttgttygattggtttaaataaggaaagaaagtggagtattaaagaattaagggtttttgtttttttttatttygttattattattatyggttttygggttttgttgagygttgyggyggttttggttgaaaattgygttttygtttaaatygagygtaaaatttttttggatagaagtttgaaagaatttagtgtagaaatagattttttygtttaatttggttttaattagtaattatataagtatatttatataattatttaagtggagagtagaygtttagatttayggtttttaygtgttgttggagttggygtagaygygtgtgygggtatagyggyggaygtgatatygtatttttttygaatttttgttatttagggtggtgtygttttaagagggggtygtggggaggtggggtaataggttgygtaatttatttgttttgggggagtttagggtttagagtagagygtaatttyggggggttgtygtatagttttatttttttatattagaagagtaatgttttttatggatgattaatagtygggttttttttgattatgyggygygtttttgtyggtattatttagttgttttaatttgatttttattagtaaygtgtttttagaggttgygagttggattygtattaygataayggttttttttttttttattyggtyggttttttgggaaggatyggggattgtagttttygygaygttttttttttttgygtagggagtaggtttgagtttttttaygtaatgatttgggagattttaggtatttyggggtttggtyggagggttttygggttttggagttgggyggtgtttgtagtgtatygtygtgagtttttttygggtataatgtgttggtgtgtagagaggaggaaaggaaaaaaaaaaaatttaatattatttttaagtggtattggtatttatgaagtggtagtggtttatattgagygtgtttttgtttggaggtgtagggggyggttattgtagtygaggggagggtattgyggttaagggtagggygagaggatagttaaggtyggttggtygygtgggagtttttttttttygggtttagyggtyggaattattagtattgyggttaaaggggttggtaggtttttttgtatttygygtgttttttygttttttttgtgtttttyggtttttttaggaggaagatggggtgtttatygygaatggggygygtygggtygtttggtygggyggttaygtgttttttttttttygttattgyggygggagttttaattagagygygttagggggtttttttygggtaggaattattyggttyggyggyggagggtgggtygtygttatttgatygttygttttygtttttygygagtaaggggyggtggtagygtttgttyggttataaatggtttttttygttyggttygttygttygttygggttyggygyggattygtttgggygtgtttttttygtyggttttaggygttttatygttttgttyggygttagttygyggttttagttatttttgagggygygtygggtatttagygygtaggttygtttayggaggtygatayggaagtttggatygtygaggygtgtggttygtttatyggtaggtgagygtgtatygygggygtgggatgttgtggggatagtgygggggaygtgtggggttttyggatgygaaygygagttygtgyg

SEQ ID NO: 5990 - DNA, 462 bp, synthetic construct
  misc_feature 1..462: note = Description of Artificial Sequence: Synthetic polynucleotide
  source 1..462: mol_type = other DNA
tygttgggattttgtgygyggggtaygttagygattataaaygtgttttaattttgttgagttaaagttttggtgttaggygttgttttttttttgttygttygagtttygtattttttggtttttttttagttggtgttgtgtttagttttttttgggtaatttatttaggaattygttgyggttatttttygttttttttttaatttgggtygagtaataagtggagttagaattaattttatgggygagaggagtayggaggygagtggagygygttgtygttagaggttgttaaggaggyggggtggttagygyggggggtggaggatgggggtaggaygygggagggaagggtagggggtggggggygaggtttyggggattagygygygagagtgtttagttgggaaatgtagtttygaattaatatygtatgttttataattagtttaygagtyg

SEQ ID NO: 5991 - DNA, 300 bp, synthetic construct
  misc_feature 1..300: note = Description of Artificial Sequence: Synthetic polynucleotide
  source 1..300: mol_type = other DNA
tygaattggtttgttygtggygggtttgtttaaagtataggggttttygttttyggtgygygttgtttttaggattagtgttgttgggagataaagagttttagatattygaggttgggagygtyggagagtttttaggtttygggtattttttyggagtaygtaagtatagttttaggtttttagggatagatgggttagagtygtttgtatttgttygtattttttgggaggttgygatgatygtagttagggtggtygagygttyggtttattgtattyggyggttgttttgtagyg

SEQ ID NO: 5992 - DNA, 554 bp, synthetic construct
  misc_feature 1..554: note = Description of Artificial Sequence: Synthetic polynucleotide
  source 1..554: mol_type = other DNA
tygagatatttygggygygagyggtagtgttgtttgtttgtttttttttttttttagtttttttttttygtgatttatttattttttgtagttttygttygtattttttttaatatttyggtatttttgtattatttgttygggtagtttyggygggttttgggatttgttgtgygygtygagaggaaggtaagttttaaatttttgtttggaagaygggttgtygyggttgtattattagtaggaggaggaggagaagaaattatttygygatattttattttgygggtgttttgtygttgtygtttttgttgtygtygattygagttygygggttygaatatygtagyggtggggayggtgggttyggygggygtygggaggaggatattagyggagttttgtattttygtgtttygtttattagtatttatttgttttttygttttttttttagttttttagagaagggattatgatttggaaaygtagygtygtttttygtttttatagtgtttgygggtttttgttataaggtaattttygtttyggyg

SEQ ID NO: 5993 - DNA, 1153 bp, synthetic construct
  misc_feature 1..1153: note = Description of Artificial Sequence: Synthetic polynucleotide
  source 1..1153: mol_type = other DNA
tygtttttttygtagagatygttagttgaggttgtaatatttgtttyggtaaagygttttygtagttttttyggtttgttygattyggtttttttygtttttgtttyggttgyggtattattttttggagttaygtttyggygagygggggtygyggagygagggggtygttgtgtygttatttattygagtygttygggttggtygygagtygggattygygagggttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatttygggtttttttttattaattaagygatttygtgtttatttygtaggagaygtttyggtagtttttaatttgtgtgygtyg

SEQ ID NO: 5994 - DNA, 1603 bp, synthetic construct
  misc_feature 1..1603: note = Description of Artificial Sequence: Synthetic polynucleotide
  source 1..1603: mol_type = other DNA
gygatayggtttttttgaygygtttttaattaaggygttaagtttagtttgatagtattttttttttttttyggtttttggtttgatgagtygtttttatttgygagyggtgtaggtatttttgttgtygattaattttttttagygtygaattggyggtattygagtygyggttgttaggtygggagaaggttgggtttggtygggttttgtagygtttygggtttygtttttgttttgggygttygttttygtygyggggygaggtggtggagatygyggaygtygagggtttttttagttagtaygtygygttgtttyggttttggggygggggtygyggagttttattaagtggttygygtttyggttttygggagattygagygyggggagggagtgggtgtygygagggggyggttygygyggggagagtygttagtttayggygtttttgygttgttgtggatgtggttaygygttattyggtttttggattgttaggagagygyggttygaygttattaygtygtggaygttyggggatttttgaattttagygttaaggttgygaygatgttygtgatttttatygygaagttattttygtaaggygaygtaaggatttyggygatttygggygtygtatattygttattttttagttttatgtaattttttttttgttgttttttttyggygttttgtttttttataattggaagtygygaaggyggttattgygttgagtygttygttttgttggttaagtttgggygattygygyggaggagggtygggttgattgtygtygttgagttgttttyggaygggagygtttgtttayggtatttattttttttagyggtggaaatgtggagaagtaagtgggaggyggtgtygggaattgattttttttaaaayggtyggygtygttgttttgaaatgggyggttaagtgtttgtgggattaagggyggttttagagatgttyggaaaatygttgttayggttagagtgyggygtagaygyggtagagttggaggtgttygyggtgtaggttgttgtttaygtygtttaggttaggtgttgagggtttagttygygtttyggtygaattatttttagtttygttgagttatttygttygttyggtttttatygtatyggttagaggaaagttttygyggtttttaygtttttttatagttgtagygttttttttgtttttggtttygtaagtgtttatttgagtygggagaggttttygggtygttttaattgttygttttatttggtagttygttttygttttygttttygyggtgaggygtttttygttttttygttttttttttttaaattatagttygagttygtttttgygygygygygtttttttyggtttaagtgaatagttttygygtaagygggatattgtggtggatgtaatttttttygtttttagtygygaggagtttttyggygtygtaggtagygttttttttygaagtagttgtatttgtaattgggtagtttggattttygtgttttgttttygggatttygygtagggggygtttygggatattttttgygggtyg

SEQ ID NO: 5995 - DNA, 1411 bp, synthetic construct
  misc_feature 1..1411: note = Description of Artificial Sequence: Synthetic polynucleotide
  source 1..1411: mol_type = other DNA
aygattagygttttyggtgygaggatggaaagaaattttagaaaaattttygttagataattyggtagtatttggtttyggaatagagaggagagaaagatttgatygtygtatttagggttattygtygtattaagtttgagggttttttttgtttttaggtttttgtygttygagtttaggtttttttaggtgttttagggtygggttgtattygagtttygaggaggttttgttagygttagygyggyggtgataatygagggaggtgggtgagaggtgyggttgtygaggtaaaygtagagtattygtttagttttttaagggtygagagtygggagtttygaaygtygtttaagtagttttttgtttttygtagttygtttatatttttgygggatttttggaygtttygttyggggatttagggaggagggagagaggagggagggagtgggtagtttgggygtaygttatyggttttygtaygttyggtatttttygtggygyggygagttaatgggatttgtatattygaggtgtaatagtattattgtattaattattatttttattttaygtttagattgtttatttatttgygggaaatatatgtygggagaagtttatatttyggattttgtttygttgtttaaggtgtaatttyggggaggyggygaggggggaggggagggttttagattttttattatattttttagttttatttgtygttgtaaattatgaggattttttattgagyggtatatggagattatatatttttttgaatatygttttttaaagtttgtagatttttattttgaaatgaaataatttttygttggttttttyggggataggygttttttgygttttttygygyggtttgggggatttttttygtagagtaggygygtattttaatgtygtggtyggygtttagtggagattttttttatagggtttagaataatttttygyggaatatttatttatatgtagtgtttgagaattaaggtagtttttttgttttgtttttttgygtttagttttyggatttttgtgtygtttgtagtttttttttatttygaatattygtatagaygygagtttatttttgttttttttttaygttgggyggttttaaattygtygygagggttgaggtgtttatatttgtttayggtagtttgtttygtttttaagygttttaaagttttttaagygtttatattggttttgggatagtygattttggtttttttgtttgtttgagggatygyggaagtggyggggaatgtgttttygtttgagatygtttattgtgagtttttaayggaaattttgtayggaaggtaatygttttttygttygyggtaagtaggatttattygagtagyggggatyg

SEQ ID NO: 5996 - DNA, 2629 bp, synthetic construct
  misc_feature 1..2629: note = Description of Artificial Sequence: Synthetic polynucleotide
  source 1..2629: mol_type = other DNA
tygtyggggttyggaggtgttygaagygaygggattgatagyggaggaaaygtagttttttttygygttygttygyggtgtaaatygagtataggtygtggagttaggttgtttyggttttygttgggttttaattttygtttygtttagtgggtttygyggtaagyggtttttgaatagttttaagagggttygyggagtaaatataygtattggttygtttttttttygggtagygyggtttygttattagttttgttyggygygtttagttatggattgtayggtagtygggyggggaaygyggagagygagygtatygatttgtgagagaaggttaagaggtttgygttgtygaygttyggtygtattttygtttygggtttttttygyggtgaatttgggtaggagaygttggggtttyggaaagagaygagtttagtagaaagygygtagagaggtagttttaggttaggggagtgtaaggttatagaggttagggaggtgagtataggaggatataaattgaggggataaagaggagygataggagtttaggaaagygaaaaagtatagagggattttgggygttggttttagaggygggtttagagggtgtgaggttaggttggyggyggygtygtyggttgygatyggggtyggygtygygygtttttgtattttygtattygtttgtatyggtatgyggtgggtttttagagatygaggygygaatgtagygygtyggttttgttgtygtggttttagtaagagtaatgtattatggygagttygggttgtygggtataagygaattgtaggttyggygtattggtgggygygggygtygggggygyggyggtggttgggttggtagggttgagttggttyggyggyggygyggyggtttygtggtgyggtggggtaggyggyggtgyggyggtygygtgtagatggtgtgygtgyggatgygggtgggggtgyggyggaggygggggtgyggtyggygggttttttaggttattgtaygagtttattaygtyggggggtagygttatgttttgtaygygtgtgtayggttygtaygaggyggtygggttygttagttttttgattatagyggtygygttagggttatyggggttygyggttgtagtygtagttgttgtagtygttgyggttgtygttatttggtaggaggtatagggtatgggtgagggaggttgyggtagyggttaygagttgttgaggaagttagattgtaggtatttggggggygttaggtagtygtagtygtyggtttyggygttygttaygtygtattygtttgyggygttttyggtttygaagagttttttgtygggttggaagtgygygggyggyggtyggaagggtttttttatgyggyggyggygtyggtagttgtttttttygaatatgttttygtaggtygggtttagygtttagtagttgtttttgygttygtygtygttttygygyggtattttgatgaagtattygttgaggttgaggttgtggyggatgttattttgttagttttttttatttttttygtagaaygggaatttygygatgatgtattggtagatgtyggatagygtgagtttttttttygygttttygyggatygttatggygatgagygttaygtaygagtaygggggtttttgygtygggttyggttttttyggggttgtttygtygttatttttatygtttttgtttgggttyggyggyggtttttttggttttttgattgtgygatyggtttttggggttagtagggttttygtygygttttygggttyggggtagttggttattatgataaagtyggygygtygyggtygggtygtttttgtttttygttttaggygttggygyggtaaagagttggggygtaygagttygtttayggttaagttttaaatttttggagattgyggatgtygttygygtttgtttgttggaggtttgtygttgttttttttttttttttttttttttttagggagyggtyggygggagtggagtttagtttttggttatggggagttygtttaatagagaggggtttyggtttygtygttttttttygtttaggttagttttygttttggtgggtttttttttttgygtttttttttttttttygtttttyggtttttygaagtaygattygygtttttggyggagttgttttttggagtttttagtgygttaggagtttygttttgttttgattygtatgggttttatygagtttygtttgygttaggygttttygtttttatagyggggyggttagtygygtaygggygagtttatttttaagttattttttgtaaaygtttygtatagtttggatyggtttgttttygtttagygagttttaggggtttagtygatagttaggtttaygygtttttgaaatttgtyggtattygttttgygggttgggttgggagatgaygaggatttyggtggggtttgttygtattyggttaaagtttaggaagttygggttttagygaggaaaggygttttaagttttttygyggtttttaggtgaaagaaaaygatttttttgttttgtygtttgttgtyg

SEQ ID NO: 5997 - DNA, 1686 bp, synthetic construct
  misc_feature 1..1686: note = Description of Artificial Sequence: Synthetic polynucleotide
  source 1..1686: mol_type = other DNA
tygyggttgtttttgtttttyggagatgaygyggagttttgttattgttatttaggtttaaggttatttattttgttygataatttttagtattattaggygttgttttagtgtgygtttggygttttttttagattagtygaygtagaaygtttagagatttagttaagggtaagatttttagygaygttygttagtttttttygtttagatattagtttaaagggtatggtaggttagggtttttygygttattttagatgatttttaggtttygggtggttattttttgggggagttttttattttttgyggtagttttttygagagtyggagtggaggygyggggttggagggtttttyggagtygtttattagggttttttgggggttyggtttygattgggtagggggatttggatagggtttyggagygtggagayggttgaggaaagttgggggtyggggttttggggyggggagygyggaattyggygtygatgttygygtttatgaatatgtaygagttattttttttttttygtgaygttaygggtygtttyggggtgagygtttgagtygtttygggttygygttagtgagygyggttgttgtyggygagttagyggygtagyggygggaattygaggtygagygtygyggyggtagygttagaagygtatttatygggtayggygaggyggtttayggtgyggtaggtatygggaggygagagtyggygyggatagtaggyggyggttgtagttygttggyggttgttgygaggatgttgtttgggyggttgtgttgggtgtygtttttgttggygttgggygtggggagyggtagyggyggtggyggggatagtyggtagygtygttttttygyggttaaaggtgggtgttggggaagtttgttttttttttaggagggaggtagggtaggtttgagggtgaaagyggtaaggatttaggtttaagttggatttgtttatttttttttgtygtagtttttttggtttttgtgygttttggattttygaagttagttttttgygtagyggattagagaggtttattygyggaygttaatttaatttttgggyggggttygggggttgagtagaaggygaggtttggggagtayggataattttgagggttgtttgtgtyggggtgggagygtagtgggtgagtttygagttttggtttagggayggttagagtagggygttggygygtygtggggataagtaggtgtttgtttttgtttgggggaaggattagyggyggtgtttttaaggagggagtygagttgtgatttgttttttagttyggggatggagtggaaatttgtaggttttagggaaggtttygttgatattttttaagtttttttagggygtttttgatttttyggggaaygtgtatttttygggtaggyggyggggttyggaagaagygygggatgtgaggtttttygttgttttttttatttygttttgattatygaggatygaggagtttaatttggtattatttttttgtttattttgtttttttgaagagtttgattttttygygtttttygttyggaaggaagttagatttaagygaaygtttggttttgttaggygagtttggaagtyggygaatttyggattttgatagttgtttgggagygtyg

SEQ ID NO: 5998 - DNA, 1686 bp, synthetic construct; identical to SEQ ID NO: 5997
  misc_feature 1..1686: note = Description of Artificial Sequence: Synthetic polynucleotide
  source 1..1686: mol_type = other DNA

SEQ ID NO: 5999 - DNA, 2132 bp, synthetic construct
  misc_feature 1..2132: note = Description of Artificial Sequence: Synthetic polynucleotide
  source 1..2132: mol_type = other DNA
tygagaaagtgggtgyggtaggyggygtttggaggaattggygtaggtttttttttaygtagtatatttggtygtagatgttgaggaaggtgaagatgtggaagagttggtggttgtggtygataatgtygaaaagattyggttggatgygttyggggattttgtttaygttgaagaaggyggttattattagttagaagtagyggyggtagaagtgtaygaagagtgtggggttttttttaygtaggtygaagagttagttttygagtataatggggtaggttatgttgagyggtatgaygaagaygaaggtgygtagygygaaygggtaggtatattagtyggtayggtttttgtagtaggttatagtgtaagttatygttagtaygaaggttataggtagtattagggygyggtaggyggygataaggygygtgtagtttaygtgttagtttaggygttgttgtaagtatggagttatgattttggtatttagtaagttgaggtttggtaataggtagtagtagtaggttatygtgttgtygaagtygtagtagttgatggaygygtagtttaggtagaagaaggyggygygtagaygtagygataggtagttgaataygtgygtygtgtagtttatggygaaggttagtagtattttygaygygtagtattataayggtagtagttaygggtggtggaagggtaygtygtygtygtttaggaagaatagayggtagaatttgtttaggaatagtagtagygggatgaagtgygtttagaagttgagygtttygttggtaggttttagtatygaggttaggtatttttgggtygtgtayggtagaygtyggtagttygataggatgaagtattttaygaagtygtygggtatttygttttagygtagtagyggtttggtagaygttggggggtttygggaggyggtagagtgggagtttygggyggttttygaagttgtyggggtyggggtyggagggttttttgtgttygygtttyggggttgtaggygtygyggtatggtgttyggggttyggttagggygygygtaggygatttttggygtyggttttygggygttgggtagttttygtyggtygtygtyggagtttttgtgtttaygtygggggygtygttgtaggtttaggagaagattygtgttttygagtagtygtttttaaaaattaaataaattaataagagaattaattaataggtagygttgygatygttaggagygyggagygygygaggtttagyggttttttygttaagtttttgttatyggygygyggtygttygygttgyggtagyggyggyggygyggttgattgyggyggtagygyggtagyggtgattgggtatygygyggtgygggtgttttygtygtygtygttttyggagygggaggtggggatgtgygagtygaggygyggagggagggaygggygtatygaggaagggygggggttttttaggttagggtttygyggtygtttygggggatagagttgttttttgtttygagtttygtattattttttttttygggtygtygtagttygggtygtttygttaatgattgatgygggggtygtaggttggtyggygaygyggyggygygygygtygagtattagagtyggttttggggttygaaattygatagttaygygggygttttggaggatattggggagtygygttygyggggggyggggagttgyggttgyggggggaggggagggygtyggagtygggtagggyggagagatgygttagyggtaattttyggaggtygtyggggaggggggtatttyggaagtyggggggttttaagttygygttyggatyggggtygtgttattgttagttatttggggatgygtttttygtttttttattgtttttgygtgtgtgttagtgtgtgtgtgtgtgtgtgtgtgtgtgtgtyggtttgtttaygtattataygaaggtttagttggttttttttygtttagtgggygtatttaggtgygttattattttgtygtttttttygtttttgttttgttygaaagaatygttygtaagttgttttgtggtygygtttattagtttttygagtyg

SEQ ID NO: 6000 - DNA, 2954 bp, synthetic construct
  misc_feature 1..2954: note = Description of Artificial Sequence: Synthetic polynucleotide
  source 1..2954: mol_type = other DNA
aygttaattatagtggaygtagtatygygagyggaaatgyggagagtatyggggtttygtatgtggggtataatgaaataagagtagtttyggttagaggtttagtaaagyggaaagayggtttygttygtatattttttyggaaaattgaagygttttttttgatttttaaggttagaaagatttattatttttttygagagggygtagttatagatttattagagagggygggtagggtgtyggaagttagagaayggygtttygygtttttttatygttttagggygtagaggtgtttttagtgttyggagaggttggtagtgtyggtttygagggaagygtggagyggayggtygataggggatttttgtttaaattttattattaattttttttgagagtaaaaatatggggtygagttyggtagttgtaygtagaatttaattttttggtagttttyggtatygaygagttttagatttygygttygtatttyggygttttgygygtagagttaagttttyggattygtggattgtagttttygygygtygyggtaaagygggtygygtttttagttttygaggygtagygayggtgggagtyggttyggygttgggggygggggyggggtyggygaagggggagggttgygyggyggaggggaggagtygyggygatagayggyggygygtattaatygggygtyggttggtaggagtygygtagaggttggttygagygygttgygggygttyggygtaaggggagtygggtagtagtatttttttgggygtygttttygygyggyggyggyggttgyggyggggtttttttttgtttaaatatttygttggttagaagygttggtatygggggygggttgggtygggtygggtagtgttgtatatttgggtttttttgtttagagttgtgtgttyggggttttttggtttagtyggaggttgyggagyggygggggttgtttgygttgttygttygggtattttttyggtgatggaagtagtygtygtygtygttgyggggtygygttgtgttttatttatygttgttagagaggtgggaaaattygtygtayggaggtygaaagygagaggggttgygtygttatgtygggagttgagttttatataagtygtttttagttatygtttttagtyggtttygtttttttgagygagataggaagttgyggtttygagaaagyggaggagaygtygttggagtygggaggygtygggttyggyggagygyggagyggggttttgggtygygtgaaagttttttttttygagtygtagggygttygttgttyggaaattgtttagggataagtyggtygattttttagatttttygaaggtgyggggatttttagyggaagygagagggagygaaatygaggaaygagtgatagtyggatagttygtygggyggtgattyggggtygttttygggygygttttyggttttaggtgagyggaggaatygggtagaatygagggtgggygttatttaggaggaggaggttgggagggagattggggygtattygtttatttygttttttttygtaggttttattyggagtygttgttatgggagagttagttttgggygttggggattagtygtygygttygtttyggagtygyggttygagtttyggygttagtagttagttygttgygtttttttttygggttgtagggttgttttygtygygtygtyggttyggattgtgtttgtgatgagtygtagttygtagygagttttgttttygggygygttttttyggttgttttaggttgygtttgtagtygygtygygtgttttgttttygtagtggtttyggygtttaggaygtygttggttygygttttttttyggaatgaaggtgtttygtaggaaggygttggtgttgtgygygggttatgtattgttgttggtgtttattatgtttaattttttggattataagtggtataaggagtygttgtagtagtgtaatttygatgggtygttgggtgtygtagygggggtagtyggaggtagttgggggygtttagggtygttttyggtygggtygtttygtgtttatgttygtttggattttygtattttttatygttttttygttgtygtygtyggggyggtttttgtagtygyggtagggatggygggggttgyggtttttttaggtaatggtattyggggtatygggggygtyggggataagyggtagttggtgtaygtgtttattaygtggygttttggttygtygtttttyggygagttatttaattagaatttygaggtgttttttttttaygagttagtgtggtatgtatggtaaaaattgtattygggggaygtygtttttttgtagggggtagygygggatatgttgagygttttttatygttgygatttttttgttttttagttgtatagtttygygggtagyggggggygtaattttattaygttgggtattttyggygtagttattaataaggtggtgtgttygttattattttgtttygtttatygtaaggaggtygtggggttggtggaygatygygtgtgtaagaagtgttygttatagygtttggygygtttygaggaggagtgtygtaagtatygtatattagttataaagggtgtgygygttttygaygtggyggttttggygttattgttgygagattyggttttggattttaaggttatttatttggtgygtgattttygygyggtggygagtttayggattygttygygttayggttttattygtgagagtttataggtggtgygtagtygagattygygagtttatygtatgttttttttggaggtygygggttataagtttggygttaagaaggagggygtgggyggtttygtagattattaygttttgggyg

SEQ ID NO: 6001 - DNA, 2954 bp, synthetic construct; identical to SEQ ID NO: 6000
  misc_feature 1..2954: note = Description of Artificial Sequence: Synthetic polynucleotide
  source 1..2954: mol_type = other DNA

SEQ ID NO: 6002 - DNA, 885 bp, synthetic construct
  misc_feature 1..885: note = Description of Artificial Sequence: Synthetic polynucleotide
  source 1..885: mol_type = other DNA
gygtaygtttgygtgtttattttttagagtttttggtttygygatygtgtattgattttttttagaattttaggttygttttggaygtggaaggtagtygtgtygtttgggaaagtggagtygagttygggaygttgtyggtttaaatggaaygtyggtttyggggttygtttttyggygggttttygagttaaattttttaattgttttatgaygttatygggttttttttttttgtttyggttygygyggttttagygtggygttaaggagtgtggyggttttygygygtatygtgggttatttttaatttaggatttggttagtaggttgtttttygagtygaggttgygttgggyggaattagggatttatagttyggagtggggttgaaatagagtttttggttygagtagagagygtgtataygtatgaaatygtgtttttgggtgygtyggyggttaggtgttygatgtyggttttggaagtagygtyggagttygtttgaatttaggttygggaggttagaggttgtyggttaygtttaattgtgttttttttgggaagataatttttttagttttggtttttttttgagttaygggtggttggttggtttggtggaaggtaggtgtataggtaatagagataaggttaggaggtaaagtatatttatgtgtaaatgagaygygttagggaatttgtaattttttgtattttygtttttgatgtttygatttttataattatagaattttaggtagaggtygtygattttttygttttygttaagagggattyggagtatygaagttttttagtyggtgtyggygttttygygtttttttttttttttgygtygtgattttaaaagggyggygggyg

SEQ ID NO: 6003 - DNA, 2174 bp, synthetic construct
  misc_feature 1..2174: note = Description of Artificial Sequence: Synthetic polynucleotide
  source 1..2174: mol_type = other DNA
tygttttatyggttttttgyggtygttgtagaagygtattttgttgaatatttygaggaygtgtttttygtatagggagygttygtttttgttggggttggagyggygtttggaggtygatattyggtygttgttggattttttygtttgtygtttttgtyggattaaggagttggttatygtygtagttatagttgtttagygagggttttaggttttagtttttattgygtttttyggtttgygtttygtyggggygagggtaggatttgggyggttagggaaagggtagtygyggggaggtagtgttaaaatttgaggaggttgtagtatygaaaattyggygtttataaggttagttaaagtttgggtagtggygataaaatgtgtgaaaatttagatgtaaatttttttaatttttggyggtyggggggyggggyggggyggttttaggtttttttgygaagtagaygtttgtattttaaatttgtattttaaggygatyggygtttaaggggtagtggggagtttagttatattgygttyggggtattaagtggaaggggaagaaygatgtttaaaataataagaygtgtttttgttggagaggygtaagygttgtaaggtgtttaaagtatatttatatatatatatatagaaaattygtttataaagtagagtttggatttaggygggtagygygttttyggtagaaaatattaaaaagtgaataaaaygtttttttagaaaataagttattaatygtaygagagaaggagaggaaggtagtaatttaattttttgyggttygyggttttgaagattaggaggttygttttagtagggtgaggtttatagaatgtatygygtyggttgyggttttttaggggtyggttattygagttttggaatttygagaggygygaagtgggagyggttattyggagtttgggtaggggygyggggygggggtagttgtttttagttgyggtgagagtaattttyggttagtagtattgtaaagagagtgggaggygagggaggggggagggygygagggagggagggagattttygagggttaagtatttttyggggagaaattagygagaggygatttgyggggttttaagagtgggygtttttttttttttygtttgtttttyggtaygagaygggtatagttggtgattatttagggaattttaaatttggaatgatttagtagtttaaataagtttttttaaaaggtagygatgtygaaggtgttttttttagttyggygtttataygtttttaattggagtttttygttatggtttattyggggtygtygtatygagttggttttygtataggtttagagggagygagggaagggagggaaggaaggggygttttggygggttygggattaggttatygtygygttgttgttygtgttttttaggttygygygtttyggtagttagtagtttataggtagtagattagatggggattattygtyggaygtaaggtygattatttagtttygygtygtttatttyggtygaggaaggaagtgattygygygttgygaatattygygygttygttygggtggggygggggttggttgtaggygatgttggttygyggyggttgaggtttttggtyggagttgtttattatggtttggygttaggggygtaggyggggtttttaggttttttggggttatttygygaggtagtygagggygtaattygggygtttggggtyggaggyggaattaggggtyggggttaggaggtaggtgtaggyggttgttaattygtttaatttgttgygygggtggtygtttagagtygygggtttgyggggygtttttygtygtygygtygtygtttttttaggttygggagggggygtttagggtggagttttatttatgggttgaggttttgggygygyggagtygtygtygttttttyggttggtttagttggagtgttagtttygtaggaaattyggggttygggygagagttatygagatggtaggtgggaygtagagttygyggtagttagagtttttttygtayggttygtygatttayggaagagygaaagagygtttaggtggggtygagttgggggtygggtttttggagygttgggaagtatagygyg

SEQ ID NO: 6004 - DNA, 873 bp, synthetic construct
  misc_feature 1..873: note = Description of Artificial Sequence: Synthetic polynucleotide
  source 1..873: mol_type = other DNA
tyggagagttgttatygatttttttaaygttttaagttttagttttgtygttygygtttttttttttttttgggttataattttggttttttygggtyggttttaygtagttgygtaggagttygygggggaagatttttygtggggatttygagtaygaygtgygattttaaatttttatattttttttgtygtttygtaggttatatgtatygggagtygggyggggtaggygyggttygtaaggattttygygatggagaygtaatattgtygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtygtygttygttgggtttttaggggtttgaaygtttaggggtygyggygagtttattyggagygagttaggtgagtaggtygttatggygatgyggtttyggagagygtaygtttgtygyggtyggtatggaaaygttttygttaggttygggggygtygttgattggtygatttaatagaygygggtgggtagtttagtygtatygttaagttyggtyg

SEQ ID NO: 6005 - DNA, 2174 bp, synthetic construct; identical to SEQ ID NO: 6003
  misc_feature 1..2174: note = Description of Artificial Sequence: Synthetic polynucleotide
  source 1..2174: mol_type = other DNA

SEQ ID NO: 6006 - DNA, 510 bp, synthetic construct
  misc_feature 1..510: note = Description of Artificial Sequence: Synthetic polynucleotide
  source 1..510: mol_type = other DNA
gygggtatttygtaygttaygtaggygttttttygatgagtttttttttattttatagtttagggaaggtgyggggttgygggygtagagttgtataagtagggttgtaggttgggttaaagtygttttgyggggatygatatgaattygggttttttatyggaagggattaaggattgagggttgagyggyggtagyggagatttygttygtagatttygtttygtygtygttatttttygtyggttyggatgaggtttttttagttttgggaygttttgtttttatatttattatttttttattttaggggtgtagyggagttttagttaygaattatttaatattygtaggttatagagygayggaggttgaggttgtgatygaattatygaygtttttttgaggggtgaaagtayggtygtggagattttaatygagtttaygttggygtaaaaggtaaaagtygygttagatttyggatgtygttttttttttttyggttgygyg

SEQ ID NO: 6007 - DNA, 511 bp, synthetic construct
  misc_feature 1..511: note = Description of Artificial Sequence: Synthetic polynucleotide
  source 1..511: mol_type = other DNA
tyggagtttggggtygggttttttttatttgygtgttgttttygggtttygtttygtttygtttyggagggatttttaggtygggtttagatttaggagttatttggggatttyggggtggttgygygtygagggggygttagyggggaygtgagttggygtygagatagtttyggttttttagygttagggttattgttaggagattttyggttagtatttaygtggggygttttygggagttygaggggtttatygtttgtygggattygttattttaaagyggygggtgtygtygagtygttggagttttyggattttaggttygtttygtygtygagtatgtttagtgygagtygtygtygaaagttttttggaataaatattygtatttggggtttggygggttaggaggtgtyggaygggygtgggagggggagagygagttggygyggtttaggygttyggyggttaggtttgggtttgtttgygtttaaatygaattagagyg

SEQ ID NO: 6008 - DNA, 417 bp, synthetic construct
  misc_feature 1..417: note = Description of Artificial Sequence: Synthetic polynucleotide
  source 1..417: mol_type = other DNA
tygygtygtygttttggyggggayggtgtagtaggyggygggatgyggyggggyggtagtttgagygtttyggatggttygyggyggggyggtttgtaagagygaygygyggttgttgttggggygggaygygttgyggtyggygttygttttgttggttttygtygtgttgttgggygtygygttyggtttyggtttyggtttttggtttggttgtygygygggtygttagygtaygygatattaggtgggtyggtygagtagatagyggyggggyggggagygyggggygygtggtttttgggttttgygggttyggagtttyggttttgygattttttgagtttggttgggaatttygtaygtaatygtttaggygtygggttttttttttgttttaggagggaggtggyggyg

SEQ ID NO: 6009 - DNA, 1748 bp, synthetic construct
  misc_feature 1..1748: note = Description of Artificial Sequence: Synthetic polynucleotide
  source 1..1748: mol_type = other DNA
ayggaaatattygaatyggtgaaatgtaaatygtgtttattgtataagggaatygtgtagggagagtygttttttataaggagttaattagygtttgtttyggatattttygyggggtttttagyggggtttaaattggyggyggtttagtagggggygaggggtgttgggaaaygtyggggttgygaatttayggaagaaaatgtattyggtgtagttgttttagattttgtygtygyggtattggttgaygaaggyggyggtgttygaggagttataygttattatgtggaagtyggtttyggataggygattaaaggtttgttttaagtaggtgaatttgaggtagaagygggaygtgtattttttyggttgtyggtyggggtygyggttttygttgagygtgttttygaagatttttttggttagygygatgygttygtatattatgatgygygttataygtyggaatttggygtyggtttggttgtygygtayggtggtgtaggagtttyggtagtttagygtgaggaagttygagygtttgttttgygygtygtygtygtygttattatygtgygttttygggttygagggtayggyggtygtygtttygygtagtagtagygygtygttgttattttgygagaygttgttttttaggtygttttggtagttttygtygttgagagagttttgtttggtgattttgggygatagtagtttgattaagtyggtgagttggaaatattyggtttygygtagtagtygttttttttyggggaagtgtttyggtagygygagttgtttgtttygtagataatttagtaygtatttgaaaaggaagtygtttyggtygatgaagaagygygttyggttgtttttgggtagttygtttyggygtygggygtygttayggggattagagggygagaatatgttggttaaagtattgttygggaygttgagtagygtygagtgtttggttatataaatttggtygtttaygtttagttttattattttagggaagggygagggtgygtagggtttyggggyggyggyggtygaygygtygggygagttggaygaggaaattatttygttaatgggtaggatggtgttgtygtygttgttygtgttttttagagttatagttttttygtygtyggtttagtgattygagagagttgtattttttygttttyggagttygygttttagtttttygygtgtttttggygttttgygttttyggattgggyggygygttttttygatyggggyggtttygtttagggttyggggtagyggyggygtyggyggygttygagttttatyggaggagagaygygygagagaggagtttygtyggtgyggyggyggtaatggagaggtaagaaggagttgttgtttttttggggygagggyggggaagtgtgagagagatttgygagaggttttagggttgttgttyggtttttygtggggagggygggaggaggggtygaagtaaagaaaattygtygtttyggtagtttgtaagygtgtygygaggtyggagygtygayggtggygttaattatttttggtagtaygggaggaggtattgaygttaagtttyggattgggattygagttttagttgttatttaaagagataggttgtagtygyggttttygggtttygaygttagggggyggggtygagagtygagtttgtaagaggtgtagtttttygattygyg

SEQ ID NO: 6010 - DNA, 1748 bp, synthetic construct; identical to SEQ ID NO: 6009
  misc_feature 1..1748: note = Description of Artificial Sequence: Synthetic polynucleotide
  source 1..1748: mol_type = other DNA

SEQ ID NO: 6011 - DNA, 648 bp, synthetic construct
  misc_feature 1..648: note = Description of Artificial Sequence: Synthetic polynucleotide
  source 1..648: mol_type = other DNA
aygaaaygttgttatatygagygaatgtaaygygtatataygtttatattygaatagtataagtaagagatyggttgggtgtggaatagaggygtatatygygtaaygtatttatagtatgtataygygygtatttygatttygttttttttygygygtttttatatttyggygtttaagattttyggtttaygaattttattagatagtygggtaattttttaggtgygtagtttgttatttyggygyggtygtttttgygttttagygtttttttttaygtygttttttttagtygtttgyggygtyggagtttagygtaggttagtttagttagtttygtygtgtatayggtgygtagygtgggttyggggttgtyggtttagtygtttyggttaygtgtgagtygggggygygggttagygygatgygggtaggagttgyggyggygtyggtgttgtygtttggtttygyggygggggtyggtgtagaggagataygtagggagggagggaagagaggagggaaggaggagggagggggttagtyggggttattgtttggatagttgggygtyggtttttttaaaggtggggttattygygttygtaygtatattagttygaatttttattttygatatagtyg

SEQ ID NO: 6012 - DNA, 863 bp, synthetic construct
  misc_feature 1..863: note = Description of Artificial Sequence: Synthetic polynucleotide
  source 1..863: mol_type = other DNA
gygtataggaagggyggaggyggtattygggggggattgtttttagaggaggtygttgtgagtyggygaygygaggttgggggagtgggaggtaaattygttaatttgtygtygaatggttatttttagtttttygtttaygagggtggaaaggtagaaggtttgaaggtaaggygtgagggagygtttaggaygttttyggaggggtygggtyggggtttgygttgtagttygtaygtattttattttygygtygyggygttyggtygttygtttttttttttgggttttttttggtygtygtygtttttttttttttagtttttttttttttttttttttttggtttttygtttttatygttgatttgttagygtttttgttygtttttttttyggygttygttgttttttttgtagygtgtttttygtttttatttyggatggggatggggtagggggygyggggtgagttattaattttagtygtttgtttggtygygtaaggygggaaagtgggggygtttttgygttttaygttaagtttagggttaygagtatttttgtggagatygggagyggttgggttagggatgatgttttttttttttttttttttttttttttttttgttttygttttttttttgggttttttyggggattattttttatttttygttagagtygttttgggagagtygagggtttgagggtygattattaagggtagagtttattttttggggagttgttggaggagataggtagygtygggaggtggtttatatygtatygtygagagygttttgttttygtatygttgaaatttaattayggttataggttataaygttaggggtyg

SEQ ID NO: 6013 - DNA, 1288 bp, synthetic construct
  misc_feature 1..1288: note = Description of Artificial Sequence: Synthetic polynucleotide
  source 1..1288: mol_type = other DNA
gyggattygagagyggygattttygtttggaggtygttggtttttatatttaggtataggtaagatattayggttattattgataggagggtygttaggayggtataygggggtatggttygggtataatgttgttyggtaggggtygggttttyggatttgggttttyggtttttttttttttttgygtgtttttttagtagtatygtggyggggtyggtygtttyggtttygttttttattttttatattttaaataattttaaaaggaaagaaaaaggtygatttttttaaagtttagtttttgtggttgtataattagttggtggagttaagtttaygagyggatayggatttttgttttgtttagygtttagattygtaggygtgtattattttygtttttttttttttttttagttggaagtgaaaagtatttttygttyggggattgggtggyggtggggtaaaaagtaagaygaaatttatttagatagttttttygatttttagaggatygatatttttttygagggttttaatagtggtygtttagggttygagggtaayggtygaggygttaygyggggtygyggttygttttggttayggaggatyggatttgttgygtttttgtgagtttgttttatttttatttattyggtgtttttyggtaygtygatttgttttttatttgtatttagtttaaggtaaaaaggttgtgagagtaygttatagygtagygygaaaggggygattaaggtggagaagagagaggaaaaygaaataaatttaaggaattaatgttattygygaagtygaagtygyggttgttygaaggattttygtagtttygygtgygygatttttaaatatttttygygatgttygygtgagtgtgtgtgtgagtgtgtgagtgygygygygtttygagtaygaygtttttttttygattttttttyggygttyggygttyggtttgtygttttygttgttgygygtttttttttygaaggtaaagtaggagttygttttattattataatgtatttattttggtttagttygygggtyggttyggggaatttttaagggaggygggaagtttgggtgggagyggggtaggaggtttgttattagtataatgtatgtaaatagttggagyggttatygtgattggagaggagtttggygatttttttttttgygyggagtaattttagtattttygagggttatttttttggtttgggtyggggtygaagyggggtyggttgygtaagaggyg

SEQ ID NO: 6014 - DNA, 1275 bp, synthetic construct
  misc_feature 1..1275: note = Description of Artificial Sequence: Synthetic polynucleotide
  source 1..1275: mol_type = other DNA
aygyggagtaaaatttaatyggtttagggaatttagataygtttttygygtygtayggattttttagaaggagtttggaggtaggygttggatttttttaggtattttygttttygtyggtttttttttttygygttygttgggttatttattygygtggggtatggtgatggtttygttggtgttggagtttaygttgaagatgattayggttgaggygttttgtaggaaygygtttyggattttatttttgtaygtgtagttgtttttggggatgagggttatttagtttttgtygygggtyggggyggygaatttggtgttggggtygtaggttaggyggtygtgggtygagttggttatgattattttttygygggygttttgtttgggygagtgtttttygtagygttygtatttygtttttttygtgtgtagtttygygtygtygtygttygtygtttyggtttyggggttyggygygggttyggygtaggtgatgtttaygaaggyggtgtattatttttttttttyggttayggtaaagtttaggtagagtagatgtaygaaataaaaggaaagtagttatgttgagagagttagattgtagtaygtttggatgagagatattgttatttttattygtyggggtttttttttygttttygygtttttttttygtttygttttttttttttagtttyggttaatttygggtygttgtttttttttttgttgttgtttattttygggtyggaggggtygyggtygggaygygtagtygtygyggggatyggatttygggygagyggatggygttggttttttttttttttagttgtagygyggtggttgtattttgttttttgggygttyggggggygygggaatagagggttygyggggtttgyggaggagttttgttgtygagygttttgttttttygttyggtttygtttttttttataagggtggtygggggtttaygaatttgtagggtggyggttttgygttttttagtttyggyggggaygggtaygattgttygtagtttggggtgttgyggtgyggggtgttgtttagggtgtttyggtygtygttattgagygttggggygygygaatttagttgtagtygttgttgttttgygtyggtttttttaggttgygggygttgygtttttgatttygtyggtggttgygtttgggtaygtatttgtygygggyggggygggtttggggatagtgggagygagtaggtagagyggagtaagyg

SEQ ID NO: 6015 - DNA, 1071 bp, synthetic construct
  misc_feature 1..1071: note = Description of Artificial Sequence: Synthetic polynucleotide
  source 1..1071: mol_type = other DNA
gygagyggtggttygatttygggtgtggtaggaaggggtgtttygygttttagagttagtgttagtttttattttttygggaagtygagatttagggggaataggttttttagagtttagtttgtagggaygyggagggtaggagtygtyggygaggagtagttaatttgttatttttggyggttgtatttttyggyggttataggttgttygatagyggattttagggttttygygayggtatttagagtgtttagaagggaggtyggggtyggggtgggtygggaaaatygagggagggaaggagtttggagaagtttygtttaggyggggagggggygattyggggygtatttttygattatgatttttatagattttggygtygtaatttgygttttttgaggtygaagatgygtattttggagaagatatttattaggttgtygttgtagagttygyggtttttgttggggttgtttygttttttgttggtagayggtyggttttagtgttgttttygygtttgtygtttttggyggattaagtygttagygatggtygyggttatggtggtttygggaaygggttyggggagggagggygygggaggayggygagtygggggtatyggaggggaaggyggyggygtagatygtggttygttttyggggtagaggagggggtgttaggygggattggggagaggggaaggggggtttagttttgatygggatttatygtttttttygyggggygyggggttaggygygtagatgygtttagggygtagtyggaygatttygggaagtyggaygtygtggtygtygtygtttggttaygttygagtggagagygggatygyggttgygggygttgttggttatygttygtygtaggaatttyggygggggtygttatygttattygygttgttttttygttttgttyggttttygggygggaggtagagtyggtyggyggtttttygggygtyggttggagggygggtttyggtagggtttttgygygttygtyggttygggtygygttgggtaggatttagygtyg

SEQ ID NO: 6016 - DNA, 694 bp, synthetic construct
  misc_feature 1..694: note = Description of Artificial Sequence: Synthetic polynucleotide
  source 1..694: mol_type = other DNA
aygttttygaatttyggattttagttgttattttatttgygtygtttyggaygttatttggttgttgaygtggtttygagttagtaaataaygttagtagtttttttagatttaygtyggttygttttttygtyggtttttttttygtagtggttttttttgtagtttttttgggtttygyggttagtagtgtagttygtggagtygyggttttgttygttttttttgggtggttttagtgygygggttgatatttatttagtyggggaaggtgaggygagtagaggttggtgyggaatttgtygtttttagtagygtyggygggttaagtttagggtygggtagataaaagaggtygttygygtaggaaggtayggtyggyggyggyggagygtagygatggtygggygagggggtagygygttgttggttttgtgyggggtattggttgtttgygggtggtttttgggygtygaagtttaggagttyggggygttygyggygggtatgaggyggygtyggyggttgtagtaagaggayggtatttttttygagtattatygttatttygagttgygygaggygttygtgttygtgtggttgtagtgtatygttattagtaggatttatayggtggggygtagtttygagggtygggagtttttggttatygagttgttygataattttggyg

SEQ ID NO: 6017 - DNA, 694 bp, synthetic construct; identical to SEQ ID NO: 6016
  misc_feature 1..694: note = Description of Artificial Sequence: Synthetic polynucleotide
  source 1..694: mol_type = other DNA

SEQ ID NO: 6018 - DNA, 1424 bp, synthetic construct
  misc_feature 1..1424: note = Description of Artificial Sequence: Synthetic polynucleotide
  source 1..1424: mol_type = other DNA
tyggygggtaygttggggatgtattygygtagttyggygaaggygttgttgatgttttgagttttgygtygttttttgyggttggyggtgtttyggygttttatygggygyggtttttttaggttygggggttyggygttyggyggtattttttygtaatgggagtggtttaggtyggyggygtygttggtatattyggggttgtaggatagggttatgttgtagtyggggggygatatttyggggtggtygatgagttagttatggaagtaggggttttttttatggttgtagyggttggyggyggyggyggtagttgyggyggyggyggyggtaaaygggtagttttygtggtgtattatygggtggtggggaaaattatttattagatttatttygtttttygygtttttttaygygttttagygtgygygtagtttygtygygttttyggttygggtttttgttttagygttyggygtttttttttattttttattttttagttttygggygttygggttygttyggtagtygtagagggggttgttgtagttygggtttygttttttygtttggttagtygggttygttttagtagygttgyggtygtyggttttttatggggygyggygagttggttttggtatygtgygtttttggtygtygtygtygtygttttyggttttygttttgttttayggttygygtttyggtttttgtttttygggttgttgygyggaggtagaattttttygtgtttatataaaggtgtyggggttttygygaggttggtaygyggagtttygggaatttaagttygggtygyggttttggtatygaagttaattyggaatttaggggygagtttgagtygyggttggaggagtyggtttagttgtgtyggggggyggyggggtygattgtttattgtaaagttattttygtgygattttttttttttygtttttttttttttttttattagttygatttgggtttttgggygtttattgttttaatgaaatttttggttgttgttgttttggtttttaaatgtgattttagttgygagtaaygtgttttygtttttttygygttttttyggagggtttttagagaggttttagtgtatttatttttttagatttttttttttyggggtaaggatttggggttttgaatgagttttggagttygaagatygyggttygggttttyggagggttttgygyggtggtygaggaagtttyggggtgayggyggtggtttttttgggttggaygaygtgaggggagtaagyggatttttttagtaagatttttatgtatagttatatttttagggtygttygggttaatatatgtygttagaggttttttaygttaatttyggggyggtaggggyggygtttygagttttyg

SEQ ID NO: 6019 - DNA, 1215 bp, synthetic construct
  misc_feature 1..1215: note = Description of Artificial Sequence: Synthetic polynucleotide
  source 1..1215: mol_type = other DNA
tygygtaggttttygggttygtygtagattttaaygtaaattttygggtttttygtaaattttaaygtagatttatygtggtttygttygygtygggtttygygttygagaggtygagttyggattygaaggyggyggyggyggygggygtttygygaggattygggagtagygtagyggygagtagagaataygttatagagaagaagtttagtaagtgtatggtggaaggatygggggtgggggatyggttygttggygggggtaggggtgggggygygggygtttttgygaggtygygggttttttttggtttttttttttygggtttttttyggygattttttttgggygagtyggaggyggygggagygggttyggggtttygygtttttaattttgtagggygtttttttagttagtgtyggggaaaggyggygggtgttaggtaaaagttttataggaaatyggatattygagtttttygtattyggagttygygaggtgaagygagggygagggaggaygtygtygyggttygygtyggtgtagttttttggagaggyggggygggggatattagaatatttygygatgtttagtttttttaaattygttagagttttygtttttttttttttttttttttttygaagtgagaggagtygggtygygggygttgyggygggggygttggyggyggtgtygggggygggaggagggyggyggggyggttggyggyggyggggttygggagygtygyggygtaggattttttagagygygtygggttgagyggyggyggyggyggyggygggygtaggggtagggtatgattgaygygttttttgtttgygtttatgtgagagaaagyggtygagggagggagygtgtygagttygggttgttttttttttttattttttttyggaagtygtttttttggagtttttygtttttttygtttttttttyggyggttttatttttttyggtttttttttggattttttttttttygtttttgttttttgyggggagygggyggtyggaggggtaagtttagtttyggggttggyggttggygggatyggttttagaggtgatgygattattttggattaygtgtagyggggagaaattgggtatygtggggtggagggagttttygttttattttyggttattttygagtttttgttttttttttygtayg

SEQ ID NO: 6020 - DNA, 1184 bp, synthetic construct
  misc_feature 1..1184: note = Description of Artificial Sequence: Synthetic polynucleotide
  source 1..1184: mol_type = other DNA
tygtttttttttttygggtygygatattgattygttaaygttaatgggggttygygattgttgyggggaygagggygtagagtagttttygttaygggtyggtttaygtaggggtygagaaagtggyggagaggyggtggtygaggtttaggggygagygygggttgagttggtttttgttgygtttaygagygatatttattttttygttgyggaygtttygygggygttaggttgggggttttgygatygatttttttygttttygaggtatygtygggttygtttggtaggtagygygtttygygagttggagggtygagtttygyggggtygtggggygtgtgggtgaaggygatatttyggatgygggaygtatgaatggtggtagagtaggggtygggattygtttatgggttgggagagagatgtttttgtgagtaygggaaagtagygttgtyggagaatagttttgaggygggattaaaagtygtyggygaagtttygtygaggaatayggtygttgttyggggyggttygygagygtgygtgtgtggaggggaggatgtygtttygyggggttttyggagggtgtygggagygggtttttagtgtagttttttygttttygttgggggtayggttgtttataggtttyggttygygtgtgtggagyggggygagggggtgaggygagggggtgaggyggyggtygagtyggggygttgggygyggggttggygggaggyggyggtggyggttyggygygaaggggttaagyggygtatygttttttyggyggtygggtgtaaatagaggagttttagtttattatgtttggtygtygygygtagttygagttyggagttaggygttgtaataygataygttttagatttaggtaatttggtagygttgggttyggttttttayggttatagygagggygygtygyggtaaggtgggtgagyggyggyggyggyggyggtttggggygggttggyggagygyggttttyggtgaggtttttygygyggtagggtygttygttygtttyggggattgyggyggtggyggtggyggtggtggyggyggyggyggyggyggtttygttttttttttttgtggtgtyggaatgggaggaggttyggygygggtttgaatyggtgyggaggtaatattyg

SEQ ID NO: 6021 - DNA, 5820 bp, synthetic construct
  misc_feature 1..5820: note = Description of Artificial Sequence: Synthetic polynucleotide
  source 1..5820: mol_type = other DNA
gygagtagaaggyggaygttttygagtygtaggttaygtagttgttatagttttgygattygttatagggatttttatagaygtttagygtygyggtygagttgagttygtggygygyggtggttagtagtyggttttygtagatygggtagtagatyggygtttgggtygaggyggygggttyggagttygttagygtgyggttttyggattygtagtaygtgtttagggagttggtggttattaagaattgtagagagaggtygygaggattggygggaagtygggttggaggttggggttttgggttttgttaatttygygygtygtttaygagggygtgtttygagtattttygggtttttygtygtttatattaggatgttygtttttttttattagtttgtgygygtttggtttttttygttaygtggggtttagtygagtatttatattttttttyggagggtttttaaggtttttgaygttatttgygygttaagtttttttttttaggggttttttggggttttaggatttttttggggtatagtttgagttttgtggtttaaatattagggaattygggttyggttygtyggatttttttagygtttyggttttttttygggggtttggggagtaggggttgggygtgaggggygygygatttaggttttgttagttyggaagtygtaggtagtygtaggtyggatattttttatttttygttttygttttattygttttatyggtatttgyggtggtttgggyggggyggggtttygtttatttggggagtygaggagtaggggtatttaaattgygggtaggatatggygggygyggttyggggyggaygggyggggtttgtagggttttgygygttggggtyggygtggygyggttattgtttyggagttgtaggtttttaggygttgggagggygaagtaggagagtyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggttygtaggygtttygtaygygtttygttattattgtttaatygagaattagtaaygtttttygtyggtttttattttaygtyggaatggatttttagaatttattgyggtygtaagatagttygtaagagttggttaaaatgtttttaggtgygtgggggtttyggggttttagttggagttygatattttgagattggyggttygagggttgtagggtygtttygggygtgygtttatyggttttgtatttttgggtagtygagtgtygyggagaaygttttattttttttatygyggttttttaagttttygtttagtttatygtttttatttygttttttygattttttttttygatttttttttygtyggtygtgtttygtyggtttttttttgtttttygyggttaagtyggggattgtygggyggttttgygygttyggaagagtaggttttttaatttaggtttyggtttttttygttaagttygtttttttyggygtttygtagggttggttgygagggagggggygttgggtgtttggyggaggygtttttttttgtttattttgtttagttttttgtttggggygtayggagtaatyggaagaggggatygagygtttattttaggattttttyggttagtattttttttgggattttgtttaagtttaaagyggaggttagtgagtaggyggtaagggggyggtaagggggygttygggttatttygaattygtttttygttttttgygttatygtttttygggatygggattygtttyggttgttttygttttttgggtyggtttttygtggtaagttgggaaggaagtygtgtaaggtagygttgtgtagatttgtttagaaagatttttgggtttagatttgtgaatygttttagggttattttttaattaatgatgaygttttygttttttttttagttgtaagtttgttttttagaaaygaaatttgtttgtttttttgatagttyggttgaaggtgattgatgattatttggagattatagtatatattatataatatttgttgygtaattgttttaatttatagatgaaaataygagtttttygatygygttggatyggagygggttaygttygagttgtttgtagagggaaattatyggaaataatgaatagtygttttatgtaaattatttagatagtttagygtyggtagtygygagaaatatataaagaataygagttaaatgatattaataattgtttttgaattttgtattgatttygyggtaggtygygttttttttttttttatttgaatygttaatattatttttttgtaaataataagaaattagttatyggggtttttygttagaaatgaattttttaatttttttttttttttttttgtttttttttttttttatttttttttttttttttttttatttttttttttttttattttttgtagttttttggtttttttygagtatttttttattttttattatttattgtttataaattattygttttttttaggtaatgaggttyggttgaaggaggggtgtgagtttagtygggttaagggttgggatggggagtagagatttttagaggggaggtatttagttgtggtttgttttttttttatttatattyggggatttggtttyggygattgtgagtatttygtyggttgagggggagagttagggtttaggggtttagttatttatgttttgtatttttgggttttagtgtaatagtttagtttatttagatttgaggttggtgtatttttttttttttagattyggyggggtttaattggagtygaagttttagaataggyggttatttattttttgagtagagtttgggagaagtagtttttattttttagggtagttagtaygtgggggttttttygggggttttttttgattattatygttatttttttttgtttttttttgtttttttagtttgtgtgtataaatygaygttttagtttttattagygggygatttttttttygtgatttagaaatttggtttttgaatyggtttttttaggtygtygtatatataygttttattttttgttygttagtaggttttagygtttggggttygggtttagttatagttattttgtttygggaagttygtaattgtttaggaggttttttgattygttyggttttatttaggttttattatttattttaggatatagggttaatttagtttgtggattggygattatygggatattttattgaaattttgtagtttggtttaggttygtttgtttaaatyggggatttttattgggttattttttttttatagataatattggaatattttttaagtgtttttattaaaaggttaagtttggagyggaggtatttagtgttttttttattaaygataggaygtttagtattttaggtattagttgaaygygtttgtatagattyggagtgttgagtttttttttttttagggattttyggtattaaatatattygtgagtaggtgggttagaagttagtyggttttyggagtatatagtatyggtttagtttyggggagatgaggtgttttygttggtttggagygtttygaagagyggaggattagggtyggagtaggtygtaggggaggtaggggatggttagtttttaaygygaagygtaggygggtygtttattttgayggggttatygttggtygtyggaattatggaaggttttyggggagataggtygggttttgattttttttyggttagtttagttttggtgttttaggagttattttgggggttattagtttttygtattaagagttygttyggagggagttttttttagtttagagaagttaattttagttaaaggygaagtygggagttyggggtattaggtaagggtttttttttttgagatttggggttagagattttgggggygtttgtgttygtttatygttygggatattyggttggggtgtgggtttgagaggttttayggtygttgaygtygtattggygaatttygaggttggtaggttatttttttatagtttygaggttttttyggagttagtggtaggagaaggagttatagggataagyggtgaatttttggatttttaatygttttttatgggggttygyggtttttttttttttttttttygttgygttttygtygtttgttttttgggtayggtttgaggttggayggagygtygttygggygtttaggatttaggtttggttatttygagttttttatttttygtttygygtyggttygygtattttgtttttygtaatttgtagtaaaygtagyggtttttggagagtttagygaygggtagtaaattttgtttttttaagygtaagagtaattttygtaaagtttgtgyggyggagtttattttttatttgagttggggaagttttygttygygtygtgtggttgtyggggtygyggggagtagttygtagttygggaygtatyggggagtygtygtagtygtygtygttygtttttttyggyggtygygyggagttttygttttttyggaaggggggaggggtttyggaatttyggggygggggygggagygggggattttatttatttgyggtggygttgggtygttttyggtagttygygagggtttygygyggaagttyggygygygygttttagyggggagtyggygataattaatggagatatttttaggyggagtatttggygagyggagygygtyggygtttttaggygtygyggtygttagtygagttygtatyggygtgaygtgggygagygagygygttgtttttattyggtygtttattaaygttttttttygygggygtygygtttttgttaattttttttttygttyggtttgygygyggygygtygggtgtaggagttggggtgagggygtttygggtgttagtaggggygttgggagttgtttgggyggggaygtagggtttygggaggttatatagttttaataggatagtgggaaggygygygagttagatttggttaaaygttaagttygttgyggtttygggttttyggtttayggggttttttttttygtttgggttgttttatttagggaygtttgggtygggygygaagagttyggaaatagttatttttgtygtyggttyggttttttttyg

SEQ ID NO: 6022 - DNA, 1233 bp, synthetic construct
  misc_feature 1..1233: note = Description of Artificial Sequence: Synthetic polynucleotide
  source 1..1233: mol_type = other DNA
tygygttgggttgygtttttgtaggagttaggtttttttatgttttgyggygatagtygttggggtggggttayggggaagtygygttgtttttygtttgagygtgggttagggtttaggtggtgattaaggttyggygtagtggtttyggagygtggaggggtagttgttgggyggtttttygggggagggtgayggttttattygttaaygttgttttttttttgggattaggtyggaggaattttggatygttygaggttggtgtttagttttttttttttattttatttttattattyggygattttygtagatttgattggtaggttttgtttygatttttatttttttaggttttygtttyggtgtttyggtgttyggtttygggttatttttgtaggttttgtttagggtagtyggyggtgtttggaggygggttygtttyggttgttttaygtttaggtyggtttttggtattttagttagtgggagggygttttygtygttttygtgttttttygtaggggttgygtygygttttygggttttttttttygtygtggtttggtttgtttgttttagggygtagttgygttygttttagygtttttygggtttgygtggtttgttyggtttagaggtttttattayggttygttttttgtyggaygtygygttgttgtggtygyggtggttttgtggttgtgagggtygtttttgttygtttatatygttttttttttgtaggtgaggaatggggtttgtttygtttggaatgtgtttttgtygggttttgtttgatttttattttttagtygggaygygygagttttttygtttggttgagttaaaaagggatygygygtatttygtygttttttattaygaagygtagatataggaggttgtagggttagtgttgyggagaattttagayggttttatagtygtygttattygyggggtattygttygggttttgtygaggatgtgggggttttggttttygtagagttgggattttygaaggttttattagaaatttaggagtagttttagttttgtagagttygygagggtggagaygggagattygttgtggggtttgaggttgagatgtyggtttgyggtgaagtyggygggaygttttaattygtttagattygtttatttygtagggttygggtttatttttyggtttgtggtttgtgttgggttgygtagtyggyg

SEQ ID NO: 6023 - DNA, 2865 bp, synthetic construct
  misc_feature 1..2865: note = Description of Artificial Sequence: Synthetic polynucleotide
  source 1..2865: mol_type = other DNA
gygagttttagttygttgttygtttagagtygtttaggtgygagggygtttttattagaaatyggtgttttygygygttttatttttyggggttttgtagatgtygggtygggggtygttagtaggttttttggtttttgttggagatattggaagattaggygattaggatagygggtygggttagtgyggtgtgataygagggttygagyggtttygtagtttaaaygtgtttttattttatattttttayggttgtttyggattyggtgttttygtgttttttagtttgtttagyggtaygtgggttttaagtttggtttttagyggttgygttagtttagttgtgtttattttggggtygygagggttttttatyggttggtagttggtggataygttgttaagatygggggaaaaaaaggaaggaaggaggttagggggatatagggttggtggttttygtagtttttgatttgygaygggygygagygtattttygygtttttgygtagagatttttttttaagattggtttaygaygttttttatttygaagttaagggttttttgtggtaaatttttataygtttttttttttttygtttattttyggygttaggattgayggggagagggtaaggtygggttagaggggttgtgggtttggattgyggttgtygttygyggttttgtttttttgggtagttagaygtggggttagygtttagtygtagttttygggggtgagttygtagattttygtaygtgatataggttaggtatggggayggggagtttttygtygttygtttttatttagatgttttttgaggtttyggaatatttygttttttattttaggatttgattaatttttaagttayggtyggtttyggtttygygagaygggggattttgaggattgttttttttttygggttgggatttttttatagtagtygatygtttttagtttagagtggttyggttygtagygtttttygggtataggttttaggtggayggtttygttttygygttyggtttttttgttygttaagygtttyggggatttttyggtttttaagyggtygyggtygggtggagttagtttygaagttygggatttttygaagggagaaaattygttttgtttttttgaagyggygggagaaatyggttttatttaggttygggggttygaygttttyggyggaggtyggttttaggggttygaggttttygaagttggaggtyggtttygtttyggygttttttygtygttattttygtttttatttygygggtyggyggagggaggggyggggtygtttgtygttygygattygggttyggtttttttagtgattgtttttgtttttttygygttagttgtttttagttttggggtaaygttgttaggtgtttagttttygygttygagagagygtttgtttggttttgaattttggttaggaaggggygygaggggaaggtttygggggaaggygtgttttygygtttygtttygtttygtttyggaaagttttygyggtttygtttattttaggggttygtttagttttyggagatttttttttttgagygtagtygtttggtgtyggttttygtygagttggagygygygggttayggtttttttggggaygtagaagygagaagyggggatttyggygygygtttygygtttygttttttttgttygygtttyggttttyggttygygtttyggtygtyggtatggtgttgttggtygggatygggtyggagggyggyggggygygttgtatgattttattatygtygtttttatttyggggygygtaggtygaggaggatttygttgattaygaagagtttgaggatttttygagtttgttagatattygtagtatygtttyggaygattttttttattttttygaggaygaggaggagtayggygtygagagygyggagagygtttyggagggygtttyggaaagygtttyggagayggygatttttttgygygtygtttgygttaataaygtggggttgttgyggaygttggtgyggygyggggtgagygtygaggaggygtaggagattgatygtaayggtagggtaagygggygttttygtaggatttgagtttttttattgtttttattttttttttttttattatattttygygttttttagtttttggtttyggatyggtttttyggttatttagtygtygtttagagygtttttttttygttgtttgggagygyggtgttttgggtggttttttygttttaggttgggggaygyggtgyggggagggagtagtygaggtgttagygyggtagaaaygttagttyggygtttttatygtatttttttttygtttatyggttttygtggattttttgattgaattygygttggttgttygtgttgtaatttaggatgggttttttgyggttyggtttttttttgattattatttttttttaggtttttggtaggggattatttttttttttttgtaggagatagttttttttgtttagygttttatttggtttttgggtttttygygtygtttttgttttaataygttggggygtagatyggtttttttagtygtaatgatttggaagtaatagttttttttttygtygggatagtttggttttttattttattttygttgagttttgtggttygygtygygattagttaaygtgatttttgattggtttgttygtaggttattttygygagttaatgttagtyggggttttttagagttagggtatagggagagttttagagtygygggtatttattygggtagggtaggaggyg

SEQ ID NO: 6024 - DNA, 1154 bp, synthetic construct
  misc_feature 1..1154: note = Description of Artificial Sequence: Synthetic polynucleotide
  source 1..1154: mol_type = other DNA
tygttttttttygtatattagggaygttatgaatgtatygagtatgtttttagggtggyggggagtagtattgtyggtgttgttttaaataygttttttttyggggagatgggtggtagggagggggagtaygtagggtagttatttggtaatygttttaagaaaggtattaatttyggatttttttttaggtatagyggttttygagggggatttggygygatygyggtttttttygaggtaggtagaaatttygtagtagtygtygtygtygtttgtyggtygggagtttaggattatttttattagyggtaagaggaggaggayggygtygggaggaggttgygttyggtttyggtygtttagtttygtaatttatttaaaggygyggygttyggyggttttttygtaaatatgtatttttygtyggygatagttttttagttygggaagaggygtgygyggygtygttyggttttagggtaaggttttgattttgtttaattgtagtatttttygtttttgttgtttgagygyggtygygggataagggatgttggygggyggtaggggygagygtygygggygagaggyggttttygaygygagtgygtagygttyggttyggyggttttttygagttyggygagygtagygttttttgtttggtttygygggttttaygggtttttgygggtttttyggggtttygggygtygtygttagtyggtygggttgagagagtagtygtygygttygtagtttygtttagtyggttgtygtygygggygygagtttggggtygtygyggygttyggygtygagygttttygagttgygtttygygygyggttygygttatttgtgtygtygtygttttagtygtygagggygaggtttttttygyggygygyggtagttttagtttttatttaaatttyggyggtyggttygggygttyggttagtgagggagygttygtttygtygtygaaatyggtttygggtgyggagtatgtttagtgtygtygygagagyggygtttygtygygygygttttattttttttggttttygyggtagtagyggtagtygygggagagaggggaggaggtygygggttgggagagggtygagtatttttgggaaygtayg

SEQ ID NO: 6025 - DNA, 1154 bp, synthetic construct; identical to SEQ ID NO: 6024
  misc_feature 1..1154: note = Description of Artificial Sequence: Synthetic polynucleotide
  source 1..1154: mol_type = other DNA

SEQ ID NO: 6026 - DNA, 396 bp, synthetic construct
  misc_feature 1..396: note = Description of Artificial Sequence: Synthetic polynucleotide
  source 1..396: mol_type = other DNA
tygttgggaagggaaaaayggtttatatygaattggatgtyggatggaaatttttttgygttattagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtygggggttygagyggttaagggatgggggtgggggyggggagagtggggggagggygaaagatygtyg

SEQ ID NO: 6027 - DNA, 438 bp, synthetic construct
  misc_feature 1..438: note = Description of Artificial Sequence: Synthetic polynucleotide
  source 1..438: mol_type = other DNA
tygygtggagagaaatgagttggagagttatatygagttaaygygggatayggttttyggttygggtygggttaggggtgggaggyggttttttatygtaggyggygggatttttatgygtygagggatttaagtttttattttatttataygtttattyggygtyggggygttgyggtttygttttaygagtttagagtaggtygtagtttgggttggggattyggtatttgggtagggtgagtttggtyggatatttttttttaggattattygtattttatagtygygttaaaagygttttatttttttgtttttygtygygtaggttttttatygaygttygttyggaaggygagagtttttaygtggttyggygyggygyggttttyggggatygygagtaataaaagttyggttygtagtttttgtttttyg

SEQ ID NO: 6028 - DNA, 438 bp, synthetic construct; identical to SEQ ID NO: 6027
  misc_feature 1..438: note = Description of Artificial Sequence: Synthetic polynucleotide
  source 1..438: mol_type = other DNA

SEQ ID NO: 6029 - DNA, 411 bp, synthetic construct
  misc_feature 1..411: note = Description of Artificial Sequence: Synthetic polynucleotide
  source 1..411: mol_type = other DNA
gyggtggtgtygatttatttgagtagttgtttygygtttagttygtygygygtagtggygtgygtyggttggatggtttggtttatgattatttygtygggygtyggtygttttatggttagggygagagygttaygtttgyggttttygatattttattatgttygtttygttygtttygtttttttygtttagttttagagggtattggygtygttygttygggtygygaatttttggtygttaggtggtgggagttgygagtgagggggttygtattgttattttaggattatygygagtgggggaaaattagygttttygggttttaggagaagtttgggaagtgygyggggagggggttttygggtagataggtttggaaggyggtttttygagagtyggagygyg

SEQ ID NO: 6030 - DNA, 1137 bp, synthetic construct
  misc_feature 1..1137: note = Description of Artificial Sequence: Synthetic polynucleotide
  source 1..1137: mol_type = other DNA
tygyggttaaaaygtttagygtygggtttgggtttgygaayggtttagtttaggttttgygttagagtatygtattygggggyggayggttttgtagttttttagttttttttygtattaattagttgaygttygggygtattggtttttttygttttygttygtaygaaagttttgttygaygtttgtagttagtatygttygtattgtttagggagggtttgygtygagatttagtggtygagtgagttatagagtygttggttttggggaygttgttttttatygttttttatygttttttttttttttgtattttatttyggtatttygtattttttttttygttyggtttygygtattttgtttagattttataagtattttttyggggtatttaggattygaygtttttttygygtygttagyggygttygttatttttggtaygtyggagggatygttttyggttttttgygyggygttttttaggggatttttagtttattttttatttagttgttygggtttygaygttttatttttgtygaattgggggatatygaggttgagttygattaagagttagayggttatygagygttttatgatttygtttttyggaygtgatttyggttggttaggggtygtygyggagggtagtgtagtygaggtggtagygtagggtagtagtagatttygtttttattaaagaatttaagaagaygttttttttttttagygttttgttaaataaatttttggagagggygagagtggtgattaaagagaggagttttttttttttttttgtttgygtttyggygygyggaggtgggtgagtttyggggagtygtyggygggtttagtttttygttgygggtgggtttyggtagaggygyggygggyggggygygggttttygyggtygtttygggtttgttgygygggtaggtagatttatyggtagataggyggatygggygttyggttgtygttgtttttygygyggyggttgyggggtttttgatttggagaataatgaagygtgagttggaggggagygagygggtygtygggagygtattgtgtataaatagaggyggygtgygtgtgagtttgagtttggtaggygyg

SEQ ID NO: 6031 - DNA, 2383 bp, synthetic construct
  misc_feature 1..2383: note = Description of Artificial Sequence: Synthetic polynucleotide
  source 1..2383: mol_type = other DNA
tygaygtgttaaggaaagygygtygtaaggtggagygttygggttgaygatgagaaggtgagttgtgaattttgtataygtttttaaataaaaggtttaygagyggyggtttygaygtggggagtaagtaggtttttttggtttttgtagtaggyggatttaggttygtttgtygtyggatatttagaatttgttttygtagygygagttttgtataygttttgygatyggtatttttggattttttaattattygtygtttaattttyggagagagggtttttygttygttgagttgyggggttgggaaggaaaagggggaygygtttttgggggtttttggatattttggtaaagggggttgtagttttaggttttagttaaagggtttgggayggagtgggttagaaagtygttaaattgaggattttttttttttttaagtyggagttttaggtgyggagtygtttgtttatttattttyggagtaygttttgttgttttygtyggyggaygyggttggttattgyggtatttttttygygatattygggygttagaaattygtttttagagtttgttgtagyggatygaatttgttgyggyggyggttggggtyggggyggtttgggyggaggaggttgaggttggtyggtygtgttttgygtttagagtattatatagtttagttataggaagtagagttggagatatagttttygttttttttttatygtyggygtygaaagygygyggtygtagattygyggagagggagtgattaaagataaaatttgygygttttagaaaagagttagggtttaataagtttttygtyggtttyggggattttttygggttygggttttttgttttagttggagatttygatagagygtyggttttttgattgtttgygaagygagaygyggggygtygggtttagygtagtgagyggygaggygyggyggaggtgtagtyggtagtttygagyggtataygttgtataatyggtttaaagtttygagygattttaggatygttagygggygggggaggaaattataaaagttttggygtaaaattttaaaaaatgtgaattttaaaagaaaaaagggtttgtaygtagagttyggyggattttygtgygtttygaagayggatattggaaagttgtaaaagttattagaaagaaataggtaagtaaataaaagtygtttttagaagaagaggagggtttttttygggttygttyggagttttatagggtaaygaagygygggtagyggttgyggagtygggyggaggtgygyggggtyggggygtgyggttagtaagagagagggygggaggttgggygttggagaagatgyggyggtggagggygyggygygggggttttagaggttyggyggggygyggggygggtyggygggyggyggttgttagtgggggygyggtygtttataygtggggtttaattyggattgagaggtyggygtagagtgggyggggatagagtaagggagagatygggattgaggaaygaggggaattagggttgggtgaggggaagaggaaggaagggggggagggygaagggagggaagaggayggagattggggagaaggggggygaattygagaggaaggtygggttggaagagggatttggaaagagggattggygagttygggtgygagaggaaatgagygggggatgggggygaagttagggtaaagagagaagtgggaaaggagagggagggttaaggttygggygtygagaggaggggttyggggggtyggttggagggggygaggygttaggyggttttgtttttygttttygttaattggtygttagttttgttttgattgtttgtataaagygagtagayggygggggatggggygattagggatyggatttgggaaaggaggtagtagttttttttttttttttttygttttygttyggtygyggattagggattagggtgtttaagygygttaggtttggtyggattygtagttgaattgattygtagttgaattttttygtyggatagaggtygtaaggttgaggatgagaaygggtttttttgtagggtttyggtttttgatttgggatggggggattygtagttagttaggaatagaggtttayggggttgttggttgtagttttaatttaagaaggaggagattttttttttgtttttttatttttatygttttatygggagyggygttagtttgygggattaaattaggggttgggagtttttagattgaaatgygttttttattattaagagggagtttaygyggtygyggggggtygaggtagttagtyggygtygyggttttggggagttyg

SEQ ID NO: 6032 - DNA, 2367 bp, synthetic construct
  misc_feature 1..2367: note = Description of Artificial Sequence: Synthetic polynucleotide
  source 1..2367: mol_type = other DNA
gygatttyggttttggggttttgtttttgtygygggagaataggttttaatttaygaagttggttaattttagaaattygagattyggtttttgagaagygattgygtgtttygggattttgygttaataattaaatttgggagaagtygygggaatgtttttattggaygttaygaagggaattggggttttttttttgggaagaaaaagttygatttgtgtyggygagagtaggttgttttgggttgggggtattttygagygttgyggygggaygtyggggttyggggygaagagagttagggygyggatygaygtttgttgtttttttgyggtattgttgttygaaygaaygaaygaaygaaygaaygaagyggtttygtttaggaaaaatatttttttgaygygaagttayggttgaagtttygggttaygtagaggggttagtaattttatgggtggtggggttttttatttttggaygtagyggggagtagygggyggtttttttttttgtttattttttttgggggtgggggagttttgtgttattygaygttgygaggggttgttaygggttttttaggttgtgtttttygyggggtygtggttygtgttttygaggttgttatttttttgaggtgttyggagttaaagtagagggttgatttygtyggttgggtgaggtagtattyggtgayggyggttatgattgtgttttgggygtaggaaygagtttttygygttgtttygaaggtttttgatttttygygttttgygttgtttygygtygtygggtggatttatataygttaggagtaaattgygtaggattyggtygttatttttttgygtttttttatygyggagattttgygtttttagtttagygttttttattttatttgggtagygttgygtttgyggttygtgggtttygggttygttygtygyggattttggtttaggtttyggtttyggttggggtttyggatttagttttggttttggtattgtayggtttttyggtttttgttggttygttatattttagygygygaggtyggggttttttyggttyggttygtttttttygtygtygtygttygtygttygyggggaaggyggggatattggtygggaggygggaagggtggggggaggggaagttaggtgttygtygggatttgyggggagaggggyggygygtagtttygtyggttaggggttttggtttttttyggggygtaggttggggttygygyggttggyggtygggtttygaggtyggggagygygttttgggattttygtggaggggttttgtygtatgyggaygaagttagagygggttttagtttggttttggggtattttttttttttgggtttagttttttatttgattygtgaggggttggttttattttygtttagaygggggttggtggtygagtttggggttttgagattggattttttttttttttgtttagtttgygggagggagttggttttgygtgttggtagggagagttygttgtttagagygtggtagttagggaggtttgaggatagattttaggttttttgtgtttgggggtagggggtgttagggtggggtaatygttygatttgttttggttgggggaattgtttttttttttttttttaggggttgggttggtgaggaaagggtatattaattttttaggatagatatttttggggttttttgtttaatttttatgtttgtatattttttagygattattttgttgygggtttgygaayggtgaygtttttatttttgtggtttygtaggtygtttttggttggttgtygttgggagaygggttggaygtaagggaattgggagtttgttttttgtttatttttaggttatagggttttttagygttgtttygtggttagataattttgtgygygaagttttatggtggaaattagttggtygaatttatttttggtatttygaagtgtttagtttgagtttgtttgttgttgggattatgggatgggattatagggtaggtygggttgtggtttgttttttttagggattggagyggttaagtttgttygtygayggttaygggttttagagygatygttttyggygtaaggtgtygggagatggtagygyggtagtygggtttgaattttttatgagatgtagttagtagyggygtttttttgtttggttttygtygatagttgttgygggagaggtygygattygygttatttyggygttttgttagttygtgtttttagggtygtttggtttgggaaygtagagatttaygattttttttttaattttygaagygggaagtyggttyg

SEQ ID NO: 6033 - DNA, 1235 bp, synthetic construct
  misc_feature 1..1235: note = Description of Artificial Sequence: Synthetic polynucleotide
  source 1..1235: mol_type = other DNA
gygttagygygtgttttgtttagagagttyggygttagtttatttttygtgtagttattggttgggattttgtgtgtygttgtyggttaatgaagaygttggagatygggtttttgttygttttttttttgygtttygggatgaggtagagattgaatagtyggygagtaaattaayggtatttagaaagttatgtyggattyggygtttagygtttaagygttaattygttgaaagttttttagygaaattttagggaygatttggatttygttgagaggaattgtttttgagtgagatggttttagaggtttggaggagyggattggtaagtatygggagggtagtgggagttttgtttttgtttggtgttttgaataaggtttttayggttatttattatgagatttyggaggaaagagagaagggtttygttgtgggtaaygtggtygygaattttggtttggatttyggtagttttttagttygtaggtttygggtggtgtttggagttagtygaagattttttgaggtgaatygggagatyggagagatgtttgtgaaygatygtttggatygagaggagttgtgtgggatattgtttttttgtattgtaattttggagttggtagtggagaattygttggagttgtttagygtggaagtggtgatttaggatattaaygataataattttgttttttttatttaggaaatgaaattggagattagygaggtygtggtttyggggaygygtttttygttygagagygygtaygatttygatgtgggaagtaattttttataaatttatgagttgagtygaaatgaatattttgygtttygygtgtagaygygggaggatagtattaagtaygyggagttggtgttggagygygttttggatygagaaygggagtttagtttttagttagtgttgayggygttggayggagggattttagtttttttygttagtttgtttatttatattaaggtgttggaygygaatgataatgygtttgtttttaattagtttttgtatygggygygygttttggaggatgtatttttyggtaygygygtggtataagtttttgtaayggatttggatgaaggttttaayggtgaaattatttattttttyggtagttataatygygtyggygtgyggtaattattygttttagattttgtaatygggatgttgataattaagggtyggttggatttyg

SEQ ID NO: 6034 - DNA, 3043 bp, synthetic construct
  misc_feature 1..3043: note = Description of Artificial Sequence: Synthetic polynucleotide
  source 1..3043: mol_type = other DNA
gygagggtttyggggtggtgggggtgtyggttttagtatgtggaggygataggattygtaagattttaygygtygtyggggtaggatygtatagggtygttatttatttatttggggygtttttaatgggtattygtgtattttagttygtgyggtgagygtaygtaygtygtygttgtygygtttatayggttttttaaagtygggggaggggtygtggagygaaggagttgtaggtagatttttttttttttttygagttgggaaaagggttagtttygtgttttgtaygtttggttttgttttgtagtttgtyggtgagttaagagtyggtagagtagaggaggygtayggttygggtygtgttattattttttggtttgttgatttggttaggagttggggatggyggtagtatygyggaggtaygttttgygttgtttttaygttttttttygaaagtagtgtttttagggggaaagttygtaatgttatttgtttygtyggtaaagttttgggatgtygggtattttttgaggagggggaagaygyggtatttttattgaggtyggtaggttaggaagagaagtttttygggygtagggygtagtttagtttyggggattttttgggtttttygygtgtyggtygggatgaagygygttttgtatyggattygggattygggggygggggttggygttggtagygttagaygttgttttattttttttygattttggggaggatagtaataagttttgttttagttattttattattttgttagtaygtgtagatttygggttttyggagttyggygyggatttygttttgtttygygtttttttttgtaygtttygtgttattttaagagtttgygtggttttgggtgggygtttggttttyggygaaaygtttggggygygtygygtgggtgtayggtgtttttttttagtagttttyggttgygggggtatatgtatttatttgtattttgtagggataggyggtttttttgttgggagtttttgttttggggattttygggtgggttggtggygtyggtttttygygtygggttaaaggtggttaatattaaagttagggttatgaattggtttagtygttyggtatatatggtttttggtattaatttttygtygggagatttggattttttgtgttttttttttttttttttttttttttttttttygtygtttttttttttttttttattttttttttttgttygttttttttttttttttygyggtygyggttyggatagaggttatttagygttttttygtagtttttyggagagtatgtgattaggtygttagtagygtygygagtgttyggtaatggtagggatggtgttttaaatatttttggaagttttggtgttatttgaatgaaggagtygagtaggtgttgtttyggyggttggattaattygagatttyggtttttttgataatayggtygggaggyggggtttgygtttaattattataggaggaagtygagygtygttgggagygtyggataaagttgtygatttggyggyggttaygygtttgygtgygtgtgtatgagtgtgtgtgagygyggtyggagatgygtgygygtgtgygggtgttttagggtaatggtygaaaggattgtataatataagagygaatttaagttttagttgttgttaaagggggayggtgtgttttgggatagtgtttttggggtttttggttygygttatatttatatygggttgggaaagtttttttttttygtygtttggaatttagtgagatttttagtttagaggatttgataaattgaagtagttttttaggtataatgatgttgtgggttaattgagtatatatgggaatttttggttttgtgatattttgtattaaaaagaattttaygattgaagataggagtagaagtattagatatagtatttggtttgagtaattgttttattttttygttttggtgggtygtgtaatatttggagtgtygtttttygttttttttttaatttagaygtattttaggttgggttgtagggatttaggtgatagttaggatttgtattatttttaggagggtggtagggaggtttaaggtagttttgagttagttygtygyggagtatygygtgttyggaggttagagtttgaaaggtaattttaygygtttttaaatatatttttgtatttttttaaagygttgttygttatttygtttygggtttttttttattttttagttattygatggaagtggtgagaataaaaataaagataaaaaagttaaattyggggaagttatttttattttttttttttttttgttyggttttttttttaagaatygtygggtygggatagttttyggttatttttttattyggttygtggagggaaggagaaagttgggygtygtttggagygtttttttttttgttgtgtgtgtaygtgtgtaygtttaygtttttttygygtyggggtyggggataggaattgttttyggtttygttattttayggygtagttyggggggttygtagggttgggggagggyggggataygagygtygygtttaagygttttagggtaygtattyggygttggygygtattygttttttttttygtttttattttttttttggagaataggtgagtttyggtattagttttygattttttattttygtttygygtttygttygygttttttgyggtaatgygtttgggaagttttattatttattgtttaggygaygyggttttgggttttygyggyggggygtattgttygtttggttggggtygttatgtgatayggttgggggagggggygaggagataygygggtaggttattttttggtyggygtttgatttttaaagtttttttttttygtgtttyggttgtaygygggagtggggaaggyggaggyggggggttaggatggttayggttggtygtagttattyggygtgtygagtttttttgagtyg

SEQ ID NO: 6035 - DNA, 864 bp, synthetic construct
  misc_feature 1..864: note = Description of Artificial Sequence: Synthetic polynucleotide
  source 1..864: mol_type = other DNA
tygtaggygyggagttgyggttgtagttattagtttagaygtggygygttygtagtaagtggttggatatygtagattaggttygygtttttagtagygyggatttyggggttagtygtttaggtagtaaagttaggyggtyggtttygttagtagtygatgagttttattttgtggattgtttagygttagggattaggattyggagaggtgtttaggaggagtagatttttagattaggtaggttgtgtattyggtgattttgaygttatttaagggaagtttygttatttygygttagtgtttgagttgtaattgtaaattgygygttttggtaygagtagyggtgggggygggtgggggaaggagygagtgattttttaggygtttttygttatttgatattagttaggtagtttttagggttagagygttagygtygaagttaggtttattygggaagttatttyggtggtygyggggtgtttatgttagtattagattttttttyggaaggaggagyggggygggttatayggttaggygggttttttttttaaggyggggtgggtygygygtttgygatttttygttygtggttttggggtagttygggttagttaggagaattygygagtttagyggygtttgtatttgyggttttygggagtygggyggttttgygaggtttattaggtttgagaggtyggaggtygttagtgtygttgttgaagggtggattaggygggatygyggattttgggttagatygtagatttggtatygyggattgggatttggatyggggattttgagttggattayggattgggggttggatygyggattgggggttggatygyg

SEQ ID NO: 6036 - DNA, 2071 bp, synthetic construct
  misc_feature 1..2071: note = Description of Artificial Sequence: Synthetic polynucleotide
  source 1..2071: mol_type = other DNA
gygagagtagyggagagaaaggagttagagaagtgygtatttattagtttatygtagttgttgagygttatagaggaggtttyggttaggtyggttaygttttygaygtagagatagttttygagtaggggttttaygygggtggtgtttttttygttttgttattttatagtggtttygggygttaygaggygggygttgggtygtagtygtaggtgtaggtttyggttaaagatygtgatattgtagaagaggtgattgttaggttttttttygttgttttyggggaagttyggggttyggatyggggyggttttgygggttygtatttttgttttggaygtagttgtygatattaygtgggatattaagyggttttgggygttagtgygtaygggtatygttaggatgygtttygtttygtgttttaggggttygtttgtaaygggaaggggygttagatyggyggagattayggagttttagtgttttagagattygtyggtaagttaygtttttttagatttygttttattgygaagggaaggggtatttygttaggygattttagaagttagtttgtattttttyggtttttttgtaatygggaaggggygttaatagggttattatttyggggtttygttattttttagtygttttttttttyggagattttgtttgttaagagttttgttttttgtttygtttagggttggggttyggtgggaattttttygtgttygaagggaygatttygttagagagtttttygatttttgtatttatygtttttggtaggaygtggagttgttyggaagttatttygggttggtttttttattygtgtgttaygatttttyggygggtttttgtygttygagtgtttttatygttagttttyggagyggyggagtttyggttttttygagtaygagyggtttgttttgtttgtttagttttygtttagttygttgtyggtttygttttttygagygttygaggattgggaggggtggaatagggttttttygattttyggggattttttgyggggygttttaattaatttttagggtttaaggttaygygttyggtagtyggttttttyggagygttttyggaygygagtttyggygtygtttygttttggtttttttttyggattygttggggttgattttgygtttttggtygyggggtttttttyggtttttygtttttatttttygygatttaggagtygttagtgtttygaggttttttyggtttaaggygttygggggyggtgyggggygttttttgygygattaattyggtttygaagttggttaatttggtttygggyggggygygyggagtttgtttaagttaggttggaygaygtttggggagggggyggyggggtaygygggatagggttaggtyggygggggtttyggggagtaggggtygggtygtatttatttggggggtyggyggyggyggygagtttggygttygygggyggyggyggyggyggtaggagyggyggyggtagtagtagtagtagtagtagtagtgyggggtagagtaggyggygagyggttttygtyggyggatttatggtagtyggattgtagtyggggtttygtattygtagtyggygygaaagtttttygygagtygtttagtttatatttgggggtagttggagtygttygtagttgtagtatygtagggygyggggyggaggaggygaggygyggaggggygggygggggagygtggagggaaggyggggagagggaaggagygagygagygagggaggtaggygggagggagggaggygagygagggggagggyggggayggygggygttttagtttgyggtgattyggygtattttggygyggtygtygtygtygttygttttttttttygygtygtygtygtygyggtgtygggttygtagygaagtagagatatttygaggyggyggtagagaagygtygygggtygggtygggggagtttygtygttagttattttaggggtataattttygaggagyggygtyggtygaayg

SEQ ID NO: 6037 - DNA, 1170 bp, synthetic construct
  misc_feature 1..1170: note = Description of Artificial Sequence: Synthetic polynucleotide
  source 1..1170: mol_type = other DNA
tygggttggygggtattgagttggggttattaygtttttttagagygtttgyggaggtggygaaggtttggagagtataygaggyggaattyggatygagtgagttttttgagtygtttgygtgggaygtagggagagggygaataaygtttttaggygttgaatgtaggggtaaggagttagygagggtggttggagtaggttttgttagttgttattaagtttttttataggtttgggggtttggggttttttggaaagattttttygtygygttgattagtayggggttygttttygtattttgaaggttgtygyggtttttygttatttataattaagtttaagattaaggttgtaagttgaggtyggggtattgataaygggaatgaagttataggggaagaggataattgggaygggttggatttatatttgatattygggaaatttttagagygtgtggtgtttttgttagyggtagttattggtggagttgaggttatygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattygygygtaygaatygggtagtgtgygygtgtgtgtgttygygtgtgtgagygygtgtgttagygtgygttttygygygggygtgygtttgggtggatttttgygtggtttgggaggtaaatygggygtttttttaagtygttttaatatgatttaggtttttaaataygtgaaagyggtagatataatagggatgygaaggaaataaaaaataattggggaagtggtgttaagttatttaggttttgaattgaggaygagtagtgyggtygygtttggggygygttyggaaattatttttagtttgtggyggttattgttttatttaaatttttttgyggggagagttgagyggatttttggggggttggttttgggttagttttaaatttttyggttgtatttygygtggttttatygayggygygtttyggygtagtttttggygygggttyg

(The sequence listing continues in the following parts.)

We claim:

1. A method for classifying an esophageal sample from a human subject as a methylated sample, comprising:
providing an esophageal sample obtained from the subject and treating with bisulfite to generate a plurality of bisulfite converted SqBE18 nucleic acid sequences;
amplifying the plurality of bisulfite converted SqBE18 nucleic acid sequences to generate amplicons for each bisulfite converted SqBE18 nucleic acid, wherein each amplicon is a read and wherein the amplicon comprises a nucleotide sequence that is at least 90% identical to the nucleotide sequence of SEQ ID NOs: 8318, 8360, 8332, and/or 8374, or a fragment thereof, said fragment comprising at least 50 nucleotides in length;
measuring the number of methylated cytosines of the CpG dinucleotides in each amplicon of the bisulfite converted SqBE18 nucleic acid sequence, wherein a read is classified as a methylated read when at least 70% of the cytosines in the CpG dinucleotides of the individual amplicon of the bisulfite converted SqBE18 nucleic acid sequence are methylated; and,
calculating a percentage of total reads that are methylated reads from the amplifying and measuring steps wherein the esophageal sample obtained from the human subject has at least 0.1% of the total reads that are methylated reads, whereby the esophageal sample obtained from the subject is classified as a methylated sample.

2. The method of claim 1, further comprising sequencing each of the amplicons.

3. The method of claim 1, wherein the amplified portion comprises 21 dinucleotides that correspond to or are derived from 21 CpG dinucleotides present in the native non-bisulfite converted SqBE18 genomic sequence.

4. The method of claim 1, wherein the amplified portion comprises the nucleotide sequence of SEQ ID NOs: 8318, 8360, 8332 and/or 8374.

5. The method of claim 1, wherein the esophageal sample obtained from the subject is classified as a methylated sample when 1% to 3.5% of the reads are classified as methylated reads.

6. The method of claim 4, wherein the esophageal sample obtained from the subject is classified as a methylated sample when 1% to 3.11% of the reads are classified as methylated reads.

7. The method of claim 1, wherein the esophageal sample obtained from the subject is classified as a methylated sample when at least 0.5% of the reads are classified as methylated reads.

8. The method of claim 1, wherein the esophageal sample obtained from the subject is classified as a methylated sample when at least 0.76% of the reads are classified as methylated reads.

9. The method of claim 1, wherein the amplicon comprises a nucleotide sequence that is at least 95% identical to the nucleotide sequence of SEQ ID NOs: 8318, 8360, 8332 and/or 8374.

10. The method of claim 1, further comprising obtaining the esophageal sample by cytology brushing.

11. The method of claim 1, further comprising obtaining the esophageal sample by balloon.

12. The method of claim 1, wherein the amplifying is performed using PCR.

13. The method of claim 1, wherein the amplifying comprises use of methylation-specific primers.

14. The method of claim 1, wherein the amplifying comprises use of methylation indifferent PCR primers.

15. The method of claim 14, wherein the amplifying comprises use of primers that are both methylation indifferent and bisulfite specific.

16. The method of claim 1, wherein the measuring the number of methylated cytosines of the CpG dinucleotides in each amplicon is performed using sequencing wherein each cytosine base in an original template is counted as methylated or unmethylated.

* * * * *

UNITED STATES PATENT AND TRADEMARK OFFICE
CERTIFICATE OF CORRECTION

PATENT NO. : 12,227,810 B2
APPLICATION NO. : 18/430156
DATED : February 18, 2025
INVENTOR(S) : Sanford D. Markowitz et al.

Page 1 of 1

It is certified that error appears in the above-identified patent and that said Letters Patent is hereby corrected as shown below:

On the Title Page

Under Related U.S. Application Data:
(63) Continuation of application No. 17/590,986, filed on Feb. 2, 2022, which is a continuation of application No. 16/315,405, Insert --filed on Jan. 4, 2019, which is a 371 of-- And delete "filed as application No." before PCT/US2017/040708 on Jul. 5, 2017.

In the Claims

In Claim 1, Column 109, Line 59, please insert:
--wherein primers used to amplify the portion of the bisulfite converted SqBE18 nucleic acid sequence comprise SEQ ID Nos: 8388 and/or 8402;--

In Claim 1, Column 110, Line 45, please delete:
"the esophageal sample obtained from the human subject"
And insert --the sample--

Signed and Sealed this
Fifth Day of August, 2025

Coke Morgan Stewart
*Acting Director of the United States Patent and Trademark Office*